United States Patent 10,006,042 (ISOLATED POLYNUCLEOTIDES AND POLYPEPTIDES, AND METHODS OF USING SAME FOR INCREASING PLANT YIELD AND/OR AGRICULTURAL CHARACTERISTICS) - sequence listing, part 6

SEQ ID NO: 8807 - DNA, 1748 bp, Zea mays
aacctaaacctcgtctcgcctccttcagtccatcccctcaaccccggcggccaaaagccggcgcaccgaagcggcggcaagcggtggccatggcggagctaaagcggctgtcagagagccgggacctgacgcggatcgagcgcatcggcgcgcactcccacatccgggggctagggctggactcctccatggaggcgcgcgacgcctcggagggcatggtcgggcagctgcccgcgcgccgcgccgcggggctcatactccagctcatccgccagggcaagatcgccggccgcgccgttctcctcgcgggccagcccggcaccggcaagaccgcgctcgccatgggcatcgccaagtcgctcggcgcggagacgcccttcgcctccgtcgccgcctcggagctcttctcgctcgacctctccaagacggaggcgctcacgcaggccttccgccgcgccatcggcgtgcgcatcaaggaggagacggaaatcatcgagggcgaggtcgtggagatcttgatcgaccgccctttgtcggcctctgccgctggcggcagctcggctgcccctacaggtgctactgcggctggtaagtcgggtcggctcacgctgaagaccacggacatggaaacggtgtacgagctcgggggaaagatgattgaggctcttgggaaggagaaggtgcagagcggggatgtgattgcgcttgacaaggcctccgggaaggtcaccaagcttggacgctccattgggaggtcgcgggattatgatgccgttggcccgcacaccaagtttgtcaagtgtcctgatggcgagctccagaagcgcaaggagatcgtgcactgtgttaccttacatgagattgatgtcattaatagcaggacacagggttttcttgcactgttcactggtgacaccggtgaaattcgtgcagaggttcgggagcagattgacacaaaagtcgcagagtggagagaggaaggaaaagctgatattgtccctggtgttctgttcatcgatgaagttcacatgctagacattgagtgcttctccttcctcaaccgagcattggaaaatgacatggctccgatcctagtaatcgcaacaaacagagggatcacatccattcgtgggacaaactaccgctcgccacacgggatcccgccagacttccttgaccggttactgatcatcacgacgcagccctacacggaggacgagatcaggaagatcctggacatccggtgcgatgaggaggatgtggagatgtccgcggacgccaaggtcctgctcaccaaaatcggcgtggagacctcgctgcggtacgccatcaaccttatcacatctgccgcactagcctgccagaggcgcaaggggaaggtggtcgacatggaggacattagccgggtgtaccagttgttcctggacgtgaagcggtcgacgcagtacctgatggagtaccagagccagtacatgttcaacgaagtgcccggggaagcagatggagaggacgcgatgcaatcctagatgaacttttcttcaccaggtgtctgtgttagtatgtactgcgtgtctgcgtcgtctatttctggtgcatcttgcttgtttagttgctgttatttcctgacaaggcgtggtgtgtgcgatggactgcctgaaagctgatttaggtaactatatatgcaattcagatgtatcttagtaaaattcaccccagttggagtgacattgtttgtttaaatttgtgcc

SEQ ID NO: 8808 - DNA, 1839 bp, Setaria italica
tccttccagcttcacccacaaaaccctgggggctcgttccccgctctcgcctaaacctcacctcgcctccacccccctcaatcccggccaaaaggcgaaccacagaaccggcggcggcgcggcgggtggtggccatggcggagctgaagcggctgtcggagagccgcgacctgacgcgtatcgagcgaatcggcgcgcactcccacatccgggggctagggctggactcctccatggaggcgcgcgacgcctcggagggcatggtcgggcagctcccggcccgccgcgccgcgggcctcatcctccagctcatccgccaggggaagatcgctggccgcgccgtgctcatcgcgggccagcccggcaccggcaagacggcgcttgccatgggcatcgccaagtcgctcggcgcggagacgccattcgcctccgtcgccgcctcggagctcttctccctcgacctatccaagacggaggcgctcacgcaggccttccgccgctccattggcgtccgcatcaaggaggaggcggagataattgagggcgaggttgtggagatctctatcgaccgccccttatctgcctccagcgctggcggcagctcctccgcgccttctggtgctactgcggctggtaaatccgggaggcttacgctgaagaccacggacatggagacggtgtatgagctcggggggaagatgattgaggctcttgggaaggagaaggtgcagagtggggatgtgattgcgcttgacaaggcctctgggaaggtcactaagcttgggcgttccattgggaggtcgcgggattatgatgctgttggcccacacaccaagtttgtcaagtgccctgatggtgagctccagaagcgcaaggaggtcgtgcattgtgtcaccttacatgagatcgatgtcatcaatagcaggacacagggttttcttgcactgttcactggtgacactggtgaaattcgtgctgaggttcgggagcagattgacacaaaagttgcagagtggagagaggaaggaaaggctgagattgtgcctggcgttctgtttatcgatgaagtccacatgctagatatcgagtgcttctccttcctcaaccgcgcattggaaaatgatatggctccgatcctagtcatcgcaacaaatcgagggatcacatctatccgcgggacaaactaccggtcgccgcatgggatcccaccagatttcctcgaccggctcctgatcatcacgacgcagccctacacggaggacgagatccggaagatcctggacatccggtgcgacgaggaggacgtggagatgtctgcagacgccaaggtcctgctcaccaagatcggtgtggagacctccctgaggtacgcaatccacctgatcaattccgccgcgctggcctgccagaagcgcaaaggtaaggtggtggagatggaggacattagccgggtgtaccagctgttcctggacgtgaagcggtcgacgcagtacctgatggagtaccagagccagtacatgttcaatgaagtgtcgggggaagcagatggaaacgatgcgatgcagtcttagatgaatcctcgtgttacaagatggtggttggattatgtcgtgtatttcggatggttcttgcttgttttaggttgctgttaccctgacgaggcgtggtacgtgcggtggactgtgtctgtgtgttagctgctgtaggtgactatgcagttcaatggatctggtcaaaattcatcccagctaggtgcggtgatttgtttaaatccgtatggcaatctcgtgctggatgtcgtgctggatcgtcggaatagttttcggttcgaaacgtggg

SEQ ID NO: 8809 - DNA, 1756 bp, Setaria italica
ctcgcctccacccccctcaatcccggccaaaaggcgaaccacagaaccggcggcggcgcggcgggtggtggccatggcggagctgaagcggctgtcggagagccgcgacctgacgcgtatcgagcgaatcggcgcgcactcccacatccgggggctagggctggactcctccatggaggcgcgcgacgcctcggagggcatggtcgggcagctcccggcccgccgcgccgcgggcctcatcctccagctcatccgccaggggaagatcgctggccgcgccgtgctcatcgcgggccagcccggcaccggcaagacggcgcttgccatgggcatcgccaagtcgctcggcgcggagacgccattcgcctccgtcgccgcctcggagctcttctccctcgacctatccaagacggaggcgctcacgcaggccttccgccgctccattggcgtccgcatcaaggaggaggcggagataattgagggcgaggttgtggagatctctatcgaccgccccttatctgcctccagcgctggcggcagctcctccgcgccttctggtgctactgcggctggtaaatccgggaggcttacgctgaagaccacggacatggagacggtgtatgagctcggggggaagatgattgaggctcttgggaaggagaaggtgcagagtggggatgtgattgcgcttgacaaggcctctgggaaggtcactaagcttgggcgttccattgggaggtcgcgggattatgatgctgttggcccacacaccaagtttgtcaagtgccctgatggtgagctccagaagcgcaaggaggtcgtgcattgtgtcaccttacatgagatcgatgtcatcaatagcaggacacagggttttcttgcactgttcactggtgacactggtgaaattcgtgctgaggttcgggagcagattgacacaaaagttgcagagtggagagaggaaggaaaggctgagattgtgcctggcgttctgtttatcgatgaagtccacatgctagatatcgagtgcttctccttcctcaaccgcgcattggaaaatgatatggctccgatcctagtcatcgcaacaaatcgagggatcacatctatccgcgggacaaactaccggtcgccgcatgggatcccaccagatttcctcgaccggctcctgatcatcacgacgcagccctacacggaggacgagatccggaagatcctggacatccggtgcgacgaggaggacgtggagatgtctgcagacgccaaggtcctgctcaccaagatcggtgtggagacctccctgaggtacgcaatccacctgatcaattccgccgcgctggcctgccagaagcgcaaaggtaaggtggtggagatggaggacattagccgggtgtaccagctgttcctggacgtgaagcggtcgacgcagtacctgatggagtaccagagccagtacatgttcaatgaagtgtcgggggaagcagatggaaacgatgcgatgcagtcttagatgaatcctcgtgttacaagatggtggttggattatgtcgtgtatttcggatggttcttgcttgttttaggttgctgttaccctgacgaggcgtggtacgtgcggtggactgtgtctgtgtgttagctgctgtaggtgactatgcagttcaatggatctggtcaaaattcatcccagctaggtgcggtgatttgtttaaatctgtatggcaatctcgtgctggatgtcgtgctggatcgtcggaat

SEQ ID NO: 8810 - DNA, 1730 bp, Setaria italica
aaaaccctgggggctcgttccccgctctcgcctaaacctcacctcgcctccacccccctcaatcccggccaaaaggcgaaccacagaaccggcggcggcgcggcgggtggtggccatggcggagctgaagcggctgtcggagagccgcgacctgacgcgtatcgagcgaatcggcgcgcactcccacatccgggggctagggctggactcctccatggaggcgcgcgacgcctcggagggcatggtcgggcagctcccggcccgccgcgccgcgggcctcatcctccagctcatccgccaggggaagatcgctggccgcgccgtgctcatcgcgggccagcccggcaccggcaagacggcgcttgccatgggcatcgccaagtcgctcggcgcggagacgccattcgcctccgtcgccgcctcggagctcttctccctcgacctatccaagacggaggcgctcacgcaggccttccgccgctccattggcgtccgcatcaaggaggaggcggagataattgagggcgaggttgtggagatctctatcgaccgccccttatctgcctccagcgctggcggcagctcctccgcgccttctggtgctactgcggctggtaaatccgggaggcttacgctgaagaccacggacatggagacggtgtatgagctcggggggaagatgattgaggctcttgggaaggagaaggtgcagagtggggatgtgattgcgcttgacaaggcctctgggaaggtcactaagcttgggcgttccattgggaggtcgcgggattatgatgctgttggcccacacaccaagtttgtcaagtgccctgatggtgagctccagaagcgcaaggaggtcgtgcattgtgtcaccttacatgagatcgatgtcatcaatagcaggtagacagggttttcttgcactgttcactggtgacactggtgaaattcgtgctgaggttcgggagcagattgacacaaaagttgcagagtggagagaggaaggaaaggctgagattgtgcctggcgttctgtttatcgatgaagtccacatgctagatatcgagtgcttctccttcctcaaccgcgcattggaaaatgatatggctccgatcctagtcatcgcaacaaatcgagggatcacatctatccgcgggacaaactaccggtcgccgcatgggatcccaccagatttcctcgaccggctcctgatcatcacgacgcagccctacacggaggacgagatccggaagatcctggacatccggtgcgacgaggaggacgtggagatgtctgcagacgccaaggtcctgctcaccaagatcggtgtggagacctccctgaggtacgcaatccacctgatcaattccgccgcgctggcctgccagaagcgcaaaggtaaggtggtggagatggaggacattagccgggtgtaccagctgttcctggacgtgaagcggtcgacgcagtacctgatggagtaccagagccagtacatgttcaatgaagtgtcgggggaagcagatggaaacgatgcgatgcagtcttagatgaatcctcgtgttacaagatggtggttggattatgtcgtgtatttcggatggttcttgcttgttttaggttgctgttaccctgacgaggcgtggtacgtgcggtggactgtgtctgtgtgttagctgctgtaggtgactatgcagttcaatggatctggtcaaaattcatcccag

SEQ ID NO: 8811 - DNA, 1755 bp, Setaria italica
actgtcaaaaccctagctcgttccccactctcgccttaaacctcaccctgccgccggccgccaccgcaatcgaaaagagcgaagcaccgaatcggcggcgcggcgggcggtgaccatggcggagctaaagcggcttgcggagagccgcgacctgacgcggatcgagcgcatcggggcgcactcccacatccgggggctggggctggactcctccctcgaggcccgcgacgcctcggagggcatggtcgggcagctccccgcgcgccgcgccgcggggctcatcctccagctcatacgccaggggaagatcgccggccgcgccgtcctcctcgcgggccagcccggcaccggcaagaccgcgctcgccatgggcatcgccaagtcgctcggcgccgagacgcccttcgcctccgtcgccgcctccgagctcttctccctagacctctccaagaccgaggcgctcacgcaggccttccgccgcgccatcggcgtccgcatcaaggaggaggcggagatcatcgagggcgaggtcgtcgagatctccatcgaccgccctttgtccgccgccgccggctcggccgcgccgtccggtgctactgcgcccggaaagaccgggcggctcacgctcaagaccacggacatggagacggtgtacgagcttgggggaaagatgattgaggctcttggtaaagagaaggtgcagagcggtgatgtggttgcgcttgacaaggcctccgggaaggttacaaaacttggccgctccattggtaggtcgcgggattatgatgctgttggcccgcacaccaagtttgtcaagtgtcctgagggtgagctccagaagcgcaaggaagttgtgcattgtgtcaccttacacgagattgatgtcatcaatagcaggacacagggttttcttgcattgttcactggtgatactggtgaaattcgtgcagaggtccgagagcagattgacacaaaagttgcagagtggagagaggaagggaaggctgagattgttcctggcgttctgtttattgatgaagtacacatgctggatattgaatgcttctccttcctaaaccgtgcattggaaaacgatatggctccaatcctagtcattgcgacgaaccgagggatcacatccatccgtgggacgaactaccggtcaccacatgggataccaccagacttcctcgaccgcctcttgatcatcacgacacagccctacacggaggatgatatccgcaagatcctggacatcaggtgcgatgaggaggatgtggagatgtctgcagatgccaaggtcctgctcacaaagattggtgtggagacctccttgaggtacgctatccacctgatcacctctgctgcactagcctgccagaagcgcaagggcaaggtggtggagatggaggatattagccgggtgtaccagctctttctggacgtgaagagatcgacgcagtacctgatggagtaccagagccagtacatgttcaatgaagttccaggagaagcagatggagatgatgccatgcagtcctagagaaagtgggatggtatttgctggctggtctggtgtattttggatgcttagttcctttttttagattgatgttaccctgacgtgtggtaaatgcagactaactgctgtaggtgatttacagttcggtgtattttatcaaattatatcccagctgggattcacggtttatatggattaattaacaacatatctgtacgtgtatagtatttgcg

SEQ ID NO: 8812 - DNA, 1843 bp, Setaria italica
atcttcgccttcatccttccaggcttccactgtcaaaaccctagctcgttccccactctcgccttaaacctcaccctgccgccggccgccaccgcaatcgaaaagagcgaagcaccgaatcggcggcgcggcgggcggtgaccatggcggagctaaagcggcttgcggagagccgcgacctgacgcggatcgagcgcatcggggcgcactcccacatccgggggctggggctggactcctccctcgaggcccgcgacgcctcggagggcatggtcgggcagctccccgcgcgccgcgccgcggggctcatcctccagctcatacgccaggggaagatcgccggccgcgccgtcctcctcgcgggccagcccggcaccggcaagaccgcgctcgccatgggcatcgccaagtcgctcggcgccgagacgcccttcgcctccgtcgccgcctccgagctcttctccctagacctctccaagaccgaggcgctcacgcaggccttccgccgcgccatcggcgtccgcatcaaggaggaggcggagatcatcgagggcgaggtcgtcgagatctccatcgaccgccctttgtccgccgccgccggctcggccgcgccgtccggtgctactgcgcccggaaagaccgggcggctcacgctcaagaccacggacatggagacggtgtacgagcttgggggaaagatgattgaggctcttggtaaagagaaggtgcagagcggtgatgtggttgcgcttgacaaggcctccgggaaggttacaaaacttggccgctccattggtaggtcgcgggattatgatgctgttggcccgcacaccaagtttgtcaagtgtcctgagggtgagctccagaagcgcaaggaagttgtgcattgtgtcaccttacacgagattgatgtcatcaatagcaggacacagggttttcttgcattgttcactggtgatactggtgaaattcgtgcagaggtccgagagcagattgacacaaaagttgcagagtggagagaggaagggaaggctgagattgttcctggcgttctgtttattgatgaagtacacatgctggatattgaatgcttctccttcctaaaccgtgcattggaaaacgatatggctccaatcctagtcattgcgacgaaccgagggatcacatccatccgtgggacgaactaccggtcaccacatgggataccaccagacttcctcgaccgcctcttgatcatcacgacacagccctacacggaggatgatatccgcaagatcctggacatcaggtgcgatgaggaggatgtggagatgtctgcagatgccaaggtcctgctcacaaagattggtgtggagacctccttgaggtacgctatccacctgatcacctctgctgcactagcctgccagaagcgcaagggcaaggtggtggagatggaggatattagccgggtgtaccagctctttctggacgtgaagagatcgacgcagtacctgatggagtaccagagccagtacatgttcaatgaagttccaggagaagcagatggagatgatgccatgcagtcctagagaaagtgggatggtatttgctggctggtctggtgtattttggatgcttagttcctttttttagattgatgttaccctgacgtgtggtaaatgcagactaactgctgtaggtgatttacagttcggtgtattttatcaaattatatcccagctgggattcacggtttatatggattaattaacaacatatctgtacgtgtatagtatttgcgtaagctcaaagtctctgcactgcagcatacatctattattgtgcggagcatggaactccg

SEQ ID NO: 8813 - DNA, 3856 bp, Panicum virgatum
cgcctacatccttccagcttcatccacattccactgacaagaagtcacaaaaccctagttggctcgttccccgctctcgtctcgcctaaacctcgcctccgccccccctcaaccccggccggccgaaagacgaaccaccgaaccggcggcggcggcgggtggtagccatggcggagctgaagcggctgtcggagagccgcgacctgacgcggatcgagcgcatcggcgcgcactcccacatccgggggctagggttggactcctccatggaggcgcgcgacgcctccgagggcatggtcgggcagctcccggcccgccgcgccgcgggcctcatcctccagctaatccgccaggggaagatcgccggccgcgccgtgctcatcgcgggccagcccggcaccggcaagaccgcgctcgccatgggcatcgccaagtcgctcggcgcggagacgcccttcgcctccgtcgccgcctcggagctcttctcccttgacctatccaagacggaggcgctcacgcaggccttccgccgcgccatcggcgtccgcatcaaggaggaggcggaaattatcgagggcgaggtcgtcgagatctccattgaccgccccttagcatcctctggcgctggcagcagctccgccgcgccttcgggcgctactgcggccggaaaatccggccggctcacgctgaagaccacggacatggagacggtgtacgagctcggagggaagatgattgaggctcttggaaaggagaaggtgcagagtggggatgtgattgcccttgacaaggcctcggggaaggtcaccaagcttggccgctccattgggaggtcgcgggattatgatgctgttggcccccacaccaagtttgtcaagtgtcctgatggtgagctccagaagcgcaaggaggtcgtgcactgtgtcaccttacatgagattgatgtgatcaatagcaggacacagggttttcttgcactgttcactggggacactggtgaaattcgtgcggaggttcgggagcagattgacacaaaagttgcagagtggagagaagaaggaaaggctgagattgtgcctggggttctgtttatcgatgaagtccacatgctagatattgagtgcttctccttcctcaaccgagcattggaaaatgatatggctccaatcctagtcatcgcaacaaaccgagggatcacatccatccgcgggacaaactaccggtcgccgcatgggatcccgccggacttcctcgaccggctcctgatcatcacgacgcagccctacaaggaggatgagatccggaagatccttgacatccggtgcgacgaggaggacgtggagatgtccgcggacgccaaggtcctgctcaccaagattggcatcgagacctccctgaggtatgccatccacctgatcaatgccgccgcgctggcctgccagaagcgcaaggggaaggtggtggagatggaggacatcagccgggtgtaccagctgttcctggatgtgaagcgatcgacgcagtacctgatggagtaccagagccagtacatgttcagtgaagtgtcgggggaagcagatggagatgatgccatgcattcctagacgacctttgtgttacaaggtaccacaggagggaagacacaaagtgcttcagcaccgcctgttgaaggtgtagctggaggagggactagttatggatgggtggatggaggtttacggggtacaagtctgggtgccggtgtaattgatcatacgaaagtacactcagaagatcttctgcacgtctggtcgatgcccagcacagcaaatgttagccaacaagaagcacctcgacctctagagaaagttaaccttctggcagcaagaaatgaaagagaaagttttcaaattgctttgcgcccaaaggtttcatggtccacttcaggtattgcagggtctgtgcagatccagtgcaccgatctctgctcctcctcaggagacaggttagtggttgatcagtccataactttgcgacgtgtggtgcctatcttaggtgtaccagatgctcttgtgcctattgatccactcagtcctcaaataagtctatacccaggggagacagctgcagtatgggtatcattgaacgttccgtgtgggcaaccacctggtttatatgagggtgaaatatttattactgctgttaagacggaattagattccagaacagaatctcttccaaaatctgaaaggtacaggctgtatagagaattaagaagttgtcttgacatcactgaacccagagactactcgtcaccagaggaaatggtacaaaggctaacatcagcttctaccacactgaggaggatgttggataacccagcactacaggactgtcaagagagcaatggatttggagacatgatggatgaagatgttatgaacaatgtttcagttcgtttgaagttaagccttactgtttgggatttcactctcccagtgacaccatcattacctgctgtttttggtatatctgaaactgtcattgaagatcgtttctgcttggagcatggcactgaaggatggtatgatgcactggatcaccactttagatggctcctccaatttagaatcagtccatttttctgcagatggggtgatagcatgcgcattctagcatacacatgcccttggcctgctgatcatccgaaggctaatgaatattactctgatccaagattagcagcatatgctgtaccctatgcacctatcctatcatgcactgatgctgcaaaaaattccttgagaagagaagttgaaatcttaaaatcgaagcctcattggtcaaaagcttacttctatttatgggatgagccattgaatgtggaacaatatgacatgatatgcaacatctctaatgagttaaggtcatattcacccgatgtgcgaattttaactacttactattgtggcccaagtggctctgaactggctccttctacatttgaagcttttgtgaaagtcccaaatgttctacgtccgcacacgcagatcttttgcacaagtgaatgggttcttggcacaagagaggacctagtgaaggatattgttgctgaattacgacctgatcttggtgaggagtggtggacctatgtttgtatgggcccttctgatcctcaaccaaactggcaccttggaatgcgtggaacccagcaccgggcagtgatgtggagagtgtggaaggaaggtgggacaggattcctttactggggtaccaactgctatgagaaggcaatgattccaagtgctgagatctgtttccgacgtggccttcctcctggtgatggggtcctattctaccctggtgaagtgttctcatcgtcacatgaaccagttgcatccacccgactagagcgcattctcagtggcatgcaggacatcgaatatctgaagctttattcttcacggtatgggagggaggaaggcctggccctactcgagaagactggcatgtatcttggcccggatcggtatacgctcgatcatggaccggtagacgtgatgcggggtgaggtataccgcagctgcaggtcttagactcagagcatgggcctgccagatgttcatcacgttcgttcagtgtagcgcgtttgttgttgtatatatggtggtcttactatgttagtatctatactccgtatttagcgatgcaaaacttggtgcatgttcctgaattacggaccagctcattaaagctggacagtaactagttgcctggtggcatcatcttatcctgccagttcaggcctgatgaatctggtttgtttagttgtttttcatcaagctgcgtgaagaacgcagcagaaaaaaccgaaaga

SEQ ID NO: 8814 - DNA, 2132 bp, Panicum virgatum
cggcctaacactataactagaagtggaccattagctcggtaacaagtagtgacagatgccaacttagaagactacaaggacgtctttatagactaccttgtcaccgaccgagttttaacataaagtagcggcccgtgaaaggttcaacatattcatagtttcatacctactacttcatccgaataaaaaatgagtgaggacatttcataactaaagtctctacgaggttagtttggtcattaaactcgtgcgggccctacctgggctggacttgaatctgggcgtgcaagccagcgctggtaagactcgacaaaaccataaacaggcccgatcgttttggcccattacgaccaggcccttttttgttctcggccctcttcgcctacatccttccagcttcatccacattccactgacaagaagtcacaaaaccctagttggctcgttccccgctctcgtctcgcctaaacctcgcctccgccccccctcaaccccggccggccgaaagacgaaccaccgaaccggcggcggcggcgggtggtagccatggcggagctgaagcggctgtcggagagccgcgacctgacgcggatcgagcgcatcggcgcgcactcccacatccgggggctagggttggactcctccatggaggcgcgcgacgcctccgagggcatggtcgggcagctcccggcccgccgcgccgcgggcctcatcctccagctaatccgccaggggaagatcgccggccgcgccgtgctcatcgcgggccagcccggcaccggcaagaccgcgctcgccatgggcatcgccaagtcgctcggcgcggagacgcccttcgcctccgtcgccgcctcggagctcttctcccttgacctatccaagacggaggcgctcacgcaggccttccgccgcgccatcggcgtccgcatcaaggaggaggcggaaattatcgagggcgaggtcgtcgagatctccattgaccgccccttagcatcctctggcgctggcagcagctccgccgcgccttcgggcgctactgcggccggaaaatccggccggctcacgctgaagaccacggacatggagacggtgtacgagctcggagggaagatgattgaggctcttggaaaggagaaggtgcagagtggggatgtgattgcccttgacaaggcctcggggaaggtcaccaagcttggccgctccattgggaggtcgcgggattatgatgctgttggcccccacaccaagtttgtcaagtgtcctgatggtgagctccagaagcgcaaggaggtcgtgcactgtgtcaccttacatgagattgatgtgatcaatagcaggacacagggttttcttgcactgttcactggggacactggtgaaattcgtgcggaggttcgggagcagattgacacaaaagttgcagagtggagagaagaaggaaaggctgagattgtgcctggggttctgtttatcgatgaagtccacatgctagatattgagtgcttctccttcctcaaccgagcattggaaaatgatatggctccaatcctagtcatcgcaacaaaccgagggatcacatccatccgcgggacaaactaccggtcgccgcatgggatcccgccggacttcctcgaccggctcctgatcatcacgacgcagccctacaaggaggatgagatccggaagatccttgacatccggtgcgacgaggaggacgtggagatgtccgcggacgccaaggtcctgctcaccaagattggcatcgagacctccctgaggtatgccatccacctgatcaatgccgccgcgctggcctgccagaagcgcaaggggaaggtggtggagatggaggacatcagccgggtgtaccagctgttcctggatgtgaagcgatcgacgcagtacctgatggagtaccagagccagtacatgttcagtgaagtgtcgggggaatcagatggagatgatgccatgcattcctagacgacctttgtgttacaaggtggctgggttattgtgcccggcgtcgtgtatttcggatgcttgttgctcgtttaggttgctggtattaccctgacaaggcgtggtgtgtgcgatggactctgtgttagctgctgtaggtgaaggtgact

SEQ ID NO: 8815 - DNA, 1956 bp, Oryza sativa
ctcccccctttcgtcttcgtcttcatatatccatccactcaacccaacccaagctggctggcaaaaccctagaactcgttccccccctttcgccttaaaccttcttctcttttagtaccctcgggaagccaaaagcacctcgtcggcggcggcggcgggtggtggccatggcggagctgaagcggctgtcggagagccgcgacctgacgcggatcgagcgcatcggggcgcactcccacatccgggggctggggctggactcctcgctggaggcccgcggctcgtcggaggggatggtcgggcagctccccgcgcggcgcgccgcggggctcatcctgcagctcatccgccaggggaagatcgccggccgcgccgtgctcctcgccggccagcccgggaccgggaagaccgccctcgccatgggcatcgccaagtccctcggcgccgagacgcccttcgcctccgtcgccgcgtccgagctcttctccctcgacctctccaagaccgaggcgctcacccaggccttccgccgctccatcggcgtccgcatcaaggaggaggcggagatcatcgagggcgaggtcgttgagatctcgatcgaccgccccgtctccgccgcagccgccgccggcagctccgcgccttccggtgtcgccgcggctggcaagaccgggcgcctcacgctcaagaccacggacatggagaccgtgtacgagctcggcggcaagatgattgaggccctggggaaggagaaggtgcagagcggggatgtggttgcgctcgacaaggcctccgggaaggtgaccaagcttggccgctcaatcgggaggtcgcgggattacgatgctgttggtcctcacaccaagttcgtcaagtgccccgagggcgagctccagaagcgcaaggaggtcgtgcattgtgtcaccttacatgaaattgatgtcatcaatagccggacacaaggttttcttgcacttttcactggtgacactggtgaaattcgtgcagaggttcgagagcagattgatacaaaagttgctgagtggagggaggaagggaaggctgagattgtccctggtgttctgtttattgatgaagtccacatgctagatatcgaatgcttctccttcctaaaccgtgcattggaaaatgacatggctccaattctagtcattgcaactaaccgagggatcacatccatacgtgggacaaactaccgatcaccacatgggataccacctgatttccttgatcgtctgttaatcatcacgacacagccttacaccgaggatgatatccggaagatcctagacatcaggtgcgatgaagaagatgtggaaatgtctgcagatgctaaggttttgctcacaaagataggagtggagacgtccctgaggtatgctatccacctgatcacttcggctgcattagcttgccagaaacgcaagggtaaggttgtggagatggaggatataagcagggtctaccagctgttcctggacgtcaagagatcgacgcagtacttgatggagtatcagagccagtacatgttcaatgaagtgccgggtgaagcaggagatgatgccatgcagtcttagtgggatattggttacagactttacggttgggttggttttacggttcattatggatacccattggtcttctagatgaataggggtaagcgtaagatgacttaccctgacaaacattgctctgtgggtgcagtaaattgtgttagtgctgtagctagatttaagaattgaatgtatcttgtcttcatcccggtttggagcagtctttcgtatgtgttttttgctaatatctttcgtagtgctcagaacacgtagcaggagtatgtgtagtaggtggctgctatgtgtttatgctaatatctttcgttactgatgcaacagcatttgtgtggtcccggttaacaaaagggttacagcacta

SEQ ID NO: 8816 - DNA, 1917 bp, Oryza sativa
atatccatccactcaacccaacccaagctggctggcaaaaccctagaactcgttccccccctttcgccttaaaccttcttctcttttagtaccctcgggaagccaaaagcacctcgtcggcggcggcggcgggtggtggccatggcggagctgaagcggctgtcggagagccgcgacctgacgcggatcgagcgcatcggagcgcactcccacatccgggggctggggctggactcctcgctggaggcccgcggctcgtcggaggggatggtcgggcagctccccgcgcggcgcgccgcggggctcatcctgcagctcatccgccaggggaagatcgccggccgcgccgtgctcctcgccggccagcccgggaccgggaagaccgccctcgccatgggcatcgccaagtccctcggcgccgagacgcccttcgcctccgtcgccgcgtccgagctcttctccctcgacctctccaagaccgaggcgctcacccaggccttccgccgctccatcggcgtccgcatcaaggaggaggcggagattatcgagggcgaggtcgttgagatctcgatcgaccgccccgtctccgccgcagccgccggcagcagctccgcgccttccggtgtcgccgcggctggcaagaccgggcgcctcacgctcaagaccacggacatggagaccgtgtacgagctcggcggcaagatgattgaggccctggggaaggagaaggtgcagagcggggatgtggttgcgctcgacaaggcctccgggaaggtcaccaagcttggccgctcgattgggaggtcgcgggactacgatgctgttggtcctcacaccaagttcgtcaagtgccccgagggcgagctccagaagcgcaaggaggtcgtgcattgtgtcaccttacatgaaattgatgtcatcaatagccggacacaaggttttcttgcacttttcactggtgacactggtgaaattcgtgcagaggttcgagagcagattgatacaaaagttgctgagtggagggaggaagggaaggctgagattgtccctggtgttctgtttattgatgaagtccacatgctagatattgaatgcttctccttcctaaaccgtgcattggaaaatgacatggctccaatcctagtcattgcaactaaccgagggatcacatccatacgtgggacaaactaccgatcaccacatgggataccacctgatttccttgatcgtctgttaatcatcacgacacagccttacaccgaggatgatatccggaagatcctagacatcaggtgcgacgaagaagatgtggaaatgtctgcggatgccaaggttttgctcacaaagataggagtggagacgtccctgaggtatgcgatccacctgatcacttcggctgcattagcttgccagaaacgcaagggtaaggttgtggagatggaggatataagcagggtctaccagctgttcctggacgtcaagagatcgacgcagtacttgatggagtatcagagccagtacatgttcaatgaagtgccgggtgaagcaggagatgatgccatgcagtcttagtgggatattggttacagactttacggttgggttggttttacggttcattatggatacccattggtcttctagatgaataggggtaagcgtaagatgacttaccctgacaaacattgctctgtgggtgcagtaaattgtgttagtgctgtagctagatttaagaattgaatgtatcttgtcttcatcccggtttggagcagtcgttcgctatgtgtttttgctaatatctttcgtagtgctaagaacacgtagcaggagtatgtgttgttggtggctgctatgtgtttttgctaatatctttcgttactgatgagattgtgtggtccgttaaaaaggtaagcacta

SEQ ID NO: 8817 - DNA, 1941 bp, Brachypodium distachyon
ctccctgttttcttccccttcgccttcatatatccatccagtcgacctgaccgctaaaccctagctcgtcccccttctcgtcttaaacctcgcccccagacccctgcagaacggtcaatctaagcggcggcggcggcggcggcgtgtggtaaccatgtcggagctgaagcggctgtcggagagccgcgacctgacccgtatcgagcgcatcggcgcgcactcccacatccgggggctgggcctggactcctcgctcgaggcccgcgacgcctcggaggggatggtcggccagctccccgcgcgtcgcgccgctggactcatcctccagctcatccgccaggggaagatcgccggccgcgccgtcctcctcgcggggcagccagggaccggcaagaccgccctcgccatgggcatcgccaagtcactcggcgcggagacgcccttcgcctccgtcgccgcctccgagctcttctccctcgacctgtccaagaccgaggcgctcacccaggccttccgccgtgccatcggcgtccgcatcaaggaggaagcagagatcatcgagggagaggtcgtggagatctcaatcgaccgccctctctcggccgccagtggcagctcgggcgcaccttcaggtgctgccgctgccgggaagactggacggctcacgctgaagacgacggacatggagacggtgtacgagctgggtggaaagatgattgaggccctggggaaggagaaggtacagagcggggatgtgattgcgctcgacaaggcctctgggaaggttactaagcttggccgctccatcgggaggtcgcgggattatgacgctgttggtgcacacaccaagttcgtcaagtgccccgagggcgagctccagaagcgcaaggaggttgtgcactgcgtcaccttacatgaaattgatgtcatcaatagcaggacacagggttttcttgcacttttcactggtgacactggtgaaattcgtgcagaggttagagagcagatcgatacaaaagttgcagagtggagagaggaaggaaaggctgagatcgtccctggtgttctgtttatcgatgaagtccacatgctagatattgaatgtttctccttcctaaaccgtgctttggagaatgatatggctccaatcctggttattgcaacaaatcgtggtattacaaccatacgggggacaaactaccggtcgccacatggtataccatctgatttccttgatcgcctcttgatcatcacaacacagccatacacggaggatgagatccggaagatcttagacatcaggtgtgaagaagaggatgttgacatgtcagcagatgcaaaggttttgctcacaaagattggcacagagacctccctcaggtatgcaatccacctgatcacttctgctgctctagcttgccagaagcgcaagggtaaggtggtggagatggaagacataagtcgggtctaccagctctttctggatgtcaagagatcgacgcagtacctgatggagtatcagagccagtacatgttcagtgaagtgcaaggggaagcagatggggatgacgccatgcagtcttagatggataattttacaacgtaactctggttggtttgtatggtttgtgtatcttggatattccttgctcctttagatgattagtttaaagcctatgatgctgttacctgacaagcacgcttggtggatatagtgagctatgttagctgttgtaggggatgacttcaaatgtatcttatgatttttgccccggtgcagtcatggctcgtgtagttctttgcccgagcatgtgcaccggcaaaagtttatccaaacatcagcagagtagaactggttgtattcttgcataaacttttgcaggtgcacaatgctctactcgtatccatcactttgacacataatgtcatttctgcaagatg

SEQ ID NO: 8818 - DNA, 1888 bp, Brachypodium distachyon
gaccgctaaaccctagctcgtcccccttctcgtcttaaacctcgcccccagacccctgcagaacggtcaatctaagcggcggcggcggcggcggcgtgtggtaaccatgtcggagctgaagcggctgtcggagagccgcgacctgacccgtatcgagcgcatcggcgcgcactcccacatccgggggctgggcctggactcctcgctcgaggcccgcgacgcctcggaggggatggtcggccagctccccgcgcgtcgcgccgctggactcatcctccagctcatccgccaggggaagatcgccggccgcgccgtcctcctcgcggggcagccagggaccggcaagaccgccctcgccatgggcatcgccaagtcactcggcgcggagacgcccttcgcctccgtcgccgcctccgagctcttctccctcgacctgtccaagaccgaggcgctcacccaggccttccgccgtgccatcggcgtccgcatcaaggaggaagcagagatcatcgagggagaggtcgtggagatctcaatcgaccgccctctctcggccgccagtggcagctcgggcgcaccttcaggtgctgccgctgccgggaagactggacggctcacgctgaagacgacggacatggagacggtgtacgagctgggtggaaagatgattgaggccctggggaaggagaaggtacagagcggggatgtgattgcgctcgacaaggcctctgggaaggttactaagcttggccgctccatcgggaggtcgcgggattatgacgctgttggtgcacacaccaagttcgtcaagtgccccgagggcgagctccagaagcgcaaggaggttgtgcactgcgtcaccttacatgaaattgatgtcatcaatagcaggacacagggttttcttgcacttttcactggtgacactggtgaaattcgtgcagaggttagagagcagatcgatacaaaagttgcagagtggagagaggaaggaaaggctgagatcgtccctggtgttctgtttatcgatgaagtccacatgctagatattgaatgtttctccttcctaaaccgtgctttggagaatgatatggctccaatcctggttattgcaacaaatcgtggtattacaaccatacgggggacaaactaccggtcgccacatggtataccatctgatttccttgatcgcctcttgatcatcacaacacagccatacacggaggatgagatccggaagatcttagacatcaggtgtgaagaagaggatgttgacatgtcagcagatgcaaaggttttgctcacaaagattggcacagagacctccctcaggtatgcaatccacctgatcacttctgctgctctagcttgccagaagcgcaagggtaaggtggtggagatggaagacataagtcgggtctaccagctctttctggatgtcaagagatcgacgcagtacctgatggagtatcagagccagtacatgttcagtgaagtgcaaggggaagcagatggggatgacgccatgcagtcttagatggataattttacaacgtaactctggttggtttgtatggtttgtgtatcttggatattccttgctcctttagatgattagtttaaagcctatgatgctgttacctgacaagcacgcttggtggatatagtgagctatgttagctgttgtaggggatgacttcaaatgtatcttatgatttttgccccggtgcagtcatggctcgtgtagttctttgcccgagcatgtgcaccggcaaaagtttatccaaacatcagcagagtagaactggttgtattcttgcataaacttttgcaggtgcacaatgctctactcgtatccatcactttgacacataatgtcatttctgca

SEQ ID NO: 8819 - DNA, 1646 bp, Oryza sativa
ctcgtcggcggcggcggcgggtggtggccatggcggagctgaagcggctgtcggagagccgcgacctgacgcggatcgagcgcatcggggcgcactcccacatccgggggctggggctggactcctcgctggaggcccgcggctcgtcggaggggatggtcgggcagctccccgcgcggcgcgccgcggggctcatcctgcagctcatccgccaggggaagatcgccggccgcgccgtgctcctcgccggccagcccgggaccgggaagaccgccctcgccatgggcatcgccaagtccctcggcgccgagacgcccttcgcctccgtcgccgcgtccgagctcttctccctcgacctctccaagaccgaggcgctcacccaggccttccgccgctccatcggcgtccgcatcaaggaggaggcggagatcatcgagggcgaggtcgttgagatctcgatcgaccgccccgtctccgccgcagccgccgccggcagctccgcgccttccggtgtcgccgcggctggcaagaccgggcgcctcacgctcaagaccacggacatggagaccgtgtacgagctcggcggcaagatgattgaggccctggggaaggagaaggtgcagagcggggatgtggttgcgctcgacaaggcctccgggaaggtgaccaagcttggccgctcaatcgggaggtcgcgggattacgatgctgttggtcctcacaccaagttcgtcaagtgccccgagggcgagctccagaagcgcaaggaggtcgtgcattgtgtcaccttacatgaaattgatgtcatcaatagccggtaatttcacattccacaaggttttcttgcacttttcactggtgacactggtgaaattcgtgcagaggttcgagagcagattgatacaaaagttgctgagtggagggaggaagggaaggctgagattgtccctggtgttctgtttattgatgaagtccacatgctagatatcgaatgcttctccttcctaaaccgtgcattggaaaatgacatggctccaattctagtcattgcaactaaccgagggatcacatccatacgtgggacaaactaccgatcaccacatgggataccacctgatttccttgatcgtctgttaatcatcacgacacagccttacaccgaggatgatatccggaagatcctagacatcaggtgcgatgaagaagatgtggaaatgtctgcagatgctaaggttttgctcacaaagataggagtggagacgtccctgaggtatgctatccacctgatcacttcggctgcattagcttgccagaaacgcaagggtaaggttgtggagatggaggatataagcagggtctaccagctgttcctggacgtcaagagatcgacgcagtacttgatggagtatcagagccagtacatgttcaatgaagtgccgggtgaagcaggagatgatgccatgcagtcttagtgggatattggttacagactttacggttgggttggttttacggttcattatggatacccattggtcttctagatgaataggggtaagcgtaagatgacttaccctgacaaacattgctctgtgggtgcagtaaattgtgttagtgctgtagctagatttaagaattgaatgtat

SEQ ID NO: 8820 - DNA, 1638 bp, Secale cereale
gcggcggcggcgggcggtgatcatggcggagctgaagcggctgtcggagagccgcgacctaacccgcatcgagcgcataggcgcgcactcccatatccgggggctggggctggactcctccatcgaggcccgcgatgcctcggaggggatggtcggccagctccccgcgcgccgcgccgctgggctcatcctccagctcatccgccaggggaagatcgccggccgcgccgtcctcctcgcagggcagccagggaccggcaagaccgccctcgccatgggcatcgccaagtcgctcggcgccgagacacccttcgcctccgtcgctgcctccgagctcttctccctcgacctctccaagacccgaggccgctcacacaggcgttccgccgcgccattggcgttcgcatcaaggaggaagcggagatcattgagggcgaggtcgttgagatctcaatcgaccgccctgtctccgccagtggcagctcgggcataccttcaggtgctaccgcggccgggaagacgggaaggctcacgctgaagaccacggacatggagacagtgtatgagctgggtgggaagatgattgaggccctggggaaggagaaggtgcagagcggggacgtgattgcgctcgacaaggcctccgggaaggttaccaagcttggccgctccattgggaggtcacgggattatgatgccgttggtgcgcacaccaagtttgtcaagtgccctgaaggagagctccagaagcgcaaggaggttatgcactgcgttaccttacatgagattgatgtcatcaatagcaggacacaaggcttccttgcacttttcactggtgacactggcgagattcgtgcagaggttagggagcagatcgatacaaaagttgccgagtggagagaggaagggaaggctgagattgtccctggtgttctgtttatcgatgaagtccatatgctagacattgaatgtttctccttcctgaaccgtgctttggagaatgacatggctccgatcctcgttattgcgacgaatcgaggtattacaaccatacgcggtaccaactaccggtcaccgcatggtataccgtcggatttcctcgaccgcctcttgatcatcacaacacagccatacacggcgggcgagatccggaagatcctagacatcaggtgcgaggaagaagacgttgaaatgtctgccgagggcaaggatctgctcacgaagattggcaccgagacctccctcaggtacgcgatccagctgatcacttcggctggcttggcttgccagaagcgcaagggcaaggtggtggagatggaggacataagccgggtgtaccacctgtttctggacgtgaagagatcgacgcagttcttgatcgacagccagagcgactacatgttcagtgaagtgcaaggggattcagatggggatgacgccatgcagtcctagacggagaaaattttgcaatgtaactgaggttggtttgtatggctcgtgtatcttggatacttgttgctcgtttagattagtgttaagcgtgagatgatgttacctgacaagcacacttgatgggtgcagtgagctatgttagcggctgttaccggcgacttcactattgagtgtatcctaaggaat

SEQ ID NO: 8821 - DNA, 1907 bp, Secale cereale
gactgcgactgctaaaccctagctcgttccccttctcgtcttaaaccttctgcccccatctcccgaaaaggggcaacatctaagcggcggcggcggcgggcggtgatcatggcggagctgaagcggctgtcggagagccgcgacctaacccgcatcgagcgcataggcgcgcactcccacatccgggggctggggctggactcctccatcgaggcccgcgatgcctcggagggtatggtcggccagctccccgcgcgccgcgccgctgggctcatcctccagctcatccgccaggggaagatcgccggccgcgccgtcctcctcgcagggcagccagggaccggcaagaccgccctcgccatgggcatcgccaagtcgctcggcgccgagacgcccttcgcctccgtcgctgcctccgagctcttctccctcgacctctccaagaccgaggcgctcacacaggcgttccgccgcgccattggcgttcgcatcaaggaggaagcggagatcattgagggcgaggtcgttgagatctcaatcgaccgccctgtctccgccagtggcagctcgggcataccttcaggtgctaccgcggccgggaagacgggaaggctcacgctgaagaccacggacatggagacggtatatgagctgggtgggaagatgattgaggccctggggaaggagaaggtacagagtggggatgtgattgctctcgacaaggcctccgggaaggttaccaagcttggccgctccattgggaggtcacgggattatgatgctgttggtgcgcacaccaagtttgtgaagtgccctgaaggagagctccagaagcgcaaggaggttatgcactgtgttaccttacatgagattgatgtcatcaatagcaggacacaaggcttccttgcacttttcactggtgacactggcgagattcgtgcagaggttagggagcagatcgatacaaaagttgccgagtggagagaggaagggaaggctgagattgtccctggtgttctgtttatcgatgaagtccacatgctagacattgaatgtttctccttcctgaaccgtgctctggagaatgacatggctccgatcctcgttattgcgacgaatcgaggtattacaaccatacgcggtaccaactaccgatcaccgcatggtataccgtcggatttcctcgaccgcctcttgatcatcacaacacagccgtacacggcgggggagatccggaagatcctagacatcaggtgcgaggaagaagacgttgaaatgtctaccgagggcaaggatctgctcacgaagattggcaccgagacctccctcaggtacgcgatccagctgatcacttcggccggcttggcttgccagaagcgcaagggcaaggtggtggagatggaggacataagccgggtgtaccatctgtttctggacgtgaagagatcgacgcagttcttgatcgacagccagagcgactacatgttcagtgaagtgcaaggggattcagatggggatgacgccatgcagtcctagacggagaaaattttgcaatgtaactgaggttggtttgtatggctcgtgtatcttggatacttgttgctcgtttagattagtgttaagcgtgagatgatgttacctgacaagcacacttgatgggtgcagtgagctatgttagcggctgttaccggcgacttcactattgagtgtatcctaaggaatcttcgcctcaggcttgtattcttttctttttttacgcgtgtgtcatcagtttatattctgattgcggtagaatggccgtgctgtccttggaaggtgtaaaaagcgtctcaaaccgtagtaggggtagaggctgcccctgacatgctactggccgtaaatggtctgatctgatcatggaagcaccg

SEQ ID NO: 8822 - DNA, 1900 bp, Triticum aestivum
cctttcctcctcccctccgcctccatatatctccacctgaccggcgactgctaaaccctagctcgttccccttctagccttaaaccttcttcccccatctcacgaaaaagggcaacatctaggcggcggcggcgggcggtgatcatggcggagctgaagcggctgtcggagagccgcgacctaacccgcatcgagcggataggcgcgcactcccacatccgggggctggggctggactcctccatcgaggcccgcgatgcctcggaggggatggtcggccagctccccgcgcgccgcgccgctggactcatcctccagctcatccgccaggggaagatcgccggccgcgccgtcctcctcgcagggcagccggggaccggcaagaccgccctcgccatgggcatcgccaagtcgctcggcgccgagacgcccttcgcctccgtcgctgcctccgagctcttctccctcgacctctccaagaccgaggcgctcacccaggcgttccgccgcgccattggcgttcgcatcaaggaggaagcggagatcattgagggcgaggtcgttgagatctcaatcgaccgccctgtctccgccagtagctcgggcataccttcaggtgctaccgcggccggcaagactggaaggctcacgctgaagaccacggacatggagacggtgtatgagctgggtgggaagatgattgaggccctggggaaggagaaggtacagagcggggatgtgattgcgctcgacaaggcctccgggaaggttaccaagcttggccgctccatcgggaggtcacgggattatgatgccgttggtgcgcacaccaagtttgtcaagtgccctgaaggagagctccagaagcgcaaggaggttatgcactgcgttaccttacatgagattgatgtcatcaatagcaggacacaaggcttccttgcacttttcactggtgacactggtgagattcgtgcagaggttagggagcagatcgacacaaaagttgccgagtggagagaggaagggaaggctgagattgtccctggcgttctgtttatcgatgaagtccacatgctagacattgaatgcttctccttcctgaaccgtgctctggagaatgacatggctccgatcctcgttattgcgacgaatcgaggcattacaaccatacgcgggaccaactaccggtcaccacatggtataccgtcggatttcctcgaccgcctcttgatcatcacaacacaaccatacacggcggaggagatccggaagatcttagacatcaggtgtgaggaagaagacgttgaaatgtctgctgagggcaaggatctgctcacaaagattggcaccgagacctccctcaggtacgcgatccagctgatcacttcggccggcttggcttgccagaagcgcaagggcaaggtggtggagatggaggacataagccgggtgtaccacctgtttctggacgtgaagagatcgacgcagttcttgatcgacagccagagcgactacatgttcagtgaagtgcaaggggattcagatggggatgacgccatgcagtcctagacggagaattttgcaatgtaactggggttggtttgtatggctcgtgtatcttggatacttgttgctcgtttagattagttttaagcgtgagatgttgttacctgacaagcacacttgatgggtgcagtgatctatgttaacggctgtaaccggtgactcacaattgagtgtatccttcgtctcaggctcgttcgttcagttctttttcagactcgtgtcatcaatttatatgtcgtttctaatcaatgctattctttgggggaaaaggtgcacactagttagaacggccgtgcagcaaccagcacgtgtccttggaaggagtgaaaagtgt

SEQ ID NO: 8823 - DNA, 1975 bp, Hordeum vulgare
ccccctgttttcttcccccccgccttcatatatctccacctgaccggcgactgctaaaccctagctcgttccccttctcgtcctaaacctttcgcccccatctccgggcaacatctaagcagcggcggcggcggcggcgggaggtgatcatggcggagctgaagcggctgtcggagagccgcgacctaacccgcatcgagcgcataggcgcgcactcccacatccgtgggctggggctggactcctccatcgaggcccgcgatgcctcggaggggatggtcggccagctccccgcgcgccgtgccgctggactcatcctccagctcatccgccaggggaagatcgccggccgcgccgtcctcctcgccgggcagccagggaccggcaagaccgccctcgccatgggcatcgccaagtcgctcggcgctgagacgccattcgcctccgtcgctgcctccgagctcttctccctcgacctctccaagaccgaggctctcacccaggcgttccgccgcgccattggcgttcgcatcaaggaggaagcggagatcattgagggcgaggtcgttgagatctcaatcgaccgccctgtctccgccagtagcagctcgggcataccttcaggtgctgccgcggccgggaagactgggaggctcacgctgaagaccacggacatggagacggtgtatgagctgggtgggaagatgattgaggccctggggaaggagaaggtacagagcggggatgtgattgcgctcgacaaggcctctgggaaggttactaagcttggccgctccatcgggaggtcacgggattatgatgccgttggttcgcacaccaagtttgtcaagtgccccgaaggagagctccagaagcgcaaggaggttatgcactgcgttaccttacatgagattgatgtcatcaatagcaggacacaaggcttccttgcactcttcactggtgacactggtgagattcgtgcagaggttagggagcagattgacacaaaagttgccgagtggagagaggaagggaaggctgagattgttcctggtgttctgtttatcgatgaagtccacatgctagacatcgagtgtttctccttcctgaaccgtgctttggagaatgacatggctccgatcctcgttattgcgacgaatcgaggcattacaaccatacgcgggaccaattaccggtcaccacatggtataccgaccgatttcctcgaccgcctcttgatcatcacgacacagccatactcggcggaggagatccggaagatcttagacatcaggtgcgaggaagaagacgttgaaatgtctgccgagggcaaggatctgctcacgaagattggtaccgagacctcgctcaggtacgcgatccagcttatcacttctgccggcctggcctgccagaagcgcaagggcaaggtggtggagatggaggacataagccgggtgtaccacctgtttctggacgtgaagagatcgacacagttcttgatcgacagccagagtgactacatgttcagtgaagtgcaaggggattcagatggggatgacgccatgcagccctagacgggaatttttgcaatgtaactgtgggttggtttgtatggctcgtgtatcttgtggattctgcttgctcgtttagattagtgttaagcgtgagatgattttacctgaaggcacggttgatgggtgctgtgagctatgttaacggctgtaaccggtgacttcacagttgagtgtatcctgaggaatcttccgtctcaggcttgtccgttcagttcttttccattttttgttacgtgcgtcatcagtttatatgtcgtttctgtttggtgggaaaaggtgcaggataattagggattacaagctgcagttagaacggctgtgcagcaaccagcatgtgtccttggaaggtgtaaaaagtgtctgaaaccgtagtagtctgcccctgacatgctactggc

SEQ ID NO: 8824 - DNA, 1773 bp, Elaeis guineensis
ccctcttcccgtgtcacgatttgttcctctcctttgctcttcgccttcggaggctctttcttctcccgttcggtaccatggcggagcttaagaagctatcggagagccgggacctcacccggatcgagcgcatcggcgcccactcccacatccgcggcctgggcctcgactcctctctcgaggcccgcgccgtctccgagggcatggtcggccagcagtccgcccgcaaggctgctggcctcatcctccagctcatccgcgagggcaagatcgccggccgcgccatcctcctcgccggccagcccggcaccggcaagaccgccgttgccatgggcctcgctaagtcccttggccaggagaccccctttgccaccgtctccggctccgagctcttctctctcgagatgtccaagaccgaggccctgactcaggccttccgccgcgccatcggtgtccgcatcaaggaggaggccgagattatcgagggcgaggtcgtcgagatcaccatcgaccgccccgccgccaccgccggaggcagcgcaagcggctcctccggccaatcatcgtctgccttcaagaccgggaagctgacgctcaagaccaccgacatggagacggtgtacgatttgggcaacaagatgatcgaggcgttgacgaaggagaaggtgcaaagcggggatgtgatagccttggataaggtttccgggaaggtcacgaagctggggcgatccatcggacggtccagggactacgacgcggtgggacccaatacgaaattcgtgaggtgtcctgagggggagctgcagaagaggaaggaggtcgtgcactgcgtcacccttcatgagatagatgtcatcaacagcagaactcaaggctttttagcactctttactggtgacactggtgaaatccgttctgaggtccgagagcagatagatacaaaagtggcagagtggagagaggaaggaaaagctgagattgtcccaggtgtcctgttcattgatgaggttcacatgcttgacattgagtgcttctcattcctaaatcgcgcattggagaatgacatggcccccattctggtcattgcaacaaaccgagggatcacaaccatccgaggcacgaactacagatctccccatggaatcccacctgatttcctcgatcgcttacttataatatctactcagccatacactgaggaggagatccggaagattcttgacatcagatgtgaagaggaagatgtagaaatgtcaaaggatgcaaaggttcttttaacaaaaataggtgcggagacctctttgaggtacgcaatcaacttgatcacagcagctgcacttgcttgccagaagagaaggggtaagattgtggagatggaggatataagtagggcatatcagctgtttcttgatgtgaaaagatcgacacaatatttaatggagtaccagagccagtacatgttcaatgaagtgccgagagaggtggatgaagatgaaactatgcaatcttaattcagaatggggacagcttcatctcaatgtggtcacattagttctaggattgtttttgatgctttctgcacttggttcatctcaatctggttgtttggatcctggaatcatgtcaaaaacaagattttctatgtagagagcctttaattctctttaattctctgtaaacttagaaagatcggttatttctctaaccaaaaaaaaaccgtagactgcaacggacacaacgtacgggggaagtaaggtgaccacacaccccccc

SEQ ID NO: 8825 - DNA, 1950 bp, Amorphophallus konjac
cggcgatggcggagctgaagaggctgtcggagtcgcgggacctcacccgcatcgaacgcatcggtgctcactcccacatccggggccttggtctcgactcgggcctcgaggcccgggccacctcccagggcatggtcggccaagtctctgcccgcagggccgccggcgtcatcctcgagatgatccgggagggcaagatcgccggccgcgctgtgctcctcgccgggcagcccggcacggggaagaccgccatcgccatgggcatggccaaatccctcggcgaggagacgcccttcgccgtcatctccgggtcggagctcttctccctggagatgtccaagacggaggcgctcacccaggccttccgccgcgccatcggcgtccgcatcaaggaggagacggagatcattgagggcgaggtcgtcgagatcgtcatcgaccgcccagcagcggccgctgtcgccaatagcagtggtggaggatcagctcatccaccatcctcatcatcctcggtttctgcgaccaagacggggaagttgactctgaagacgacggatatggagacggtgtatgagctcggggggaagctgattgaggcattgtcaaaggagaaagtgcagagcggagatgtgattgcattggacaaatcatctggaaaggtcacaaagctcgggaggtccattgggcggtcgcgggactatgatgccgtgggaccgcacacgaggttcgtgaggtgccctgagggtgagctacagaagaggaaggaggtggtccactgtgtcacactccatgagatcgatgtaatcaacagcaggacacagggctttctggctctcttcactggtgacaccggtgaaattcgtgcagaagtaagagaacagattgacacgaaggtggcagagtggagggaggaagggaaggcagaaatagttcctggtgttttattcattgatgaagtgcatatgcttgatattgaatgcttttctttcttaaatcgtgccttggaaaatgagatggcccccatccttgttattgcgactaaccgagggatcacaactattcgtgggacaaactacaaatctcctcatggcatcccaattgatttccttgatcggctgctcatcataacgacacagccatacacagaggaggagatccgccagattcttgacatcaggtgtcaggaggaagaggtggagatgtccgaggatgccaaggtcttgctaacaaagattggtgtcgagacctcattgaggtacgcaatcaacttgatcactgcctctgcactgtcttgtcaaaagagaaaggggaaaactgtagagatggaggacataagcagagtttaccaactattcattgacgtgaagaggtcaacacagtatctgatggagtaccagagccagtacatgttcaacgaagtgcccagagatgccgaagaagatgaaatcatgcaatcttgattcagtttgtagtatatggagctgatgtccatgcatatcatctgcctaaccatatgttcaccgattttggcctgtgccctggggttctgcattttgatgtacttcttttggatttgttcgatgcagagttgtctatgcccttggtgttcctcgtgtatgtgcaagtgattcatctagtttgttctattaattatgaactggaattttgtgggtgctcacactaattctctttgttctgtccttggtaagttcatcacttattcgtggacaaaacctttgtcttggagcagtccatgacaagttgaattgcagaaatcagttgtggttccatgcaccctcttctgtaaggttctgagattgcatggatgacgctttcccttggagtttcaggtgccagtcgtcgttctcgagctggataccccattggttctgctgccgttgcaggcttggcttgcagctgggtttgggatcgcaagataacaaacagaag

SEQ ID NO: 8826 - DNA, 1413 bp, Phalaenopsis aphrodite
gctctctgaaagccgagacttgactcgtatagagcgaattggagcgcactcgcacatccgaggccttggcctcgactcctccctcgaggctcgcgcggtctccgaaggcatggtcggccagcagcccgcccgcaaggcggccggcctcattctccagctcatcaaggagggcaagatcgccggccgggccgtcctccttgccggccagcccggcaccgggaagactgccatcgctatgggcctcgccaaatccctcggcgaggagacccccttcgccactctctctggttctgagctcttctccctcgagatgtctaaaaccgaagccctcacccaggcctttcgccgcgctatcggcgttcgcatcaaggagaggccgagatcatcgagggtgaggttgttgagatcaccattgaccgtcctgttggcgtcggcggatctggttcgggttcttcatccgcgggatctgccggttctaagacagggaagctcacgctgaaaactacggatatggagacggtgtacgatttgggaggaaagatgatcgaggcactgagtaaagagaaggtccagagcggggatgtgatagcattggataaggcttccggtaaggtgaccaagcttgggcggtcgattgggcgatcgagagactatgatgcagttgggcctcataccaagtttgtaaggtgtcctgaaggtgagctacagaagaggaaggaggtcgtgcactgcgtcactcttcatgagatcgacgttatcaatagcaggacacagggtttcctagcactcttcacaggagacaccggagaaatccgagctgaggtaagagagcaaattgatacgaaagtagcagaatggagggaagaagggaaggccgaaatagtacccggtgttctcttcatcgacgaggtccacatgctcgacatcgaatgcttctccttcctcaaccgtgctttggagaacgaaatggctccgattctcgtcatcgctacgaaccgagggatcacaaccatccgcggcacaaattatcgttcgcctcatggaatacccgccgattttcttgatcgcctcctcatcatatcgacccaaccatactccaaagaagagattcataagatcatcgaaattagatgcgacgaggaagaagtggaaatgtcgaaggactcaaaagtgttgttgacgaagattggcacggagacgtctttgagatatgcaatccatttgatcacagtcgcggctctcgcctgccagaagcgaaagggaaaggtggttgagatggaggatatcagtcgagtttattcgttgtttctcgatgtgaagagatcgacacagtatttaatggaatatcaaagccagtatttgttcagtgaaattcccggcggggttgatgatgaagatgccatgaatttgtga

SEQ ID NO: 8827 - DNA, 1961 bp, Aristolochia fimbriata
cgttctccctctcggcgttctccctctccgaccatcttcgacgccatggctgagctgaaaatctcagaaactcgcgacttgactcggatagagcgtataggagctcactcccacatccgggggcttggcctggactccgccctcgagccccgtgatgtctctgaaggcatggtgggtcaggcctccgcccggaagggcgccggagtaatcctccatatgatcagggaagggaaaatagccggccgagcggtgcttctcgccggacagcctggtacgggcaagactgccattgccatgggactcgcgaagtctctcggacaggagaccccctttgctatgcttgccggcagcgagctcttctccctggagatgtccaagaccgaagcgctcactcaggcgttcaggaaggctattggggttcgtatcaaggaggagactgaggtcattgagggcgaagtggttgagctccaaatagataggcctgctgtcgccggggctgcctcaaagaccgggaagcttaccctcaagactactgagatggagacagtgtacgatttagggaccaagatgattgaatcgttggggaaggagaaggtgcagagtggggatgtcattgccattgacaagtcttcgggaaagataaccaagctgggccgctccttcgccaggtcgagggactatgatgccatgggtccacagacgaagttcgtccagtgccctgacggggagttgcagaaacggaaggaggtggtgcactgtgtcacacttcatgagattgatgttatcaatagcagaacacaaggcttccttgctcttttcactggagacacaggtgaaattcgtgctgaagttagggaacaaattgacaccaaggtagcagaatggagagaagaagggaaggctgagataattccaggagttctattcattgacgaagtccacatgcttgacatagaatgcttctctttcctaaatcgtgcactggagaatgatatggctcccatcttggttgttgccacaaaccgaggaatcacaaccattcgaggcacaaactataaatccccacatggaatccccatagatctcctagatcgtttactcatcatttctacacaaccctacacagaagatgagattcgaaagatactcgatattagatgccaagaggaagacgtggacatgtcagaagatgcaaaggttctactcacaaagatcggtgtggagacttctttgaggtatgcaattcatttgatcacctctgctgctttggcttgccaaaagaggaagggaaaagtagtggaaatggaagatatcacacgggtgtaccatcttttccttgatgttaagagatcaacccagtacttaatggagtatcagagtcagtacatgtttaatgaggttcccagagagggagaagatgacgatgcgatgcattcttaatttgttctcttcgaaggcaatccaatcaccgtgggaaacaaatgacatgatgcttcagttatggatggacttgtttgcgatatctggtttcatgtttcttatgtttgggatctaaatcaagctgggtcctgcgatctctaatgtttttaaagttgctggaaggaagaagcgaacctaatgtaactgtgtgatgtaaaaaaaacggccatcttttttattgggtagcgagtatctaatagttgaaaggcagatttcttccattgtgatctcggctttcacaatgagaggatactgaaaggcagatttctgcgccatttgtataagtaagactgctgcatcttaagttattttcatcaattggcttctacatatcatgtagttgttaagagactatcatttagttgccggttgttttggtgattttcaatgtcagtccaatttgacaatgacatgtatataatcaaaagatttgtggtgaacttacttacagcagcataatgctttactcaattttggctttc

SEQ ID NO: 8828 - DNA, 1716 bp, Musa acuminata
gaataagccctcgaggagcaaaaccctcgccgttgctgttggtggttcctcccgatcgtcgtcgatgacggagctcaagaagatatcggaggcgcgggacctgatgcggatcgagcgcatcggggcacactcccacatccgggggctcggcctcgacgcggggctcgaggcccgtgccgtgtcggaggggatggtgggacagtgcgccgcccgcaagtctgctgggctcatacttaacctcatcaaggagggcaagatcgccggccgtgccatcctcctcgctggccagcctggcaccgggaagaccgccgtcgccatgggcctcgctaagtcccttggtcctgagacccccttcgccaccgtcttcgcttccgagatcttctccctcgagatgtccaagacggaggccctcacccaggccttccgcaaggccatcggcgtccgcatcaaggaggaggcggagatcatcgagggcgaggtcgtcgagatctccatcgaccgccctgcggccggcgctgggttgtcggcgggtcagtcctcttccaaaactggtaaactgacccttaagacgaccgatatggagacggtctatgagctcggagggaagatgatagaagcgctgggcaaggacaaggtgcagaatggggatgtgatagcgctggatagggcatctgggaaggtcacaaagcttgggcggtcgatcacgcgctcgagggactatgatgccaccggtccgagcaccaagttcgtgaggtgtccagagggagagttgcagaagaggaaggaggtggtgcattgtgtcacccttcatgagatcgatgttatcaatagcaggacgcagggttttcttgcactttttactggtgacactggcgaaatccgagccgaagtcagagaacagattgattcaaaggtttcagagtggaaagaggaagggaaggccgaaatcataccaggagtcctgttcatcgatgaggtccatatgctagacatcgagtgcttctcctttctcaaccgtgccttggagaatgagatggccccaatactggttatcgcaacaaatcgtgggatcacgactatccgcggaactaactaccggtcgcctcatggaattccagccgatttcttagaccgcctcctcatcataaccactcagccatatacagaggaagaaatcggcaagattatcgagatcaggtgcggagaagaagaggtggagttgtccaaggacgcaaagctcttgctgacaaagattggggtagagacgtcgttgaggtacgccatccaccttatcacagtggctgcactggcttgtcagaagcggaaggggaagacagtcgagatggaagacataagcagggtgtatcagttgtttctagatgtgaagagatcaacgcagtatctaatggagtatcagaaccagtacatgtttaatgaagtgcccaaggcgggcgacgaagatgaaactatgcagtcttgatctatcattcgatcctgattccggtcataggttgcgttggagatgagagacttaacagagtgcacactgacgagtaggaggagatgccatttatgtcttttgcagtgaagagttcaacagtttacctgtagattatgaccgaggaaatggtttatctactgattgatggattgttcgaacgccaagcttcatctctagttcttgcatcatcatgtcctaaagcagctcagaagggc

SEQ ID NO: 8829 - DNA, 1766 bp, Musa acuminata
gtttcatctgcaaataacccaaagaggcataaaaccctcggccaagcggtcgcctcgcagctaaaaccctaatcgttgtttctccggatcgtcgtcgatggcggagctcaagaagctatcggaggcgcgcgacctgacgcggatcgagcgcatcggggcgcactcccacatccgagggctcggcctagacgcggcgctcgaggctcgtgccgtgtcggagggcatggtgggccagtgcgccgcccgcaaggccgccggcctgatcctcaacctcatcaaggaaggcaagatcgctggccgagccatccttctcgccggtcagcccggcaccgggaagaccgccgtcgccatggggctcgctaagtccctcggcgccgagacccccttcgccgccgtctctgcttccgagatcttctccctcgagatgtccaagaccgaggccctcacccaggcattccgcaaggccattggcgtacgcattaaggaggaggccgagatcatcgagggcgaggtcgtcgagatctccatcgaccgacctgccgccggcgctggggcgtctgctggccagtcctcttcaaagaccggaaaattgaccctgaagactactgatatggagacggtctacgagctaggagggaagatgatagaggctctgggtagggagaaggttcagagtggggacgtgatatcactggatagggcatctggaaaggtcacgaagcttggtcgatcaatcacacgctcgagggactatgatgccactggcccaagcacaaagtttgtaaggtgcccggaaggagagctgcaaaagaggaaggaggttgtgcattgtgtcaccctccatgagatcgatgtaatcaatagcagaacgcagggttttcttgcacttttcactggcgacactggtgaaatccgatctgaagtgagagaacagattgattcgaaggtttcagagtggaaagaggaaggaaaggctgaaatcatacctggtgtcctgttcatcgacgaggttcatatgctggacattgagtgcttttcctttctcaaccgagcattggagaatgagatggctccaatactggtcattgcaacaaatcgcgggatcactacaatccgtggaaccaactaccgatcacctcatggaattcctgccgatttcttagatcgcctcctcatcgtaactactcagccatatacagaggaagaaattggcaagattattgaaatcaggtgtgaagaagaagaggttgagatgtccaaggacgcaaagctcctgctaacaaagattggggtcgagacatccctgagatatgccatccacctaatcacatcggctgcactggtttctctgaagcgcaagggaaagatggttgagatggatgacataagcagagtttacaggttgtttcttgatgtgaagagatccacgcagtatcttatggaatatcagaaccagtacatgtttaatgaagtgcccagtgtgggtgaagaagttgaatctatgcagtcttgatttgtcttgggtcgaaatggacttttgccttcttgtattactggcttgtattagaaatggacaggagctgatgcccatttatatcctttgcattgcatttaacttaactcttgtatttttctttagcagcttttggttatcgaaaaatagaggtttccttgtttatttaattcactgatttgtaagttaattaaagctggtgcatcttctttcattaatcttgcatcagctcaacagattaaacattatgaaa

SEQ ID NO: 8830 - DNA, 1756 bp, Sesamum indicum
attcactgccgtttctagagcaccaaaaccctaaaacccttctcagcaccacttctctttgctctgttaacgcacaaactccttcaccttcctcttgccctaaaaccttctcctctctcatctctcaagatcagccatggcagagattaagctgtccgagatgcgagatttgacccgaatagagcgaatcggagcgcactctcacatccggggcctgggtctggactccaccctggaggcccgcgcctcctctgagggcatggtgggccagacttcagctcggagagctgctggagtcattgtgaagatggtccaggaagggaaaatcgcgggccgtgccgtactcctcgcgggccagcctggcaccgggaagactgccattgccatgggcatggcaaagtctctcgggcaagaaactccatttgctatgctcgcagggagcgaactattctccctcgagatgtcgaaaaccgaagcccttatgcaggcctttaggaaagcgattggggtcagaattaaggaggaaaccgaggtgattgagggcgaggttgtggagattcagattgacaggccggctgtggcgggggcagcgtctaagactgggaagctgactctgaagacgacggaaatggagacggtgtatgatttgggggcaaagatgattgaggcattggggaaggagaaagtgcaaagtggagatgttattgcgattgataaggcatctggaaagatcacaaagcttgggaggtctttctcaaggtccagggattatgatgccatggggcctcagaccaagttcgtgcagtgccctgatggtgagctgcagaagaggaaggaagttgtgcattgtgttacgcttcacgagatagatgtcatcaacagcagaacacagggatttctggcactattcacaggtgataccggtgaaattcgtgcggaagttagggaacaaattgacacaaaggttgcagagtggagggaagaaggaaaagcagaaattgtgcctggtgtccttttcattgatgaagttcacatgctggacattgagtgcttttctttcctgaatcgtgcattggagaacgacatggcgcctatattggtcgttgccaccaatagagggataacttctattaggggcacaaattacaaatccccacatggcatcccaattgattttcttgatcgtctgcttatcatctccacacaaccgtacacatcagatgatattcgaaaaattctggacattagatgccaagaggaagacgttgaaatgtctgaagatgcaaaaattttgttgacaaagataggagaagatacatctttgagatacgctataaacctcatcacctctgctgcattagcctgccaaaaacggaagggaaagattgtggaaatggaagatattagccgagtttacgagctattttatgatgtgaaacggtcaacacaatacttgatggaataccaaagccaatacatgttcagtgaggttccagacgaagggggagatgaagatgaagccaacgcaatggtctcatagtggattgtttggaacacaaacaacatttgctggtatataattggcttgcattattattcttgcgactgcagtatgttggctcccgacattcctatcgtcgtgttaatttgttcgcagtgcagtttaaatcatggaaaattatgggtccaatatgggtgtatttagatgttcaacaattgaatgttctgcagcaaccagcatgaaggacttggtagt

SEQ ID NO: 8831 - DNA, 1579 bp, Ocimum basilicum
ccaaaattgggccatggcggagattaagctttcggagatgcgagacctaacccgaattgaacgaatcggcgctcattcccacatccgtggcctcggcctcgactccgccctggaggcccgctcctcctccgagggcatggtgggccagacctccgcccgaaaagccgccggcgtcatcgtcaaaatggtacaggagggcaaaatcgccggccgcgccgtccttctcgccggccaacccggcaccggcaagaccgccatcgccatgggcatggctaaatccatcggccaggagacccccttcgccatgctcgctgggagcgagctcttctcgctcgaaatgtccaaaaccgaagccctaatgcaggccttcaggaaggcgattggtgtccggatcaaggaggagactgaggtgattgagggagaagtggtggagatccaaattgaccggccggcagtggcgggggcagcatcgaagacggggaagctaacgctgaagacgacggatatggagacggtatatgatttgggggtgaagatgattgaggcgttggggaaggagaaagtgcagagtggcgatgtgattgccatcgacaaggcgtcggggaagatcacgaagcttgggaggtcgttttcgaggtcgagggattacgatgcgatggggcttcacacgaagttcgtgcagtgccctgatggggagttgcagaagaggaaggaggttgtgcattgcgtcacgcttcatgagatagatgttatcaacagcaggacgcaggggtttctggcactcttcaccggtgacactggtgaaatccgtgctgaagttagggaacaaatcgacactaaggtagctgaatggagagaagaaggaaaagccgaaatcataccaggcgtactcttcatcgacgaagttcacatgctggacatcgagtgcttctcctttctgaatcgtgcattggagaacgacatggcgcccatattggtcgtcgccaccaaccgaggaatcacctccataaggggcacaaactaccgatccccacacggcatacccatcgatttcctcgaccgcctcctcatcatctcaacacagccatacacttcagacgacatccggaagattctagacatcaggtgccaggaggaagatgtggagatgtccgaagatgcaaaagtgctactcacaaagattggagaagacacatcactcagatatgctataaatcttatcacttcgtcggcattggcttgtcagaagcggaaggggaagacggtggagatggaagacattagccgtgtttacgagctgttttacgacgttaagaggtcgacgcagtacttgatggagtatcagagccagtatatgttcagtgaggtggtgacgggcgtgggcgacggagaaggagacgaagcaattgctatggtctcataaggaggtatcgtttttcagacacaaaaattgtgttaatttagtgatggtgaagcagttgtcttgtgttatgtgcatggaatttgtaggtcttaaaacgttttttatctcatgtattttgttgatggttctaatgttttatgatagtagatttgagca

SEQ ID NO: 8832 - DNA, 1759 bp, Citrullus lanatus
aacacaattacgctccaaacgccaacaagaagaagtgtttcttcaagtttgcaaaaccctgaaccctaaccctagttcttaacgctctgttcctgcgtcctttagcaaccaagcaaattacgggaatcagctcttacgatggcggagctgaagctctcggagagccgtgacctaacgcgaattgagcgcattggggcgcactcccacatccgcggcctcggccttgattcctcccttgaaccacgggccgtctcggagggaatggttggccaaaccgccgctcgtaaggccgctggggtcattcttcagatgatcaaagaaggaaaaattgccggtcgggctgttctcctcgctggtcagcctggtactggcaagactgccattgccatgggcatggctaagtcccttggccttgaaactcctttcgcaatgattgctggcagtgagctcttttctctggaaatgtccaaaactgaagcattgatgcaggccttccgtaaatctattggcgtccgaataaaggaagaaaccgagataattgaaggagaggtcgttgaggttcaaatagacaggcccgcggttgccggggcagcgtcgaagactgggaagcttactttgaaaacgacggatatggagacggtatatgatttgggggcgaagatgattgaagctttgggtaaggaaaaggtgcagagcggcgatgtaattgcgattgataaggcctcagggaaaattactaagctagggaggtctttctctaggtccagggattatgatgcaatgggtcctcaaacaaagtttgtgcaatgccctgatggtgagttgcaaaagcggaaggaagttgtacattgtgtcacactccatgagattgatgtcatcaatagcagaacacaaggtttcttagctttattcactggtgatactggagaaattcgagctgaagtaagggaacagatagataccaaagtggctgagtggagggaagaaggcaaggccgagatagttccaggtgttctctttatagatgaggtccatatgcttgatattgagtgcttctctttcctaaatcgtgctttggagaatgagatggctccaatattagttgttgctactaatagggggattaccacaatccggggaacaaactacaaatccccacatggtattcctattgatcttcttgatcgcctacttataatttccacccaaccttatacggaagatgaaatacgaaagattttagatatcagatgtcaagaggaagatgtggaaatgtctgaagaggcaaagagacttttgaccacaattggtgtagaaacatcgcttagatatgccatccatttaattacagcagctgcattggcatgtcaaaagcgaaaggggaagattgtggagatggaagacataaatcgtgtataccatctgttcttagatgtgaagagatcaactcagtacttgatggagtatcaaaatcaatatatgttcagcgaattgggagatgcagaagaagatgattccaatgctatgaacccttgacttcttttgtagaagaattttggaggctaaactaagctgtgctgtagttactaggagtttgaatttcctgcagtctatatatttacgtgggtgattatttaatggctgtcttgattcttcaccagtgtgtaagatgtataatctaatcttcgtgtttgatgcttattgctgttgtttcttgtaccatggttctgtgaaactgcttagatatttctttttgttt

SEQ ID NO: 8833 - DNA, 1880 bp, Lupinus angustifolius
aaactagcaacacactgtaacagtattcaggagcagagtacattgcaaaccctaaaaaccctaaaaccaaaccaccgctatcaatggcggagctcaaactctccgagagccgcgatctcacccgaatagagcgcataggcgctcactcccacatccgcggcctaggcctcgactccaccttggagccccgtgacgtctccgagggcatggttggccaaacctccgcccgcaaggccgccggcgtcattctccagatgatcaaagacggcaaaatcgccggccgcgccgtcctcatcgccggccaacctggaacaggcaaaaccgccatcgccatgggtatggctaagtccctcggcctcgaaacccccttcgctatgatcgccggcagcgagctcttctcactcgagatgtcgaaaaccgaagccctaacccaggcgttccggaaggccataggcgtgagaattaaggaggagaatgaggttattgagggtgaggtagttgaggtgcagattgaccgaccttcggcatctggggctgcgtcgaaatcggggaaattgacgttgaagacgactgagatggagacggtgtatgacttgggggctaagatgattgaggcactggggaaggagaaggtgagtagtggtgatgtgattgcgattgataaggcgtccgggaagatcacgaagctggggaggtcattttcgaggtctagggattttgatgctatgggaccgcaggtgaagttcgtgcaatgcccggatggggagctgcagaaaaggaaggaggtggtgcattgtgttactcttcatgagattgatgttattaatagcagaacacagggatttctggcacttttcactggtgatacaggtgagatccgtgcagaagtcagagaacaaattgacaccaaagtagcagagtggagggaggaaggaaaggcagagatcgtgccaggtgtccttttcattgacgaggtacacatgcttgacattgagtgcttttcattcctcaatcgagctctggagaatgagatggctcccatattagttgttgctaccaacagaggcatcacaactatccgaggcacaaattacaaatccccacatggtattcccattgatctacttgatcgcctgctcatcatctctacccagccttataccgaggatgaaattcgcaagattctggacatcagatgccaagaggaagatgtagaaatgtctgacggtgcaaagcatttgttaaccaaaattggtggagaaacatccttgagatatgctatccatctcatcacagcagcggcattggcatgccaaaagcgaaaggcaaaggttgtggagttggaggatataaatcgggtttaccatctgtttttggatgtcaaaagatcaacacaatacctgatggagtatcaaaatcagtacatgttcagtgaaacaggagaagttgatgaagatgatacaaatgctatggtctcatgaaattcagtttgagtttgtaattactgcgcttgacttttgtttgaatatggatcaccagaagttttctgttcttgaactactactctacatgtaagaggctgcactgtatgtgttatcacatattcacactgaagttttcaattttttctttttgtcttccttttaaaagaaaattaatttgctctatcatgtgtgcatagagatcttttgatccatgtagcagactctacttggtgagactaaaacttagttgttattgatgcatacactttcaagttctcttatccttgcacatgtcatcaaccgaggtagcataagagtaccttttaagtaggtacagtttgctaatccgcactcattatttatttgatgtggacggttcatagttttatgaatatg

SEQ ID NO: 8834 - DNA, 1640 bp, Actinidia deliciosa
  misc_feature (128)..(128): n is a, c, g, or t
  misc_feature (161)..(161): n is a, c, g, or t
  misc_feature (179)..(179): n is a, c, g, or t
  misc_feature (206)..(206): n is a, c, g, or t
  misc_feature (215)..(215): n is a, c, g, or t
  misc_feature (218)..(218): n is a, c, g, or t
  misc_feature (222)..(222): n is a, c, g, or t
  misc_feature (230)..(230): n is a, c, g, or t
  misc_feature (845)..(845): n is a, c, g, or t
  misc_feature (984)..(984): n is a, c, g, or t
  misc_feature (987)..(987): n is a, c, g, or t
  misc_feature (989)..(989): n is a, c, g, or t
  misc_feature (1010)..(1010): n is a, c, g, or t
  misc_feature (1022)..(1022): n is a, c, g, or t
  misc_feature (1387)..(1387): n is a, c, g, or t
  misc_feature (1393)..(1393): n is a, c, g, or t
  misc_feature (1437)..(1437): n is a, c, g, or t
  misc_feature (1451)..(1451): n is a, c, g, or t
  misc_feature (1456)..(1456): n is a, c, g, or t
  misc_feature (1486)..(1486): n is a, c, g, or t
  misc_feature (1491)..(1491): n is a, c, g, or t
  misc_feature (1503)..(1503): n is a, c, g, or t
  misc_feature (1525)..(1525): n is a, c, g, or t
ctcctcctcctcctccaccagccatggcggagctgaaactctcggaaacccgagatctaacccgaatagagcgaatcggggcgcactcacacatccgcggccttggcctggactccaccctggagccncgctccgtctcggagggcatggtgggccaggcntccgcccgcaaggccgcnggagtcatcgtccagatggtcaaggcnggaaagatngcnggcngagctgtnctcctcgccggccaccctggcaccggtaagaccgccatcgccatgggcatggctaagtccctcggcctcgaaacccccttcgccatgctcgctggcagcgagctcttctccctcgagatgtccaagaccgaagccctaactcaagccttccgaaaagccatcggcgtcagaatcaaggaagagaccgaagttattgaaggcgaagtggtggagattcagatcgatcggccggcgtcggcgggggcggcgtcgaagacagggaagctgacgctgaagacgacggagatggagacggtgtacgatttgggggcgaagatgattgaggccttggggaaggacaaggtgcagagcggggatgtgattgcgattgataaggcttcggggaagattacgaagcttgggaggtcgttttcgaggtcgagggactacgatgccatgggaccgcagacgaagttcgtgcagtgcccggacggggagttgcagaagcggaaggaggtggtgcattgtgttacgcttcatgagattgatgtcattaacagcagaacccaaggttttctggctctcttcactggtgatactggagaaatccgtgctgaagtgagggagcaaattganacgaaggtagcagagtggagggaggaagggaaggcagagattgtgcctggtgtcctctttattgatgaagtccacatgcttgacattgagtgtttttctttcctaaaccgcgctttagaaaatgaaatggcaccgatantgntngttgccactaacagggggatnactacaatccgnggcacaaactacaagtccccccatgggattccgatcgatttccttgatcgcctgctcatcatctccacacagccatacacagaagaagaaattcggaaaatcctggacattagatgccaagaggaagatgtggagatgtctgaagatgcaagagttttgttgacaaagatcggggttgatacatctttgagatatgccatccaccttatcacctctgctgcattggcttgccaaaaacggaagggaaaggttgtggaaatggaggacatcagtcgagtttatgaactattttgggacgtgaagagatcaacacaatacttgatggaatatcaaagccaatacatgttcaacgaagtgccaactgnagaggnagatgaagatgaagccaatgccatggtctcttaggactatactnggggatggtttatnatgancttgctttgttaattatgtgcagtaactanttttncgtagaggatantcacattttaatgcttattttnccttccgtgtgaaaatttggacgagtagagattgggtagttctcgctcaaaagacggtgtaatctcgtgtatgttgctgcagacagttttaggtcggtgccttatgtgttttgtt

SEQ ID NO: 8835 - DNA, 1952 bp, Prunus mume
atattaacggtttagacggctgagattaaaagaaagacgggaggcaacagcaaaacaaattagccattgaagagagaacccttcactcttcttcactcttcgcacgccgccgccagtttttccgtcacttcgccactgaagaaaacccttcacagagcttctcagttttcagccatggcggagctaaagctctcagagagtcgggacctaactcgaatagagcgcataggcgcacactcccacatccgagggctcggcctcgactctgccctagaagcccgtgacgtctccgagggcatggtgggccagacctcggcgcgaaaagccgccggcgtaattctccagatgatcaaagaaggcaagatcgcgggtcgggccgtactgttggccggtcaacccggaaccggaaagaccgccatcgccatgggcatggccaagtcgctcggcctcgaaacccccttcgctatgttagccggaagcgagctcttctctctcgagatgtccaagaccgaagccctaatgcaagcttttaggaaagccattggggttagaattaaggaagagactgaggtcatcgaaggtgaggttgtggaggttcagattgaccggcctgcggtggctggagcggcttcgaagaccgggaagttgactttgaagacaacggagatggagacggtgtatgacttgggggccaaaatgattgaggctttggggaaggagaaggtgcagagtggggatgtgattgctattgataaagcttctgggaagattacaaagcttggtaggtcgttttcgaggtcgagggactatgacgccatgggaccgcacatcaagttcatgcagtgccctgatggagagttgcagaagcgcaaggaggtggtgcattgtgtcacccttcatgagattgatgtcatcaacagcagaacacagggatttctggctctatttactggtgatactggtgaaatccgttcagaagtgagagaacagattgacacaaaggtggcagagtggagggaggaagggaaggcagagattgtgccaggtgtcctctttattgatgaggtgcatatgcttgacattgagtgcttttcatttttgaatcgtgctttggagaatgagatggctccaatattagttgttgctaccaacagagggatcactaccatcagaggcacaaactataaatccccccatgggattcctattgacctccttgatcgcctgcttatcattaccacccagccttacacagaggatgaaattcgtaagattctggacatcagatgccaagaagaagaagttgagatgtctgaagaggcaaagcatttgttgaccaagattggtgttgatgcatccttgagatatgctatccatctcataacagcttctgccttggcatgccaaaagcggaagggaaatattgtggagatggaggatattaaccgagtttaccatctgtttttggacgtaaagagatcaacacagtacttaatggagtatcagagtcagtatatgttcagtgaggaaggtgatgaagatgataccaatgccatgcaatcttgagagattccttgcgactaggaaagactttgtgtttatttctgtatcttggtttattggttttaggcagcactggacttttttcatgggaaaacggcattactgctcgtgtatgttttgaccctgtttagagttttgggattttatggtagttttgtggtttttccatttgaagcatgaatctgtaatatttatccacatacaacaatgtagcaggaatagtctcatgactttgatatctaatctactttaatctagggtttccgcctacatcttcctccgggagccttacaagttacagaaccttcgctttaatcaattgtgattcgttcaatccaagtctgtccaagggtattgtaaggggttgtttaatcaattggcaaatttca

SEQ ID NO: 8836 - DNA, 1643 bp, Solanum lycopersicum
ctgtctctctttctcctctgcttcatcaatggcaatgggggagttgaaaatctcagagatgcgtgacctaacccgtatagaacgcataggggcacactctcatatcagaggtcttggccttgattcttcactcgaacctcgattaagctctgaaggtatggtaggtcaaattccagctcgaaaagctgccggaatcattgttaaaatggttcaacaaggtaaaattgcgggtcgtgcactgctccttgcgggtcaacccggaactgggaagacagctatagctatgggtatggctaaatcgttagggcaagaaaccccttttgctatgcttgctggtagcgaactttattcacttgatatgtcgaaaactgaagcgttaatgcaggcttttcgtaaagcaattggtgtgagaattaaagaagaagctgaagttattgaaggtgaagttgtggaagtacatattgataggccggcggtagctggagctgcgtcaaaaacaggaaaactgacgttgaagactactgatatggagacggtttatgatttgggggcgaagatgattgaggctttggggaaggagaaagtacagagtggggatgttattgctattgacaaggcttctgggaagattacgaagttggggaggtcgttttcaaggtcgagggattatgatgctatgggacctcagactaagtttgtacaatgtcctgaaggggagctgcagaagcgcaaggagattgttcattgcgttacccttcacgaaatcgatgtcataaatagcagaacacagggatttttagcactatttacgggtgatactggtgagattcgtgctgaagtgagagaacaaatagataccaaggttgctgagtggagggaggaagggaaggcagagattgtgcccggtgtcctcttcattgacgaagtacatatgcttgacattgagtgtttctctttcctaaaccgagctctggagaatgacatggcacctatattggttgttgctacaaatagaggcattactacaatccggggaacaaactacagatccccacacgggattccaattgactttcttgatcgcctgctcatcatctctacacaaccttacaaagaggaagaaattcgcaaaatcctggacatcagatgccaagaggaggatgtagaaatgtctgaggatgcaaaagttttattgaccaagatcggggttaatacttctttgagatacgccatccatcttatcacttctgcagcattggcctgccaaaagcgcaaagggaaggctgttgaagtggaagatattactcgagtctataatctgttttatgatgtgaagagatccacacagtacttgatggagtatcagagccagtatatgtttaacgaagtgccagccggagaggccgaagaagatgaaactgctgcaatggtgtcctaaaaccttctcgacatgggattcaggagattgcaacttagctttggccaagtatttagttacctggttcttgtttgatgatttcttctctttcatttatgttttctgacctttgtgttacttgaatatagttccctcccccggtttcttttttctcgtttacttatcagtaaaaaaaggaagtgcatcagcttctatttttctgtat

SEQ ID NO: 8837 - DNA, 2074 bp, Eucalyptus grandis
caaaaccctaaaaccctgatcttcgaaaactcttctcgctctctctctctcgtccctctccgactcgctctccctccccctccctctctcgccatggcggaggtgaagctctcagaaacccgggacttgacccgaatcgagcgcatcggcgcccactcccacatccgcggcctcggcctcgactcctccctcgaggcccgcgccgtctccgagggcatggtcggccagaccgccgctcgcaaggccgccggcgtcatcctccagatgatcaaggacggcaagatcgccgggcgcgccgtgctcctcgcgggccaacccggcaccggcaagaccgccatcgccatgggcatggccaagtccctcggcctcgagacccccttcgccatgctcgcgggcagcgagctcttctccctcgagatgtccaagaccgaggccctcatgcaggcgtttcgaaaggcgatcggggtgaggatcaaagaggaagccgaagtgatcgaaggcgaggtcgttgaggtccaaattgaccgccctgccgtggcgggggctgcttcgaagaccgggaagctgacgcttaagactacagagatggagacggtgtacgatttgggggcaaagatgatcgaggcgctggggaaggagaaggtgcagagtggggatgttgttgcgatcgataaggcgtcggggaagatcacgaagcttgggaggtcgttctcgcggtcgagggactatgatgcgatggggccgcagacgaagttcgtgcagtgcccagatggcgagttacagaaacggaaggaggtggtgcattgtgtcactctccatgagattgatgttatcaatagcaggacacagggatttctggcgctgttcactggtgatactggtgaaattcgtgcagaagtgagggagcagatagacaccaaagtggcagagtggagggaggaaggaaaagctgagatcgtaccaggagtgctcttcattgatgaagtgcacatgcttgatatagagtgcttctctttcttaaatcgtgctctggagaatgagatggctcctatattggttgttgctaccaacagagggatcaccaccattcgaggcacaaactacaaatccccgcatggaattcccattgaccttctggaccgtcttctcatcatcactactcagccctatactgaagatgaaattcgcaagattatagacattaggtgccaagaggaggatgtcgaaatgtctgaagaggcaaaactcttgttgacaaagattggagtggatacatccttgaggtatgctatcaatctcattacggctgctgctttgtcatgccagaagcggaaggggaaaattgtggagttggaggacatcacacgagtctacaatctctttttggatgtgaagagatcgacacagtacttgatggagtatcaaagccagtacatgttcagtgaatttggtaatgctgaggaagatgaagccaatgtaatgatttcctgaggtagtcctttatctgtaatgatgtaagttcttgttttcacaaatattgacctgcttgaaaactatggtagttctctttttttatagtccaaaatttgctgtagctttggagattcgggagttgtaatgtttgcatgatctttaattgttgtaaagttaaatgagcccttttggtcataactcatgagattaggtcaagaagaaaaacattaacgacctggtcttctatccttgtgaagggaggagttacaaaagggacaaaaaggagaaacgttcctctttgctacaacacctgatctggggttctgaagagaacttctcaaagccactagacagggaacgttggcagatattagaaacctcatttcaccataaagtggaacatatccttctaccgtgttggcacttcgttgcttctcttagaattccaagcttcttaatcatccgtccttatctactatcaatattcagaattctcatgcaaacctcagagcctcctgggtaaattttttgctcgacttgattccaagcttctatctggaatgttgttgacgctacctaattcgagctatttttgacccta

SEQ ID NO: 8838 - DNA, 1983 bp, Glycine max
gagaagtgaattggaggatgggaagcaactagcaagggtaccttcattcttgtgttgcttgtggcacgggcagtctagcgatcccggcattgatatagttacatgctgaagcagtaacttaagtgtcgcacaagcgcactccgaagtccaaaccttcatcaaaaccctaaacaaaccccgaaagcctctttctccctcgcaccatcttcgccgtttctatcatggcggagctgaaactctctgagagccgcgacctgacccgcattgagcgcgtgggcgcgcactcccatattcgcggccttggccttgactcctccctggagccacgcgccgtctcggacggcatggtcggccaaactgccgcccgcaaggccgccggcgtgatcctccagatgattaaagatggcaagatcgccggccgcgcggtcctcctcgccggccagcccggcaccggcaagaccgccatcgccatgggcatggccaagtccctcggcctcgaaaccccctttgccatgatcgctgccagcgaaatcttctcattggaaatgtccaaaaccgaagccctcacccaggccttccgcaaggccatcggcgtccgcatcaaggaagaagccgaagtcattgaaggggaagtggtcgaggtccagatcgaccgccctgcggtgtctggcgccgctgcgaagaccgggaagctgacgctcaagacgaccgagatggaaacggtttacgacctcggcgctaagatgatcgaggcgttggggaaggagaaggtgagcagcggcgatgttattgcgattgataaggcgtccgggaagattacgaagcttggacggtcgttttcgcggtcgagggacttcgacgctatggggccgcaggtgaagttcgtgcagtgtcccgatggagagttacagaagaggaaggaggttgtgcattgtgttactcttcacgagattgatgttattaatagcagaacacagggatttctggctcttttcactggagatacgggtgaaattcgtgctgaagtcagagagcaaattgacaccaaagtggcagagtggagagaagaaggaaaggcagagatcgtgcctggtgtccttttcattgatgaggtgcacatgcttgacatagagtgcttttcattcctcaatcgggcgctggagaatgatatggctcccatattagttgttgctaccaacagaggcatcacgactattagaggcacaaattacaaatccccacatgggatccccattgatcttctggatcgactactcatcatctctactcagccttacacggaggatgagattcgcaagattctggatatcagatgccaagaggaagacgtagacatgagtgaaggtgcaaagtgtttgttaaccaaaataggtgtagaaacatctttgagatatgctattcatctaatcacagcagctgcattggcatgccaaaagcaaaaggggaagaccgtggagttggatgatataaatcgggtttataatctgtttttggatgtcaaaagatcaacacagtacctaatggagtatcaaagtcagtacatgttcaatgaaacaggagaagctgatgaagatgaagccaatgccatggtctcttagatttacaataatcagttagagaatttgtaattatctggttagtctttctataagttgcagcattttgttccatgatctggttggtcaatgcgcttcaaattatgtttgatatagatcaccagaagtttcccgtggttgaactgtgcacaggagtttgcaacttatatactatgattcatgaacatgagaagctgtaccgaatttctgttactactgagcatttacccccttgtttttttttttgctgtatcatgcattgcacaatcatcaatagagtagctttatcagtaacttattagacgtggtttgctgtaggcggtcatattattgagatgaaattctaattttgattgaaaaataatat

SEQ ID NO: 8839 - DNA, 1417 bp, Cucumis sativus
catcggctcttacgatggcggagctgaagctgtcggagagccgcgacctaacgcgaattgagcgcattggggctcattcccacatccgcggcctcggccttgattcctcccttgaaccacgggccgtctccgagggaatggttggccaaaccgccgctcgtaaggccgctggtgttattcttcagatgatcaaagaaggcaaaattgccggtcgggctgttctcctcgctggtcagcctggtactggcaagactgctattgccatgggcatggctaagtcccttggtcttgaaacccctttcgcaatgattgctggcagtgagctcttttctttggaaatgtccaaaactgaagcgttgatgcaggccttccgtaaatctattggcgtccgaataaaggaagaaaccgagattatcgaaggagaggtcgttgaggttcaaatagacaggccagcagttgccggggcagcgtcgaagactgggaaacttactttgaaaacaacggatatggaaacggtatatgatttgggggcgaagatgattgaagctttgggaaaggaaaaggtgcagagcggggatgtaattgcgattgataaggcctcggggaaaattactaaactagggaggtctttctctaggtctagggattatgatgcaatgggtccccaaacaaagtttgtgcaatgccccgatggtgagttgcagaagcggaaggaggttgtacattgtgtcacactccatgagattgatgtcatcaatagcagaacacaaggtttcttagctttattcactggcgatactggagaaattcgagctgaagtaagggaacaaattgataccaaagtggctgagtggagggaagaaggcaaggccgagatagttccaggtgttctctttattgatgaggttcatatgcttgatattgagtgcttctctttccttaatcgtgctttggagaatgagatggctccaatactagttgttgctacaaacagggggattaccacaatccggggaacaaactacaaatcccctcatggtattcctattgatcttcttgatcgattacttataatttctactcaaccttatacggaggatgaaatccgaaagattttagatatcagatctcaagaggaagaagtagaaatgtctgaagaggcaaagagacttttgaccacaattggtgtagaaacatctcttagatatgccatccatttaatcacagccgctgctttggcctgtcaaaagcgaaaggggaagattgtggagatggaagacataaatcgagtatatcatctgttcttagatgtgaagagatcaactcagtacttgatggagtaccaaaatcaatacatgttcagcgaattgggagatggtgaagaagatgattctaatgctatgaacccttgacatct

SEQ ID NO: 8840 - DNA, 1673 bp, Prunus persica
ctcagtcttcagccatggcggagctaaagctctcagagagtcgggaccttactcgaatagagcgcataggcgcgcactcccacatccgagggctcggcctcgactctgccctagaagcccgcgacgtctccgagggcatggtgggccagacctcggcgcgaaaagccgccggcgtaattctccagatgatcaaagaaggcaagatcgcgggtcgggccgtactgttggcgggtcaacccggaaccggaaagaccgccatcgccatgggcatggccaagtcgctcggcctcgaaactcccttcgctatgttagccggaagcgagctcttctctctcgagatgtccaagaccgaagccctaatgcaagcttttaggaaagccattggggttagaattaaggaagagactgaggtcatcgaaggtgaggttgtggaggttcagattgaccggcctgcggtggctggagcggcttcgaagaccgggaagttgactttgaagacaacggagatggagacggtgtatgacttgggggccaaaatgattgaggctttggggaaggagaaggtgcagagtggggatgtgattgctattgataaagcttctgggaagattacaaagcttggtaggtcgttttcgagatcgagggactatgacgccatgggaccgcacatcaagttcatgcagtgccctgatggagagttgcagaagcgcaaggaggtcgtgcattgtgtcacccttcatgagattgatgtcatcaacagcagaacacagggatttctggcactatttactggtgatactggtgaaatccgttcagaagtgagagaacagattgacacaaaggtggcagagtggagggaggaagggaaggcagagattgtgccaggtgtcctctttattgatgaggtgcatatgcttgacattgagtgcttttcatttttaaatcgtgctttggagaatgagatggctccaatattagttgttgctaccaacagagggatcactaccatcagaggcacaaactataaatccccccatgggattcctattgacctccttgatcgcctgcttatcattaccacccagccttatacagaggatgaaattcgtaagattctggagatcagatgccaagaagaagaagttgagatgtctgaagaggcaaagcatttgttgaccaagattggtgttgatgcatccttgagatatgctatccatctcataacagcttctgccttggcatgccaaaagcggaagggaaatattgtggagatggaggatattaaccgagtttaccatctgtttttggacgtaaagagatcaacacagtacttaatggagtatcagagtcagtatatgttcagtgaggaaggtgatgaagatgataccaatgccatgcaatcttgagagattccttgcgactaggaaagactttgtgtttatttctgtatcttggtttattggttttaggcagcactggacttttttcatgggaaaacggcattactgctcttgtatgtttggatcctgtttagagttttgggattttatggtagttttgtggtttttccatttgaagcatgaatctgtaatatttatccacatataacaatgtagcaggaacagtctcaggactttgatatctaatctactttaatctagggtttccgacta

SEQ ID NO: 8841 - DNA, 2015 bp, Theobroma cacao
gctcgctccatttcaattttcacacagtctacacaaaaccctaaaccctacacctccccttcctcactcttccaatggcggagctaaaactctccgagagccgagatctaacccgaatcgaacgaataggggcacactctcacatccgcggccttggccttgactcctcgctggaggcccgcgacgtctcggagggtatggtgggccaaacccaagcccgcaaagccgccggcgtcatcctccaaatgattaaagacggcaaaatcgctggccgagccatcttattagcgggacaacctggaaccggtaaaaccgccatcgccatgggcatggccaaatccctaggcctcgaaactccctttgctatgctttcgggtagtgaactcttctccctcgaaatgtcaaaaaccgaagcgttaatgcaagcgtttcgaaagtccattggagtaagaatcaaagaagaaaccgaagtaattgaaggcgaagtcgttgaaatccaaattgaccgcccggcggtctccggggcagcttcgaaaacggggaaattgacgcttaaaacgacggacatggagaccgtttatgatttgggggcgaagatgattgaggcgttagggaaagagaaagtgcagagtggggatgttatagctattgataaagcttctgggaagataacgaagctgggaaggtcattttcgaggtcgagggattacgatgcaatggggccgcaaactaagttcgtgcaatgtccggatggagagttgcagaagaggaaagaagttgttcattgcgttacgcttcatgagattgatgtcattaatagcaggacacagggatttctggcacttttcactggtgatactggtgaaatccgtgctgaggtgagagaacaaattgacacaaaggtggctgagtggagggaggaaggaaaggcagaaattgtgcctggtgtcctctttatcgatgaggtgcacatgcttgatattgagtgcttttccttcctgaatcgtgctcttgagaatgagatggccccgatattagttgttgctaccaacagaggaataactacaatccgaggcacaaattacaaatccccacatggaattccaattgatcttcttgatcgactattaatcattactactcaaccttattctgcggatgaaattcgcaagattctagacatcaggtgccaagaggaagatgtggagatgtctgaagatgcaaaacaactgttgacaaaaattgggcatgagacatccttgagatatgctatacatcttatcacagcttctgctttgaattgccagaagcggaaggggaaggtcgtggaagtacaggatatcactcgggtttacagtctgtttctggatgtaaggagatcaacacagtacttgatggagtaccaaaaagagtacatgtttaacgaagcatcaatggttgatggtggggaagatgatgctgatgccatgcacgattgattgctccttcaggtttagaattgaagattttgtgttattatgtttctttattaatgcccttcacacatggcatgtcatagcatctcacagtttgttctgtgtcatgactaatattatttgggtagtttttgctgtgcggtggtgagtttgtattgtaatttgtatggaataccaagtcttaatttcccggtagtttctgtgggattggcttcctgaacaaatttgtgcggcaacattaatttgaagcagtgtagaaatagtaatcctagcactcgataaggtttaaaaaagaaaaattattacgaagctgaagttgcgttctcaatatttatcataaattaaggaaccttgttccttcaaaagactgatactctcttcggcatgggcttccctagtcaagaaagatggcagaacttcctatccattttttagtctatagcggccgtctctcattccattgcttaacccatgcgctctgaaagttatcatgtcatattttggttttcttagatgtctcaaatctatgttcacactttt

SEQ ID NO: 8842 - DNA, 2733 bp, Solanum lycopersicum
aaccgacccgacctgaataccctactcgcatgattttcatgttactcacattattgttataggatcgatcctccgtaaaccctaaaccctaatttcttttgctaccttctctgtctctctttctcctctgcttcatcaatggcaatgggggagttgaaaatctcagagatgcgtgacctaacccgtatagaacgcataggggcacactctcatatcagaggtcttggccttgattcttcactcgaacctcgattaagctctgaaggtatggtaggtcaaattccagctcgaaaagctgcaggaatcattgttaaaatggttcaacaaggtaaaattgcgggtcgtgcgctgctccttgcgggtcaacccggaactgggaagacagctatagctatgggtatggctaaatcgttagggcaagaaaccccttttgctatgcttgctggtagcgaactttattcacttgatatgtcgaaaactgaagcgttaatgcaggcttttcgtaaagcaattggtgtgagaattaaagaagaagctgaagttattgaaggtgaagttgtggaagtacatattgataggccggcggtggctggagctgcgtcgaaaacagggaaactgacgttgaagactactgatatggagacggtttatgatttgggggcgaagatgattgaggctttagggaaagagaaagtacagagtggggatgttattgctattgacaaggcttctgggaagattacgaagttggggaggtcgttttcaaggtcgagggattatgatgctatgggacctcagactaagtttgtacaatgtcctgaaggggagctgcagaagcgcaaggagattgttcattgcgttacccttcacgaaatcgatgtcataaatagcagaacacagggatttttagcactatttacgggtgatactggtgagattcgtgctgaagtgagagaacaaatagataccaaggttgctgagtggagggaggaagggaaggcagagattgtgcccggtgtcctcttcattgacgaagtacatatgcttgacattgagtgtttctctttcctaaaccgagctctggagaatgacatggcacctatattggttgttgctacaaatagaggcattactacaatccggggaacaaactacagatccccacacgggattccgattgactttcttgatcgcctgctcatcatctctacacaaccttacaaagaggaagaaattcgcaaaatcctggacatcagatgccaagaggaggatgtagaaatgtctgaggatgcaaaagttttattgaccaagatcgggattaatacttctttgagatacgccatccatcttatcacttctgcagcattggcctgccaaaagcgcaaagggaaggctgttgaagtggaagatattactcgagtctataatctgttttatgatgtgaagagatccacacagtacttgatggagtatcagagccagtatatgtttaacgaagtgccagccggagaggccgaagaagatgaaactgctgcaatggtgtcctaaaaccttctcgacatgggattcaggagattgcaacttagctttggccaagtatttagttacctggttcttgtttgatgatttcttctctttcatttatgttttctgacctttgtgttacttgaatatagttccctcccccggtttcttttttctcgtttacttatcagtaaaaaaaggaagtgcatcagcttctatttttctgtatatcttttcctgaaggcatatgctaattatgtgagctagaacattagacacatagatgatacacaattaggcgagctttggatttgtggagaaatttggagattgattttctatttgaatacgagatgaggtatgcaagagagagagagagagagtgagaggattaggatgcagagaaagagtcctgatgaaggggaaggatatgggataatgaggtagcttatcaaaagaatttgttcacctgggtctccgaatgttttcagatgggaaagggttggagggagaaaggcaaacaagatagaataatttttcaagtactcagtaagtccaggtgtgggtgaggtagtcttggggaatggatgagaagtgagtgcatttcaaatgcaagtcaagagggactgggttttgtctttatattgacaaacaagagacacagaagtgtatgcttatcatcaatcctcgtggggatggtttggtgatagtaaagtggcgacggagagagagcaagagagaagaggttcagatccggagactgtagagtggggtgaataaagttataaagagaaatacttttcccttctttaagctttgtgtattcatctcgtttccacttaaccttctgaaaggttgaatgcttcttactatctagatattgggaagactagatttcagtcatgaaagaagaattaaaagatgttattctgttttgttttcaaaggacatcctaaaacttgtgtaccagacacacgtttgctatttcgtgatgaaacatggtccatgaggttcttgtggaacagagttataatgcgttttggattcaatttggcttagcatcttgtacatgggttcataattctgacattagttcctacaattaacattggctcatgatctgaactatacgttagggagaaaattgtataccatcttgttattcaacttgaagctctattgctgagcagtgaatcttgcatacccacg

SEQ ID NO: 8843 - DNA, 2146 bp, Theobroma cacao
gtttacttttttaagtgctaggaagagaacaaaagctcaaagaaactaaggctactctcttacactcctcgaccaagctacttctacaataatattatacacaatgtcttgtttcatggtattgttcttttaataaatgcaatatccaatatttcaccgattcaaaattcatttcgggctacatcgcacatgttgggctccattgccaaatggctactaaggcccaaactctaaaaatgatcctcaaattacaatattaccccaaccagagagaagaattttgtacctttaaccgaagcgtcgcccttttgtcaccgctcgctccatttcaattttcacacagtctacacaaaaccctaaaccctacacctccccttcctcactcttccaatggcggagctaaaactctccgagagccgagatctaacccgaatcgaacgaataggggcacactctcacatccgcggccttggccttgactcctcgctggaggcccgcgacgtctcggagggtatggtgggccaaacccaagcccgcaaagccgccggcgtcatcctccaaatgattaaagacggcaaaatcgctggccgagccatcttattagcgggacaacctggaaccggtaaaaccgccatcgccatgggcatggccaaatccctaggcctcgaaactccctttgctatgctttcgggtagtgaactcttctccctcgaaatgtcaaaaaccgaagcgttaatgcaagcgtttcgaaagtccattggagtaagaatcaaagaagaaaccgaagtaattgaaggcgaagtcgttgaaatccaaattgaccgcccggcggtctccggggcagcttcgaaaacggggaaattgacgcttaaaacgacggacatggagaccgtttatgatttgggggcgaagatgattgaggcgttagggaaagagaaagtgcagagtggggatgttatagctattgataaagcttctgggaagataacgaagctgggaaggtcattttcgaggtcgagggattacgatgcaatggggccgcaaactaagttcgtgcaatgtccggatggagagttgcagaagaggaaagaagttgttcattgcgttacgcttcatgagattgatgtcattaatagcaggacacagggatttctggcacttttcactggtgatactggtgaaatccgtgctgaggtgagagaacaaattgacacaaaggtggctgagtggagggaggaaggaaaggcagaaattgtgcctggtgtcctctttatcgatgaggtgcacatgcttgatattgagtgcttttccttcctgaatcgtgctcttgagaatgagatggccccgatattagttgttgctaccaacagaggaataactacaatccgaggcacaaattacaaatccccacatggaattccaattgatcttcttgatcgactattaatcattactactcaaccttattctgcggatgaaattcgcaagattctagacatcaggtgccaagaggaagatgtggagatgtctgaagatgcaaaacaactgttgacaaaaattgggcatgagacatccttgagatatgctatacatcttatcacagcttctgctttgaattgccagaagcggaaggggaaggtcgtggaagtacaggatatcactcgggtttacagtctgtttctggatgtaaggagatcaacacagtacttgatggagtaccaaaaagagtacatgtttaacgaagcatcaatggttgatggtggggaagatgatgctgatgccatgcacgattgattgctccttcaggtttagaattgaagattttgtgttattatgtttctttattaatgcccttcacacatggcatgtcatagcatctcacagtttgttctgtgtcatgactaatattatttgggtagtttttgctgtgcggtggtgagtttgtattgtaatttgtatggaataccaagtcttaatttcccggtagtttctgtgggattggcttcctgaacaaatttgtgcggcaacattaatttgaagcagtgtagaaatagtaatcctagcactcgataaggtttaaaaaagaaaaattattacgaagctgaagttgcgttctcaatatttatcataaattaaggaaccttgt

SEQ ID NO: 8844 - DNA, 1847 bp, Manihot esculenta
atgcgccgcgaagagaaacgtagcaagctccacgaagccctgctcaacactctttatccaccagacccagagccagagctccaagcggaagatgagaaaaagcctttgagcactcctcgggaagactttgatgtgaaactgattccagatgattatgggctgcggcaaagtagttcctcaacaagtgacgataatggtgagagcgaatgcagccaacagaaattgactagggctcagaggaagaggcttcgtaagaagaagcttaaggaagagaattctcgtcgaagagaaattattgggccattgttaccttcatccagcagcgatattggtggagatggtagtagagcagcggaaaaagacactccagctgctcgacaaaatgctgatgagagtcattgtgaccaaagcagcgggagaaagacgaccattgccatggcggaactcaagctatcagaaagccgagacttgacccgaattgagcgcataggcgctcattcccacatccgtggacttggtcttgactctgcgctggaaccccgcgctgtctccgaaggcatggtaggccagactgcagcccgaaaagccgctggtgtcatcctccaaatgataaaggatgggaaaattgctggtcgagccgtacttctggctggacagccgggtactggaaaaaccgcaattgcaatgggcatggcgaaatccctcgggcttgaaaccccattcgctatgatatctggcagcgaaatcttctctctggaaatgtctaaaaccgaagccctaatgcaagcttttcgaaaagcaatcggcgtaagaattaaagaagaaacggagataatcgaaggcgaagtcgttgaagtccaaatcgataggccagcggtaagtggtgcggcttcgaagactgggaaattgacactgaaaacgacggaaatggagacggtatatgatttgggggcgaagatgatagaagcattaggaaaggaaaaagtgcaaagtggagatgtaattgcgatagataaggcgtccggaaaaattacaaagctcggaaggtcattttcacggtcaagagactacgatgccatggggccacaggtgaagtttgttcagtgccccgatggtgagctgcagaagaggaaagaggtggtgcattgcgtgacgcttcacgagattgatgtcatcaatagcagaacacaagggtttctggctctcttcactggtgataccggtgaaatccgcgcagaagtgagagaacaaattgatacaaaggtggcagaatggagggaagaaggcaaggcagatattgtgccaggtgttcttttcattgatgaggtgcacatgcttgacatcgaatgcttctctttcctgaatcgtgctcttgagaatgaaatggctccaatattagttgttgcaaccaacagaggtatcaccacaattcgaggcacaaattacaaatctccacatgggattcccatagatctccttgatcgcctactaattatcacaactcaaccatatacaaaagatgacattcgcaagattgtggacattagatgccaagaagaagaggtagaaatttctgaagaggctaaggctttattgacacatattggggtagaaacatccttgagatatgcaattaatctcattactgctgctgcattagcatgccagaggcgcaagggaaaacttgtagagagcgaagacatcacacgagtttacagtctgtttttggatgtgaagagatcaacacagtacttgatggagtatcagaaccagtacatgtttaatgaagcaccagtcgggaatggcgacgaagatgatgccagtgctatgctttcttgaaggtaact

SEQ ID NO: 8845 - DNA, 1909 bp, Papaver somniferum
tcgtcttcttctttctctctctcttctctgcttctgcaacaatggcggaactaaaactatcagaaagtcgagaccttactcgaatcgaacgtataggagcacactctcacattcgagggcttggtttagattctgccctagaacctcgagatgtatcagaaggcatggtaggtcaagctcctgctcgcaaagcagctggagtcattcttcagatgattaaagaaggtaaaatcgctggtagagctgttcttttagctggtcaacccggaacaggtaaaactgcaatcgctatgggtatggctaaatctttaggtcaagaaaccccttttgctatgatggctggtagtgaacttttctcattggaaatgtcaaagactgaagccctaatgcaagcttttcgtaagtctattggtgttagaattaaggaagaaactgaagtaattgaagctgaagttgttgaagttcagattgatagacctgctgttgctggtgctgcatcaaaaactgggaagatgactttaaaaactactgatatggaaacagtttatgatttgggtgcaaagatgattgaagctcttggtaaacagaaagttcagagtggtgatgttattgctattgataagagttctggaaaaattactaaacttgggagatcttttgctaggtctagagattatgatgctatgggtcctcaaactaagtttgttcagtgtccagaaggggagttgcagaagagaaaagaagttgttcattgtgttactcttcatgaaattgatgttattaacagcaggacacagggattcttagctctcttcactggtgatacaggtgaaatccgtgcagaagtgagagaacagattgacacaaaagtggcggaatggagagaggaagggaaggcggagattgtgcctggtgtcttgtttattgatgaggttcacatgcttgacattgaatgtttctcttttctgaatcgtgctttagaaaatgatatggcacctatcttagtggttgccaccaatagaggaatcacaaatatccgaggtacaaactacaaatccccacacgggatcccgatcgacctccttgaccgtttgcttatcatctcaacacaaccctacagtgaggatgagatccgtaagatcctcgacattaggtcccaagaggaagatgttgaaatgtctgatgatgcaaaggttttgctaacaaaaattggggtagaagcatctttaaggtatgcgatccacctcataacagctgcgtcattggcttgccaaaagaggaagggaaaggttgttgagatggaggatatcagcagagtgtaccagttgtttctggacgtgaagagatcaacacaatacttgatggaatatcagaaccagtatatgttcaacgaggttccaacaagagagggaggtgatgaagatgatgctactgctgtgcattcctgaatgttctttgagttcatattaagagaaagaaaaagtgctcatcaccttttcatgcacgtaagcccctgattatactttgttcttagccaagactgttaggcataatgatttttcgttaatggtgatagcatagatgtaagtgcatatggtgtatcttctttagttctcttttatattttatgaacatcggggttgttatttactagttctatgccttcctgtgtagttgtagacatagacaccatggtatggaacacaacctgtcaacggacatcatcctctaggaaaaatagaaaatcaattgtgatttctcatgattgttttattgatgtttattgttgacgctgcaatgtctggtctaaatttaatctttgtaccggttgtctttgtgaagaatgtgtagccttctttttctcttcagttttaaataggcagttgatgtttcagctagataaaatcct

SEQ ID NO: 8846 - DNA, 1585 bp, Elaeis guineensis
gaggctctcggagagtcgtgaccttacccggatcgagcgcatcggtgcccactcgcacatccgcggcctgggcctcgactccgccctggaggcccgggctgtctccgagggcatggtcggtcagcagtccgcccgcaaggccgccggcctcatcctccagctcatccgcgagggtaagatcgccggccgcgccatcctcctcgccggccagccgggcactggcaagaccgccatcgccatgggcctcgccaagtccctcggccaggagacccccttcgccaccgtctccggttccgagctcttctccctcgagatgtccaagaccgaggccctcacccaggccttccgccgcgccatcggcgtccgcatcaaggaggaggccgagatcatcgagggcgaggtcatcgagctcaccatcgaccgccccgccgccgccggaggcggcgcaagtggttccggccagtcctcgtcagcctccaagaccgggaagctcacgctcaagaccaccgacatggagacggtgtacgatttgggcgcgaagatgatcgaggcactgaccaaggagaaggtgcagagtggggatgtgatcacattggataaggcgtccggaaaggtcacgaagctggggcggtccatcgggcggtccagggactacgatgccgttggaccgcatacgaagttcgtgaggtgccctgagggggagctgcagaagagaaaggaggtcgtgcactgcgtcacccttcacgagatcgatgtcatcaacagcagaactcaaggctttttagcactctttactggtgacactggcgaaatccgtgctgaagtcagagagcagatagacacaaaagtggcagagtggagagaggaaggaaaagctgagatagtcccgggtgtcctgttcatcgatgaggttcacatgcttgacattgaatgcttctcattcctaaatcgcgcattggagaacgatatggcccccatcctggttattgcaacaaaccgagggatcacaaccatccgaggcacaaactatagatctccccatggaatcccagccgatttcctcgaccgcctacttataatatgtactcaaccatataccgaggaggagacccggaagattcttgacatcagatgtgaagaggaagatgtagaaatgtccaaggatgcaaaggttctgctaacaaaaataggtgcggagacctctttgaggtatgcaatcaacttgatcactgcagctgctcttgcttgccagaagagaaagggtaaggattgttggaggatggagggatataagtagggtggtatcagttgtttctttgtatgtgaaagaatcgacacagtatttaattaggaggtaccacgagccacgtacatgttctaacgaaagtagccgacgggagggcgagatgagatgaaccaacgcattttaagttctggcaccatgtagtagctccatccgtatgtttactttagtcgatggtaggggtagggattgttaagttccaacgtattcttgctgttgcttaatttattgccctatggttgtttggtatctgatctgtcgaaacagattctatgcgagaga

SEQ ID NO: 8847 - DNA, 2384 bp, Amborella trichopoda
cagagagagggaggtgtttcccacagaggttttagggtgtaagcttcagagagagggaggtgtttcagagagagtttacgctccactcacgtagatcacgtagagagactgtcctagggcttctcctctagagagagagagggttttccctactagggcttctgattttctcagagggagaaaccatggctgagctgaagctctcagaaagcagagacctgacccgaattgagcgcataggtgcccactctcacatccgaggactgggcctcgacgcgaacctccagcctcgcgacagctctcagggaatggtcggccaagtccctgctcgcaaggcggctggcctcatcctccaaatgatcagagagggcaaaatcgcgggtcgagctgttcttatagctggccagccaggcactggtaagaccgctattgccatgggcttggccaaagccttaggggaagaaacaccatttgctatgatggctggctctgagctcttctctctcgaaatggggaaaactgaggccctaacgcaagcttttcgtaaggcaataggagtgagaatcaaggaagagactgagattatcgagggggaagttgttgagttgcaaattgataggcctgccactcaaggggccgctttgaagactgggaaattggtgatgaagactacagagatggagactgtgtatgatttgggagcaaaaatgatagagagtctggggagggacaaggttcagagtggggatataattgttattgataaggcctccgggaagataacgaagcttgggcggtcgtttaataggtcgagggattacgatgcaatggggcctcagacgaagtttgtgcagtgcccagatggggagttgcagaagaggaaggaggtcgtgcattgcgtcacacttcatgagattgatgtgatcaatagcaggacgcaaggatttcttgctctcttcactggggacacaggtgagatccgagcagaggtcagggaacagattgacactaaagtggcagagtggagagaggaaggcaaagctgagattgtgccaggggtcctcttcattgatgaagtccatatgcttgacattgagtgtttctctttcctcaaccgggcattagagaacgagatggcccctatcttagtggtggcgacaaaccgaggcattacaagaattcgaggcacaaactacaagtccccacatggaatcccaatagaccttcttgatcgactcctaatcatctccacccaaccctacactgaagaagaaattcgaaaaattctcgatattaggtgtgacgaggaagatgtggaaatgtcggaggatgcaaaggtccttttgacaaagattggggtagagacttctctaaggtatgctattcatttgataacagctgcttcgctcgcttgccaaaaacgtaagggaaagctcgtggagatggaagatatcagtagggtttaccaacttttccttgatgtgaagagatcgacccagtacctagtggagtatcagaaccagttcatgttcaatgaggttcccggtgaggtggatggagttgaaactatgcaagtgtaatcttgggttcttcttgcttaccatcaattttcgagatttcatgttcgatgttcaatgaggttcccggtgaggtggatggagttgaaactatgcaagtgtaatcttgggttcttcttgcttaccatcaatttttgagatttcatgtcgatgttacgggagagaagtcagaaagagatgaccatgcatgctcacaactcggattttcctggttaattgtgtatttttggattatcatgattctaccccctctgtttttttcggttcgcgtagtatcaggaattctagttgttcttgttcatgatgaagtggagagaggccacatgatagaatacgtatttctctttttcttggtatagttcatatttcatattctatgttacaatgttcaatcttaggaatgggattgaagttaaggtgctagcatgactcagctaccggtcttggtttccattcctacaatgctaacaacccttttgaaatttgtttaccatggttgtacctatgcttggcaaaggtggcatgtcagcctaaaatttgttaaccatggttgtaactatacttggcaaaggtggcaggtcagcctaggaatcgcaagttgaggtcgaagcaattgctcggtatctactgcagtttgctctttcatgctgcgagtttttttattgaatctgtaaatctcttttcataaatgcaaaaaagaattacatgtatatctgttttcatcatatacgaaattcagccattacatgtatatctattctttattgtatacaaaattgagctctctatacgacagacttttcaaaa

SEQ ID NO: 8848 - DNA, 1720 bp, Allium cepa
gaattcgtaaaaccctaacctcaacccttctcaaattcaccgatggcttcggagctgaagaaaataaccgaatctcatgacctgacgcgaatagaacgcataggagctcactctcacatcagagggctcggcctcgatgactccaacacccctcgcctaatcgccgacggcatggttggccagcttcccgcccgaaaagctgcaggattgattcttaaacttatcaaagaaggaaagattgctggtcgggcagttcttctggcgggacagccgggaacaggtaagacagcgatagcaatgggactggccaagtctttagggcaggagacgccttttgcgacgattgcagcgtcagagctgtttagcttggaggtttccaagactgaggcattgatgcaggcgtttaggaaggctattggggttaggattaaagaggaagcggaggttattgaaggggaggttgttgagatttccattgatcgacctgcaggaggagactccaaatcagcttcaaaaacagggaaattgacaatgaagaccacagatatggaaacagtgtatgagctaggaggcaagatgattgagtcattgaacaaggagaaggtacaaagcggggatgttatcgcattagacaaggcatctggaaaggtgacaaagctcggaagatcaatcgggcgatccagagattatgatgctatgggcccacagacaaaatttgtgaggtgtcctgagggagagttgcagaagaggaaggaggttgtgcattgtgtgaatctgcatgagattgatgtcatcaatagcagaacccagggatttcttgcactgttcaccggcgacacaggcgagatccgaagcgaagtgagggagcaaatagatgcaaaagtagcagaatggagagaagaagggaaagccgacgtaatcccaggcgtcctcttcatagacgaagtccacatgctcgacatagagtgcttctccttcctcaaccgagccctagaaaacgaaaactcacccattttggtaatcgccaccaaccgaggcatcacgaccatccgaggcacaaactacaaatcaccctcacgggatccctgcagacttcctcgaccgcctcctcataatatcgacgcaaccgtacaccgaggaagagatacgatcgatcctagacatcagatgcgaggaagaagacgtcgacatgagccaagacgccaaagtgcttttaaccaaaatcggggtcgaaacctctttgaggtatgccatccatttgatcactgcagctgcgctcgcttgtcagaagaggaaagggaaggtggtggagatggaagatgtgagcagggtttatagtctatttctcgatgtaaagagatcaactcagtatctgatggagtatcagagccagtatatgttcagtgaagtgactaacgacgatgaagacgatgacatggtacaagcctgatgtgaaattttgagctgtaagcgcatcatttgtaatgtaatgttatgcaacgctgtttatttatgggcatgttaggccgttctgtatattatttgttagcggatttatagctcgccacctttgcatttggttcttctgtccttgaaatgcaattgatatgtgaggttttcctcgttgattatgcttggtagcggttctcttcatgcgtgcgcacgctataaagcagggagtgccttgtgcattgtccactcagtatagtagattcttttg

SEQ ID NO: 8849 - DNA, 1471 bp, Flaveria ramosissima
aagaccactaaacatggtggaactaaaagtgtcggagagcagagacctaaccagaattgagcgcataggcgctcattctcacatccgtgggctgggtcttgactcggccctagagccccgtgctgtttctgaaggtatggtaggccaaaaccacagcccgtaaagcggctggagtcattgttcagatggtgaaagaaggtaaaatcgcaggtcgagctgttcttctagcgggccagcctggaacaggcaagactgccattgccatgggcatggctaagtcgattgggctagaaactccgttcgctatgcttgcaggcagcgagcttttttccttagagatgtctaaaactgaagcacttatgcaagcttttaggaaggctattggtgtgaggattaaagaggagactgaagtgattgaaggggaagttgtggagatccagattgaccgtcctgcagtgactggagctgcatctaaaacagggaagttgactttgaagacgaccgagatggagacagtgtatgatcttggggctaagatgattgaagctttggggaaagataaagttcagagtggtgatgtgattgctattgataaggcttcggggaagataacaaaacttgggaggtcattttcgaggtctagagattatgatgcaatgggcccacaaacgaagttcgtgcagtgtcctgatggcgagctgcagaagaggaaagaggtggtgcattgtgttacacttcatgaaattgatgttatcaacagcagaacacaggggtttcttgctctcttcactggcgacactggtgaaatacgagccgaggtcagagaacaaatagatacaaaggttgcagagtggcgagaggaaggaaaggctgagatcatcccaggtgtcctcttcattgatgaagtccacatgcttgacattgagtgtttttcattcctaaaccgtgccttagaaaatgacatggcgcccatactagttgttgccaccaaccgaggaatcacaaccattagaggcacaaactacaaatcaccacacgggataccaattgattttctggaccgcctgctcatcatctccacacaaccctacactgaagatgacattcgcaagattctagatataaggtgtcaagaggaagatgtggatgtatctgaagatgcaaaggttttgttgaccaaaatcggggtgaacacctcactaagatatgctataaacctgattacttcagctgcattggcttgccaaaagaggaaagggaaggtcgttgagatggaagacgtgagtcgagtttatgagctgttttgggatgtgaagaggtcaacacagtacttgattgagtatcagagccagtacatgttcaatgaagcaacgatggcggagaagatgagggcgctatgatggttgataaggtaggtagctgctgcttgtaatggttaaatttcaagtacttatggtatgtaattgtgaat

SEQ ID NO: 8850 - DNA, 1814 bp, Mimulus guttatus
attgaattagccaaacacgcccccgctctcattcaaaacactaaaaccctaaaccccctttcttgtgaaaccctctgcctctcttcgcttgaccttccttctcactcactactcagacaactatggcggagattaagctctcagagatgcgggacctgacccgaattgaacgaattggggcccattctcacatccggggtctcgggctcgactctgcacttgaagcccgctcctcctccgagggtatggtgggccagacctccgcccgcaaggccgccggcgtcatcgtcaaaatggtacaagaaggcaaaatcgccggccgcgccgtcctattagcaggccagcccggcacaggaaaaaccgccatcgccatgggcatggccaaatccatcggccaagaaaccccatttgcaatgctcgccggcagcgaattgttctccctcgagatgtcgaaaaccgaagccctaatgcaggcgttcaggaaagcaattggggttagaattaaggaggagacggaagttattgaaggcgaggttgtggaggttcaaatcgacaggccggctgtcgcaggggcggcgtccaagacggggaaattgacattgaagaccacagagatggagaccgtgtacgatttgggtgggaagatgattgaggctttggggaaggagaaagtgcagagtggagatgtgattgccattgataaggcttctggaaaaatcacgaagctaggaaggtctttctcgaggtctagggattacgatgcgatgggcccacagacgaagttcgtgcagtgcccggatggcgagctgcagaagaggaaagaagtcgtgcattgtgttactcttcatgagattgatgttatcaacagcaggacacagggtttcctagctctgttcaccggtgacacaggcgaaattcgagccgaagttcgagaacaaatcgacacaaaggtggcagagtggagggaagaaggaaaagctgaaattgtccctggtgtccttttcatagacgaagtccacatgctcgatatcgagtgcttctctttcctcaaccgcgccttggagaatgacatggcgcccatactagtcgtcgcaacaaacagagggatcacctcaatcagggggaccaattacaagtcgccacacggcatcccgattgacttcctcgaccgcctcctcatcatctccacgcagccctacacaccggaggacatccggaagattctagacattagatgccaagaggaagacgtggagatgtctgaagatgcaaaggtattgctgacaaagattggagaagacacttctttgaggtatgcgataaatcttattacagcatctgctttggcctgccttaaacggaagggtagggttgtggagatggaagacattagcagggtttacgagcttttttacgatgtgaagaggtccacgcagtacttgatggagtatcagagccagtatatgttcagtgaggtgccagctggagagggtgatgaagatgaaaccaatgccatggtttcttaaggggactgtttgcttgcactcgatattcgtctcgtcttgattgaattgttcataatgcggttggttgtgttttgcgtgtttttagatgtcggccgacgaatgttgtgtagcaaatttatcttctagtggtttttgtagcagaatttgaaggcttttctgaaaacttggtagctccatttatagtacttgattcatctgatttttatgtaatgtctgataaatatgccttacattgtgtttacttgagaaaaaacataataatgagaaaaatcagaaaataaatataaa

SEQ ID NO: 8851 - DNA, 1654 bp, Solanum tuberosum
tctgtacctctctctgctcagcaatggcaatgggggagttgaaaatctcagagatgcgtgacctaacccgtatagaacgcataggggcacactctcatatcagaggtctcggcctcgattcttcactcgaacctcgattaagctctgaaggtatggtaggtcaaattccagctcgaaaagctgccggaatcatggttaaaatggttcaacaaggtaaaattgcgggtcgtgcactgctccttgcgggtcaacccggaaccgggaagacagctatagctatgggtatggctaaatcgttagggcaagaaaccccttttgctatgcttgctggtagcgaactttattcacttgatatgtcgaaaactgaagcgttaatgcaggcttttcgtaaagcaattggtgtgagaattaaagaagaagctgaagttattgaaggtgaagttgtggaagtacagattgataggccggcggtggctggagctgcgtcgaaaacggggaaattgacgttgaagactactgatatggagacagtttatgatttgggggcgaagatgattgaggctttagggaaggagaaagtacagagtggggatgttattgctattgacaaggcttctgggaagattacgaagttggggaggtcgtttgctaggtcgagggattatgatgctatgggacctcagactaagtttgtacaatgtcctgaaggggagctgcagaagcgcaaggagattgttcattgcgttacccttcatgaaatcgatgtcataaatagcagaacacagggatttttagcactgtttacgggtgatactggtgagattcgtgctgaagtgagagaacaaatagataccaaggttgcagagtggagggaggaaggaaaggcagagattgtgcctggtgtcctcttcattgacgaagtacatatgcttgacattgagtgtttctctttcctaaaccgagctctagagaatgacatggcacctatattggttgttgctacaaatagaggcattactacaatccggggaacaaactacagatccccacatgggattccaattgactttcttgatcgcctgctcatcatctctacacaaccttacaaagaggaagaaattcgcaaaatcctggacatcagatgccaagaggaggatgtagaaatgtctgaggatgcaaaagttttattgaccaagataggggtgaatacttctttgagatacgccatccaccttatcacttctgcagcattggcctgccaaaagcggaaagggaaggctgttgaagtggaagatattactcgagtctataatctgttttatgatgtgaagagatccacacagtacttgatggagtatcagagccagtatatgtttaacgaagtgtcagcaggagaggccgaagaagatgaaactgctgcaatggtgtcctaaaagcttctcgacttgggattcaggagatcgcaacttagctttggccaagtatttagttacctggttcttgtttgatgatttcttctctttcatttatgttttctgacctttgtgttacttgaatatagtcccctccccccggtttctttttctcatttacttatcagtaaaaacggaagtgcatcagcttctatttttctgtataaaaaaaaaaaaaaaaa

SEQ ID NO: 8852 - DNA, 1731 bp, Gossypium hirsutum
gctagacccaaaactgaaaacaagcgttcagaacacaggcattatcaatagcttacatcatcattctcttccatttcaattcagtttctcacaaaacccaaaccttgcctttccctccctcaatcatccaatggcggagctgaaactctccgagagccgagacctgacccgaatcgaacgcattggggctcattcccacatacggggcctaggcctcgactcctctctggagccccgtgacgtctcggaagggatggtgggccaagcacaagctcgtaaagccgccggtgtcatcctccaaatgatcaaagacggtaaaattgctggccgtgctatcttattagcgggccaacctggaaccggcaaaaccgccatcgccatgggcatggcgaaatcccttggccttgaaacccctttctctatgctctctggcagcgaaatcttctcccttgagatgtcgaaaaccgaagctttaatgcaagcgtttcgaaagtccatcggggtaagaatcaaggaagaaactgaaataatcgaaggcgaagtcgttgaaatccagattgaccggccggcagtttctggggcggcttcaaaaactggaaaattaacgcttaaaacgacggacatggagaccgtttacgatttaggggcgaagatgatcgaggcattagggaaagagaaagtgcagagtggagatgtgatagctattgataaagcttcagggaaaataacgaagcttggaaggtcattttcaaggtcgagggattacgatgctatgggcccgcaaacaaagttcgtgcaatgtccagacggagagctgcagaaaagaaaagaagtcgtccattgtgttacgcttcatgagattgatgtcattaacagcagaacacagggatttcttgctcttttcactggggatactggtgaaatccgtgctgaggtgagagaacaaattgacacgaaggtggcagagtggagggaggaagggaaggctgaaatcgtgcctggtgttctctttatcgatgaggtgcacatgcttgacatcgagtgcttttctttcctgaaccgtgctcttgagaatgagatggcccctatattagtagttgctacaaacagaggcataacttcaatccgtggcacaaattacaaatcccctcatggaattccaattgatcttcttgatagactactaatcatcactactcaaccttattccgaggatgaaattcgtaagattctagacatcaggtgccaagaggaagatgtagagatgtctgaagatgcaaaacaactgttgaccaaaattgggcatgagacctccttgagatatgctatccatctgatcacagcttctgcactgaattgccagaagcggaaggggatggttgtggaagtgcaggacatcactcgtgtttacagtctatttctggatgtaaggagatcaacgcagtacttgatggagtaccaaaaagaatacatgttcaatgaagcatcaatccttgatggtggggatgccgatgccatgcacgattgatagctccttccggtctggttggagacttttcgttatcccatggcgttactgcaactattatttggcaaattcactgtgtaacagtgaattcgttttgtgatttgtatgcgatactgagtcttaatcccgtggatttacgtgcgaaaacaaacttgaaattgaagtactgatgaattttagaatgatgacaaagctgaagttct

SEQ ID NO: 8853 - DNA, 2207 bp, Gossypium raimondii
tcaaggagcaaatggagccgaaggcccaaactctaaaaaaatccaaaaattagaactttaccctagacccaaaactgaaaacaagccttcggaacacaggttttattaatagctttcttcatcactctctaaaacaattcaaaaattagaactttaccctagacccaaaactgaaaacaagcgttcagaacacaggcattatcaatagcttacatcatcattctcttccatttcaattttcagtttctcacaaaaccctaaaccttgcctttccctccctcaatcatccaatggcggagctgaaactctccgagagccgagacctgacccgaatcgaacgcattggggctcattcccacatacggggcctaggcctcgactcctctctggagccccgtgacgtctcggaagggatggtgggccaagcacaagctcgtaaagccgccggtgtcatcctccaaatgatcaaagacggtaaaattgctggccgtgctatcttattagcgggccaacctggaaccggcaaaaccgccatcgccatgggcatggcgaaatcccttggccttgaaacccctttctctatgctctctggcagcgaaatcttctcccttgagatgtcgaaaaccgaagctttaatgcaagcgtttcgaaagtccatcggggtaagaatcaaggaagaaactgaaataatcgaaggcgaagtcgttgaaatccagattgaccggccggcagtttctggggcggcttcaaaaactggaaaattaacgcttaaaacgacggacatggagaccgtttacgatttaggggcgaagatgatcgaggcattagggaaagagaaagtgcagagtggagatgtgatagctattgataaagcttcagggaaaataacgaagcttggaaggtcattttcaaggtcgagggattacgatgctatgggcccgcaaacaaagttcgtgcaatgtccagacggagagctgcagaaaagaaaagaagtcgtccattgtgttacgcttcatgagatcgatgtcattaacagcagaacacagggatttcttgctcttttcactggggatactggtgaaatccgtgctgaggtgagagaacaaattgacacgaaggtggcagagtggagggaggaagggaaggctgaaatcgtgcctggtgttctctttatcgatgaggtgcacatgcttgacatcgagtgcttttctttcctgaaccgtgctcttgagaatgagatggccccgatattagtagttgctacaaacagaggcataacttcaatccgtggcacaaattacaaatcccctcatggaattccaattgatcttcttgatagactactaatcatcactactcaaccttattccgaggatgaaattcgtaagattctagacatcaggtgccaagaggaagatgtagagatgtctgaagatgcaaaacaactgttgaccaaaattgggcacgagacctccttgagatatgctatccatctgatcacagcttctgcactgaattgccagaagcggaaggggatggttgtggaagtgcaggacatcactcgtgtttacagtctatttctggatgtaaggagatcaacgcagtacttgatggagtaccaaaaagaatacatgttcaatgaagcatcaatccttgatggtggggatgccgatgccatgcacgattgatagctccttccggtctggttggagacttttcgttatcccatggcgttactgcaactattatttggcaaattcactgtgtaacagtgaattcgttttgtgatttgtatgcgatactgagtcttaatcccgtggatttacgtgccaaaacaaacttgaaattgaagtactgatgaattttagaatgatgacaaagctacagattatccattggtccttcaaagattaatatcattgcctgtggtaaagaaagcttgcaggatatttatcatctaatccacgtgctctgaaagttaagcgtgtcaagttatgggttttcttgcacgtctcaaatacttgtattcatggcagacacaagccctaaatgaattgtatacaagcataataaaagaaaacatatgagcaatacaagccaaaaaaaggaaaaaactgagtggcagtcagcttggcaaacaaatgtttcactgtagggatcaattgaatatgatctaaaactctagccgttcatatcgttttgacagt

SEQ ID NO: 8854 - DNA, 1928 bp, Cajanus cajan
cacaaacaagcacactccagagtccaaaccaaaccctcaaaaccctaaacaaaacccctcttatcgccgccgcaaccatggcggagctgagactctcggagagccgcgacctgacccgcatcgagcgcgtgggcgcgcactcccacatccgcggcctgggcctggactcctccctctccccacgcgccgtctcggagggcatggtgggccaggtggccgctcgcaaggccgccggcgtcatcctccagatgataagagaggggaagatcgcggggcgcgccgtcctgatcgccgggcagccgggcaccggcaagaccgccatcgccatgggcatggcgaagtccctcggcctggagacccccttcgccatgatcgccggcagcgagctcttctccctcgaaatgtcgaaaaccgaagccctcacccaagccttccgcaaggccatcggcgtccgcatcaaggaggagaccgaggtcatcgagggcgaggtcgtcgaggtccagatcgaccgccccgcctccgccgccgccgccgccaagaccggcaagctcacgctcaaaacgacggagatggagaccgtttacgacctcggcgctaaaatgattgaggccttggggaaggagaaggtgagtagtggagatgttattgccattgacaaggcttctgggaagatcaccaagcttggaaggtcgttctctcgctccagggatttcgatgccatgggcccccaggttaagttcgtccagtgccccgatggggagttgcagaagaggaaggaggttgtgcattgcgtcactcttcacgagattgatgttatcaatagcagaacgcagggttttttggctcttttcactggtgatacgggtgaaattcgtgcggaagtcagagagcaaattgacaccaaagtggcagagtggaaagaagaaggaaaggcagagattgtgcctggtgtccttttcattgatgaggtgcacatgcttgacatagagtgcttttcattcctcaatcgggcattggagaatgagatgtctcccatattagttgttgcgaccaacagaggcatcacgaccattagaggcaccaattacaaatccccacatgggattcccattgatctgctggatcgcctactgatcatctctactcaaccgtacacagaggatgaaattcgcaaaattttggatatcagatgccaagaggaagacgtagaaatgagtgatggtgcaaagcatttgttaaccaaaataggtgtagaaacatccttgagatatgctattaatctaatcacagcagctgcattggcatgccagaagcggaagggaaagacagtggaattggatgatataaatcgggtttacaatctgtttttggatgtcaaaagatcaacacagtacctaatggagtatcaaagtcagtacatgttcagtgaaacaggagaagctgatgaagatgataccaatgccatggtttcctagatttacaaacatcagtcggagagtttgtaattacctggtcagtcattgattatataagttgcagaatttgttccatgatgtgattggtcaaaacactcatttatgtttgataatggtatagatcaccaggagttttccgtggttgaactgtccacatgattttgcaacttaaatattaggatcatgtgttatgttacttctaaacatttactcgtttcttttagctgtaccactaattcactagtcatcaatagagagtagctttaacagtaatttattagacatggtttacagtaggtggtcaaattattatgtaaggtgaaaggttgaacttttattagaggactgtctatttgcctcctcaggagcattttgtgttgttctccaattatattggagttagagcctcatctaaaaaattcacataataaaggtttatattaaacacttcaa

SEQ ID NO: 8855 - DNA, 1663 bp, Gossypium hirsutum
ttcccttcctcaatcatccaatgacggagctgaaactctccgagagccgagacctgacccgaatcgaacgcattggggctcattcccacatacggggcctaggcctggactcctctctggagccccgtgacgtctcggaaggaatggtgggccaagcacaagctcgtaaagccgccggtgtcatcctccaaatgatcaaagacggtaaaattgctggccgtgctatcttattagcgggacaacctggaactggcaaaactgccattgccatgggcatggcgaaatctcttggccttgaaacccctttctcgatgctctctggcagcgaaatcttctcccttgagatgtcgaaaaccgaagctttaatgcaagcgtttcgaaagtccatcggagtaagaatcaaagaagaaactgaaataatcgaaggcgaagtcgttgaaatccagattgaccggccggcagtttctggggcggcttcaaaaactgggaaattaacgcttaaaacgacggatatggagaccgtttacgatttgggggcgaagatgatcgaggcattagggaaagagaaagtgcagagtggagatgtgatagctattgataaagcttcaggaaaaataacgaagcttggaaggtcattttcaaggtcgagggattacgatgctatgggtccgcaaacaaagttcgtgcaatgtccagacggagagttgcagaaaagaaaagaagtcgtccattctgttacgcttcatgagatcgatgttattaacagcagaacccagggatttctagctcttttcactggggatactggtgaaatccgtgctgaggtgagagaacaaattgacacgaaggtggcagagtggagggaggaagggaaggctgaaatcgtgcctggtgttctctttatcgatgaggtgcacatgcttgatatcgagtgcttttctttcctgaaccgtgctcttgagaatgagatggccccgatattagtcgttgctacaaatagaggaataacttcaatccgtggcacaaattacaaatcccctcatggaattccaattgatcttcttgatagactactaatcatcactactcagccttattctgaggatgaaattcgtaagattctagacatcaggtgccaagaggaagatgtagagatgtctgaagatgcaaaacaactgttgaccaaaattgggcacgagacctccttgagatatgctatccatctgatcacagcttctgcattgaattgccagaagcgaaaggggatggttgtggaagtgcaggacatcactcgtgtttacagtctatttctagatgtaaggagatcaacgcagtacttgatggagtaccaaaaagaatacatgttcaatgaagcatcaattgttgatggtggggatggcgatgccatgcatgattgatagttcctagacttttggttatcccatggcgctgctgcaactattatttggtagtttcacagtgaatttgtatgctataccgagtcttaatcccgtggtagtttctgtaaatgaaattgtaggatttatgtccggatgaatttttgaattataacaaaaatgaacttccgttttcaattgtccttccaagattaatataatggcctgtggtcaggaagttatagggtaaaaaagaaaaagtaccg

SEQ ID NO: 8856 - DNA, 1810 bp, Solanum phureja
ttttgctcctctgtctgtcttcccctcttctgtacctctctcggctcagcaatggcaatggcaatgggggagttgaaaatctcagagatgcgtgacctaacccgtatagaacgcataggggcacactctcatatcagaggtctcggcctcgattcttcactcgaacctcgattaagctctgaaggtatggtaggtcaaattccagctcgaaaagctgctggaatcatggttaaaatggttcaacaaggtaaaattgcgggtcgtgcactgctccttgcgggtcaacccggaactgggaagacagctatagctatgggtatggctaaatcgttagggcaagaaaccccttttgctatgcttgctggtagcgaactttattcacttgatatgtcgaaaactgaagcgttaatgcaggcttttcgtaaagcaattggtgtgagaattaaagaagaagctgaagttattgaaggtgaagttgtggaagtacagattgacaggccggcggtggctggagctgcgtcgaaaacggggaaattgacgttgaagactactgatatggagacagtttatgatttgggggcgaagatgattgaggctttagggaaggagaaagtacagagtggggatgttattgctattgacaaggcttctgggaagattacgaagttggggaggtcgtttgcgaggtcgagggattatgatgctatgggacctcagactaagtttgtacaatgtcctgaaggggagctgcagaagcgcaaggagattgtacattgcgttacccttcatgaaattgatgtcataaatagcagaacacagggatttctagcactgtttacgggtgatactggtgagattcgtgctgaagtgagagaacaaatagataccaaggttgcagagtggagggaggaaggaaaggcagagattgtgcctggtgtcctcttcattgacgaagtacatatgcttgacattgagtgtttctctttcctaaaccgagctctggagaatgacatggcacctatattggttgttgctacaaatagaggcattactacaatccggggaacaaactacagatccccacatgggattccaattgactttcttgatcgtctgctcatcatctctacgcaaccttacaaagaggaagaaattcgcaacatcctggacatcagatgccaagaggaggatgtagaaatgtctgaggatgcaaaagttttattgaccaagataggggtgaatacttctttgagatacgccatccaccttatcacttctgcagcattggcctgccaaaagcggaaagggaaggctgttgaagtggaagatattactcgagtctataatctgttttatgatgtgaagagatccacacagtacttgatggagtatcagagccagtatatgtttaacgaagtgtcagcaggagaggccgaagaagatgaaactgctgcaatggtgtcctaaaagcttctcgacttgggattcaggagatcgcaacttagctttggccaaatacggagaagaaggcttcttgaatagcgatgatggatgtgcatgttttcaatactgacaaactggccttcaatggtgttgatcgagtctcagttagaaatgaatttggtgtttctctatgcctttgttaaagctaactaacattgttcatgagctacgcgttcttctcattttgctttgtcttttgggggcacgagggcgttgttttagtttgtgaattggctgcctgttttatattacattctggagctgctatatatgttcatggttcttggttaattgcattggtttggaa

SEQ ID NO: 8857 - DNA, 1642 bp, Echinacea purpurea
aaaccctatcacgcacgatctcttcacccgtccgccgcgaccagccacagcaagaatggtggaagtaaaagtctccgaaaccagagacctaaccagaatcgagcgcataggtgctcattcccacatccgagggctgggcctggactccgccctagaaccccgagccgtttccgaaggcatggtgggccaaaccaccgcccgcaaagcagccggagtcatcgtccagatggtcaaggaaggcaaaatcgccggtcgagccgtcctcttagccggccagcccggcaccggcaagaccgccatcgccatgggcatggccaaatcaatcggactcgaaacccctttcgctatgctcgcaggtagcgagttattctctctcgagatgtcgaaaaccgaagcacttatgcaggcttttagaaaggctataggtgtgagaataaaggaggagactgaggttattgaaggggaggttgtggagatccagattgaccggcctgcggttagtggagcggcgtcgaagacggggaagttgacgctgaagacgacggagatggagacggtgtatgatcttggggctaagatgattgaggctttggggaaggagaaggtgcagagtggggatgtgattgcgattgataaggcgtcggggaagataacgaagcttgggaggtcgttttcgaggtcgagagattatgacgcgatggggccgcagaccaagtttgtgcagtgtccggatggggagttgcagaagaggaaagaggtggtgcattgtgttacacttcatgaaattgatgttatcaatagcagaacacaggggtttcttgctctcttcactggcgacacaggtgaaatacgagccgaggtcagagaacaaatcgacacaaaggttgcagagtggcgggaggaaggaaaggctgagattgtgccaggtgtcctcttcatcgatgaagtccacatgctcgatatcgagtgtttctcattcctaaaccgtgccttagagaacgacatggcacccatactagtcgttgccacaaaccgaggaatcacaaccattcgaggcacaaactacaaatcgccacatgggatcccaatcgatttcttggaccgcctgctcatcatctccacacaaccctacacagaagatgatatccggaagatactggatataaggtgtcaagaggaagatgtggatgtctccgaagatgcaaaggtgttgttgaccaaaatcggggttgacacatcgctgaggtatgcgataaacctgattacatcagctgcattggcctgccaaaagaggaaagggaaggctgttgagatggaggatgtgagtagggtttatgagctgttttgggatgtgaagagatcgacgcagtatttgatcgagtatcagagtcagtacatgttcaatgaagcaacaatgggggaagaagaagatgaaggccacatgatggtctgataatattgtagtaatattcaagtctacttatgatctgatttgagaatgttaaatgcttctttctagttatattcgatgcccaaatgcacacttgcttgttccttttaagtttgcattgaagcctctttgagtttattttttcgtatgctacaaaggtggaaaattaaagggtaaattacaagttttgtc

SEQ ID NO: 8858 - DNA, 2155 bp, Gossypium raimondii
ggggactgaactgttcacgatttgcatagctaatgttgggctcaaggagcaaatggagccgaaggcccaaactctaaaaaaatccaaaaattagaactttaccctagacccaaaactgaaaacaagccttcggaacacaagttttattaatagctttcttcatcactctctaaaaaaattcaaaaattagaactttaccctagacccaaaactgaaaacaagcgttcagaacacaggctttatcaatagcttacttcatcattctcttccatttcaattttcagtttctcacaaaaccctaaaccctgcctttccctccctcaatcatccaatggcggagctgaaactctccgagagccgagacctgacccgaatcgaacgcattggggctcattcccacatacggggcctaggcctcgactcctctctggagccccgtgacgtctcggaagggatggtgggccaagcacaagctcgtaaagccgccggtgtcatcctccaaatgatcaaagacggtaaaattgctggccgtgctatcttattagcgggccaacctggaaccggcaaaaccgccatcgccatgggcatggcgaaatcccttggccttgaaacccctttctctatgctctctggcagcgaaatcttctcccttgagatgtcgaaaaccgaagctttaatgcaagcgtttcgaaagtccatcggggtaagaatcaaggaagaaactgaaataatcgaaggcgaagtcgttgaaatccagattgaccggccggcagtttctggggcggcttcaaaaactggaaaattaacgcttaaaacgacggacatggagaccgtttacgatttaggggcgaagatgatcgaggcattagggaaagagaaagtgcagagtggagatgtgatagctattgataaagcttcagggaaaataacgaagcttggaaggtcattttcaaggtcgagggattacgatgctatgggtccgcaaacaaagttcgtgcaatgtccagacggagagctgcagaaaagaaaagaagtcgtccattgtgttacgcttcatgagatcgatgtcattaacagcagaacacagggatttcttgctcttttcactggggataccggtgaaatccgtgctgaggtgagagaacaaattgacacgaaggtggcagagtggagggaggaagggaaggctgaaatcgtgcctggtgttctctttatcgatgaggtgcacatgcttgacatcgagtgcttttctttcctgaaccgtgctcttgagaatgagatggccccgatattagtagttgctacaaacagaggcataacttcaatccgtggcacaaattacaaatcccctcatggaattccaattgatcttcttgatagactactaatcatcactactcaaccttattccgaggatgaaattcgtaagattctagacatcaggtgccaagaggaagatgtagagatgtctgaagatgcaaaacaactgttgaccaaaattgggcacgagacctccttgagatatgctatccatttgatcacagcttctgcattgaattgccagaagcggaaggggatggttgtggaagtgcaggacatcactcgtgtttacagtctatttctggatgtaaggagatcaacgcagtacttgatggagtaccaaaaagaatacatgttcaatgaagcatctatcgttgatggtggggatgccgattccatgcacgattgatagctccttcaggtctggttgaagacttttcgttatcccatggcgttactgcaactattatttggcaaattcactgttacacagtgaatttgttttgtgatttgtatgcgatactgagtcttaatcccgtggatttacgttccaaaacaaacttgtgtgtggtcatcaaaaattgaagttctgatgaattttagaatgatgacaaagctacagattatccattggttcttcaaagattaatatcattgcctgtggtaaagaaagcttgcaggatatttatcatctaatccacgtgctctgaaagttaagcgtgtcaagttatgggttttcttgcacgtctcaaatacttgtattcatggcagacacaagccctaaatgaattgtatacaagcataataaaagaaaacatatgagcaatacaagcca

SEQ ID NO: 8859 - DNA, 1754 bp, Arachis hypogaea
gaattatccactaagctcagctaagctcagctcagcacttcacagaaaccctaaacccgcatttcaaattcctaaaaccctaacgccaccaccaccctgcgtccatggcggagctgaagttgtcggagtctcgggacttgacccgcatagagcgcataggcgctcactctcacattcgaggccttggtctcgactcttctctcgagcctcgcgccgtctccgagggcatggtcggccagacctcggcccgcaaggccgccggcgtcatcctccagatgatccgcgacggcaagatcgccggccgcgctgtccttctcgcaggccaacctggaaccgggaagaccgccatagccatggggatggccaagtccctcggcctcgagacaccgttcgccatgattgccggcagcgagctcttctccctcgagatgtcgaagaccgaggcgctgacacaggcgttccgtaaggccattggtgttcgcattaaggaggagactgaggtcatcgaaggtgaggtcgttgaggtccagattgaccgtcctgccgtcgccggcgccgcctctaagtccggcaaactcactctcaagacgacggagatggagaccgtttacgacttgggagcgaagatgatagaggcccttgggaaggagaaggtgaccagcggtgacgtcattgccattgacaaggcttctggaaagatcacgaagcttgggaggtcgttttcgaggtctagggatttcgacgccatggggcctcaggtgaagttcgtgcagtgtcctgatggggagttgcagaagcgcaaggaggtcgtgcattgtgttactcttcatgagattgatgttattaatagcagaacacagggatttctggctcttttcactggtgatacaggtgaaattcgtgctgaagtaagagaacaaattgacaccaaagtagcagagtggagagaggaaggaaaggcagagatcgtgcctggtgtccttttcattgatgaggtgcacatgcttgatattgaatgcttttccttcctaaatcgagctctggagaatgagatggctcctatattagttgttgctactaacagaggcataacaaatattagaggcaccaattacaaatcccctcatgggattcccattgatctgcttgatcgtctgcttatcatctctactcaaccttacacggaggaagagattcgcaaaattctggatatcagatgccaagaggaagatgtagaaatggctgaaggtgcgaagcagttgttaaccaaaattggggttgaaacatccttgagatatgccattcatctcatcatagcagctgcattggcatgccaaaagaggaaggggaaagtagtggagctggaggatataaaccgtgtttaccatctatttttggatgtcaaaagatcaacgcagtacttgatggagtatcagaatcagtacatgttcaacgaaacaggggaaggtgaagaagacgatgtccatgccacggtcttttaaaaaacttgaattctagtttggatggatttgtaattatgtgagcaagtctctaattattaggttgcagtagcaatattttttctttcttgttttaaaggacattgtgtttgtttgatattgggatttactagcagtttttcttggttgaactgaaatatcttcatcctccatatgatgctgctgtatctgtatgtaattttattacttggtgaaatgcttaatcatttgatctgaccaaaaaaaaaaaaaaaa

SEQ ID NO: 8860 - DNA, 1497 bp, Ambrosia trifida
ttataccaaaaaccctccttcaacctctctctgctgccccttttttcgtgccctaataagttgacagaagtcctcagctgataccatccaagataaccaaacatggtggagctaaaagtctcagagagcagagacctaactagaattgagcgaataggcgctcattctcacatccgtgggctgggtcttgactcagcattagaaccccgtgccagttctgaaggtatggttggtcagactaaagcccgtaaagcagctggagtcattgttcagatggtgaaggaaggtaaaatcgcaggtcgggcggttctcctcgctgggcagcctggaacaggcaagactgccattgccgtggggatggccaagtcaattggactagaaactccgttcgctatgctcgcaggcagcgagcttttttcgctggagatgtctaaaacggaagcacttatgcaagcttttaggaaggctattggtgtgaggattaaagaggagactgaagtgattgaaggggaggttgtggaaatccagattgaccgtccggcggtgactggagcggcgtctaaaacaggtaaattgactttgaagacgacggagatggagacggtgtacgatcttggggcgaagatgattgaagccttggggaaggataaggttcagagtggcgatgtgattgcaattgataaggcttcggggaagataactaaactcgggaggtcgttttcgaggtctagagattatgatgcaatggggccgcaaacaaagtttgtgcaatgtcctgatggcgagctgcagaagcggaaagaggtggtgcattgtgttacacttcatgaaattgatgtgatcaatagcagaacacaggggtttcttgctcttttcacgggcgacactggtgaaatacgagcggaggtcagagaacaaatagacacaaaggttgcagagtggcgagaggaagggaaagctgagatcgtgccaggtgtcctcttcattgatgaagtccacatgcttgacatcgagtgtttctcattcctaaaccgtgccttagaaaacgacatggcacccatactagttgtagccaccaaccgaggaatcacaaccattcgaggcacaaactacaaatcgccacatgggataccaattgatttcctggaccgcctgctcatcatctccacacaaccctacactgaagatgacatccgcaagattctagatatcaggtgtcaagaggaagacgtagatgtatctgaagacgcaaaggtattgctgaccaaaatcggagtggacacatccctaagatatgcgataaacctgattacatcagcctcattggcttgccaaaagaggaaagggaaggttgttgagatggaagacgtgagtcgcgtttatgagctgttttgggatgtgaagagatcaacacagtacttgattgagtatcagagccagtacatgtttaatgaagcgacaatgggggaggaagatgagggcaacttgatggtttca

SEQ ID NO: 8861 - DNA, 1910 bp, Glycine max
aggttacgtttatatatgtccaaccagtaacgtaacagtagcacaagcacactccaaagaccaaaccctaaaaaccctaagcaaactccgaaaccctctttctccctcgcaccgtcttcgttgtttctacaatggcggagctgaaactctctgagagccgcgatctgacccgcatagagcgcgtgggcgcgcactcccacatccgcggccttggcctggactcctccctggagccgcgcgccgtctcggacggcatggttgggcaaaccgccgcccgcaaggccgccggcgtgatcctccagatgataaaagacggcaaaatcgccggccgtgcagtcctcctggccggccagcccggcaccggcaagaccgccatcgccatgggcatggccaagtccctcggcctcgaaacccccttcgccatgatcgccgccagcgaaatcttctcccttgagatgtcgaaaaccgaagccctcacccaggccttccgcaaggccatcggcgtccgcatcaaggaagaaaccgaggtcatcgagggcgaagtcgtcgaggttcaaatcgaccgtcccgcggtggctggcgccgccgcgaagaccgggaagctgacgctgaagtcgaccgagatggagacggtttacgacctcggcgcgaagatgattgaagcgctggggaaggagaaggtgagcagcggcgatgttattgcgattgataaggcgtccgggaagattacgaagctcggacgatcgttttcgcggtcgagggactttgacgctatggggccgcaggtgaagttcgtgcagtgtcccgatggggagttgcagaagaggaaggaggtcgtgcattgcgttacgcttcatgagattgatgttattaatagcagaacacagggatttctggctcttttcacaggggatacgggtgaaattcgtgctgaggtcagagagcaaattgacaccaaagtggcagagtggagagaagaaggaaaggcagagattgtgcctggtgttcttttcattgatgaggtgcacatgcttgacatagagtgcttttctttccttaatcgggctctggagaatgagatggctcccatattagttgttgctaccaacagaggcatcacaactatcaggggaacaaattacaaatccccacatgggattcccattgatctgcttgaccgacttctcatcatctctacccaaccttacacagaggatgaaattcgcaagattctggatatcagatgccaagaggaagacgtagacatgagtgaaggtgcaaagtgtttgttaaccaaaataggtgtagaaacatctttgagatatgctattcatctaatcacagcagctgcattggcatgccaaaagcgaaaggggaagacagtggagttggatgatataaatcgggtttacaatctgtttttggatgtcaaaagatcaacacagtacctaatggagtaccaaagtcagtacatgttcaatgaaacaggagaagctgatgaagatgaaaccaatgccatggtctcttagatttacaaacatctgttagagagttcgtaatttcctggttagtctttctataagttgcagcaatttgttccatgatctggttggtcaatgcacttcaattgtgtttgatattgatccccaggactttcccgcggttgaactgtgcacgactgtgcaacttatatactatgaacatggcaagctgtacccaatttatgctattactgagcatttcctccctcgtttttttttgttgtatcatggatgcacaatcatcaatagagagtagctttaacagtaatttattagacgtggtttactataggcagtcatattattgagatgaaattctaattttgattgaaaagtaatatgcaaaatatttaaagaattgcatctaaa

SEQ ID NO: 8862 - DNA, 1521 bp, Cirsium arvense
gaaaactcttgcaaaaaagaactaataccaaccaaccatggtggagctaaaagtctcagagagcagagacctaacccggattgaacgaataggtgctcattcccacatccgtgggctgggtctggattcagctctagagccacgagctgtctctgaaggtatggtaggtcaaaccactgcccgtaaaggtgctggagtcatcgtgcagatggtgaaagaaggtaaaattgcaggtcgagctgttctacttgcaggccagcctggaacaggaaaaaccgccattgccatgggcatggctaaatccattggactagagaccccatttgcaatgctcgcaggtagcgaacttttctctctggaaatgtctaaaactgaagcccttatgcaagcttttaggaaggcaatcggtgttagaattaaagaagagactgaagtgatcgaaggggaagttgtggaaatccaaattgatcgtccagcggtggcgggggcggcatcaaaaactgggaaattgaccctgaaaacaacagagatggagactgtatatgatttgggggcgaagatgattgaggctttggggaaggataaagttcaaagtggcgatgtgattgcaattgataaggcttcggggaagattacgaaacttgggagatcgttttctaggtctagagattatgatgcaatgggaccacagacgaagtttgtgcagtgtcctgatggggagttgcagaaaaggaaagaggtggtgcattgcgttacacttcatgaaattgatgttatcaatagcagaacacaggggtttcttgcacttttcaccggtgacactggcgaaatacgagccgaggtgagggaacagattgatacaaaggttgcagagtggcgggaggaaggaaaggccgagatcgttccaggtgtccttttcattgacgaagttcacatgctcgatatcgagtgtttttcgttcctaaatcgtgctttagaaaacgacatggcaccaatattagttgtcgctaccaaccgaggaatcacaacgattcgtggcacaaactacaaatccccacatgggatcccaatcgatttcttggatcggctgctgatcatatctacacaaccgtactcggaagaagagatccggaagattctagatataaggtgcggagaggaagatgtggaagtatcggaagatgcaaaggttttgttgacgaaaattggggtggagacgtctttgagatacgcgataaatctgataacatcggcatcgttatcgtgccagaaaaggaaagggaaggtggtggagatggaagatgtgagtcgggtttatgagctgttttgggacgttaagagatcgacgcaatacttgatggagtatcagagccaatatatgttcagtgaagcagcaacaatggaagatgaagaagccaatatgatggtttgatttcttgtaattgtggaattataacttaaattttctaagtatttatttatggtctgaaattaaatgttaaaactaatccgatggtggct

SEQ ID NO: 8863 - DNA, 1672 bp, Fragaria vesca
ctctttgccgccaaaaaatctcaccaccgctcttcctccacccatggcggagctaaagctctcggagagccgagacctgacccgaatagagcgcataggcgctcactcccacatccgcggcctcggcctcgactccgccctcgaagctcgcgacgtctcggaaggcatggtgggccagaccgcagctcgtaaagccgccggcgtgattctccagatgatcaaagaaggaaagatcgccggccgggctgtcctcctcgccggacagcctggcaccggcaagacggccattgctatggggatggctaagtcgttagggctcgagacgccgtttgcgatgctcgccggaagcgagctgttctcgctggagatggggaagacggaggcgctgatgcaggcgtttcggaaggcgattggggtgaggatcaaggaggagacggagattattgagggggaggttgtggaggttcagattgaccggcctgcggtggccggagcggcgtcgaagactgggaagttgactttgaagacgacggagatggagacggtgtatgacttgggggccaagatgattgaggcgttggggaaggagaaggtgcagagtggggatgtggtggctattgataaggcgtcggggaagattacgaaggtggggaggtcgttttcgaggtccagggactatgatgcgatgggaccgagtgtgaagttggtgcagtgtcctgatggggagttgcagaagcgtaaggaggttgtgcattgcgtcacgcttcatgagattgatgtcatcaacagcagaacacaaggatttctggctctctttactggagatactggtgaaattcgttcagaagtgagagaacagattgacacaaaggtagcagagtggagggaggaagggaaggcagaaattgtgccgggtgttctgtttatcgatgaggtgcatatgcttgacattgaatgcttttcttttctgaatcgtgctctggagaatgagatggctccaattttagttgttgctacaaacagagggatcactacgatcagaggcacaaactataaatccccccatgggattccaattgatctccttgatcgcttacttattatcaccactcagccttacactgaggatgaaattcgcaagattctggacatcagatcccaagaagaagaagttgagatgtctgaagaggcaaagcatttgttgaccaagattggtgtagatgcatctttgagatatgccatccatctcataacagctgctgccttggcatgccaaaagcggaagggaaagattgttgagatggaggatattaaccgagtttaccatctgttcttggatgtgaaacgatcaacacaatacttgatggagtatcagagtcagtacatgttcaatgatgctgatgaagacgatgccaatgccatgcaaccttgagatattctttggactaggaagattttatggttatttgtgtatgtcgctttagtgattatatgcatcattgaactttgtttaggggaaatggtatcactctggttgtatgttatcctgttagggaattagttttgttactttgtagttttttcatgtgtagggatgaatcagtaaactttgtctactctttaatgaagcataactattttaactggttcgatctgatctttagtttcagtt

SEQ ID NO: 8864 - DNA, 1646 bp, Flaveria ramosissima
ttttctggtgaactaattccgactagtaactcatccgccaccgcagattagggttcaggcgactcctcactgcaaaaatccttcataaaggagaacagcgtaacacaggagctgctaccaaccaaagccaccaaacatggtggaactaaaagtctcagagagcagagacctaaccagaattgagcgaataggcgctcattctcacatccgcgggctgggtcttgactctgccttagaaccccgtgcagtctctgaaggtatggtaggccaaaccacagctcgtaaagcagctggagtcattgttcagatggtgaaagaaggtaaaatcgcaggtcgagctgttcttcttgcgggccagcccggaacaggcaagaccgccattgccatgggcatggccaagtcaattgggctagaaactccgttcgccatgcttgcaggcagtgagcttttttctcttgagatgtctaaaaccgaagcacttatgcaagcttttaggaaggctattggtgtaaggattaaagaggagactgaagtgattgaaggggaagttgtggagatccagattgaccgtcctgcagtgactggagcagcgtctaaaaacagggaagttgacgttgaagacgaccgagatggagacagtgtatgatcttggggctaagatgattgaagctttagggaaggataaagttcagagtggtgatgtgattgcaattgataaggcttcagggaaaataacgaagcttgggaggtcgttttcgaggtctagagattatgatgcaatgggcccgcaaacgaagttcgtgcagtgtcctgatggcgagctgcagaagaggaaagaggtggtgcattgtgttacacttcatgaaattgatgttatcaatagcagaacacaggggtttcttgctcttttcacgggcgacactggtgagatacgagccgaggtaagagaacaaatagatacaaaggttgcagagtggcgagaggaaggaaaggctgagatcatcccaggtgtccttttcattgatgaagtccacatgcttgacattgagtgtttttcatttctaaaccgtgcgttagaaaatgacatggcgcccatactagttgttgccaccaaccgaggaatcacaaccattcgaggcacaaactacaaatcaccacatgggataccaattgattttctggaccgcctgctcatcatctccacacaaccctacacggaagatgatatccgcaagattctagatataaggtgtcaagaggaggatgtggatgtatctgaagatgcaaaggttttgttgaccaaaatcggggtggacacatctctaagatatgctataaacctgattacatcagctgcattggcttgccaaaagaggaaagggaagtcgttgagatggaagacgtgagtcgtgtttatgagctgttttgggatgtgaagcggtcaacacagtacttgattgagtatcagagccagtacatgttcaatgaagcaacgatggcggaggaagatgagggcgctatgatggttgataaggtaggtagctgctgcttgtaatggttaaaatttcaagtacttatggtatgaattgtgaatgttttagaaagtagagtacctgtttctaatcatgtcaaatgtacactcattc

SEQ ID NO: 8865 - DNA, 1655 bp, Manihot esculenta
attccttgacaaccatcaccatggctgaactcaagctttctgaaagccgagacctgacccgaattgagcgcataggcgcccactcccacatccgaggacttggtcttgactccgcccttgaaccccgagcagtctcggagggcatggttggccagactgcagccagaaaggccgccggcgtcatcctacagatgataaaggatgggaaaattgccggtcgagccgtacttctggcgggccaaccgggtactggaaaaaccgcaattgcaatgggcatggcgaaatcgctcggcctcgagacgccatttgctatgatatctggcagcgaaatcttctcgctggagatgtctaaaacagaagccctaatgcaagcctttcgaaaagcaatcggtgtgagaattaaagaagaaaccgagttaatcgaaggcgaagtcgttgaagtccaaatcgataggccagctgtagctggtgcggcgtcgaagacagggaaattgacactaaaaacgactgaaatggagacggtttatgatttgggggcgaagatgatagaagcgttggggaaggaaaaagttcaaagtggggatgtaattgcaatcgataaggcgtccggaaaaattacaaagctcggtaggtcattttcacggtcgagggactacgatgctatggggccacaggtgaagtttgttcaatgccccgatggtgagctgcagaagaggaaagaggtggtgcattgtgtgacgcttcacgagattgatgtcatcaacagcagaacacaagggtttctggctctcttcactggtgatactggtgaaatccgtgcagaagtgagagaacaaattgacacaaaggtggcagaatggagggaggaaggcaaggcagatattgtgccaggtgttctcttcattgatgaggtgcacatgctggatattgaatgtttctctttcctgaatcgtgctcttgagaatgaaatggctccaatattagttgttgcaaccaacagagggatcactgcaattcgaggcacaaattacaaatctccacatgggattcccatagatctccttgatcggctactaattatcacaactcagccttatacaaaggacgaaattagcaagattgttgacattagatgccaagaagaagaagtggaaatatctgaagaggcaaaggctttattaacgcatattggagtggaaacgtctttgcgatatgctattaatctcattactgctgctgcattggcatgccataggcgcaagggaaaacttgtagagagtgaggacgtcactcgagtttacaatctgtttttagatgtgaagagatcaacacaatacttgatggagtatcagaaccagtacatgtttaatgaagtaccagtaggggatggtgatgaagatgatccgagtgccatgctttcatgagggtaactttagaagacactgtcattgtgcgtatcacctaattttttgatgatgcatcaagaacacgtagatcgtgtaccatgattttaggtttcataagaactgtgtcacctgttattagctgggggatctttttcatgtgcaagtgatgaaatctttattattattttttttcttatctgcttcaggaatcagatatttgtatgacattgacaagcttgcaattgtgcc

SEQ ID NO: 8866 - DNA, 1568 bp, Tabernaemontana elegans
aaccccctcttttctactcgtttcccctcttcactcccatccctccagccatggcggagctgaaaatctctgagatgcgagacctaccagaattgaacgcattggggcccactcccacatccgtggcctgggtctggactcggcgctcgagccccgctcgtttctgaggcatggtgggccagacgtctgctcgaaaagctgccggtgttattgtcagaatggtcaaggaaggaaaaatcgccggccgggcagttctccttgcgggtcagcctggctccgggaagacagccattgcaatgggaatggcaaaatcacttggccaagaaaccccttttgctatgctagcaggtagtgagcttttttctctcgagatgtcaaaaactgaggctctgatgcaagcctttaggaaagctattggggttaggattaaggaagagacggaggttattgaaggtgaggtggtggagattcaaattgaccggcctgctgtggctggagtggcatcaaagaccggaaggttgacgctaaagacgacggagatggagactgtgtatgacttgggagcgaagatgattgaatctttggggaaggagaaggtgcagagtggggatgttattgctattgataaagcttctgggaagattacaaagctagggagatcattttcgcggtctagggactatgatgctttgggtccgcagactaagtttgtgcagtgtccggatggggagctgcagaagcggaaagagattgtgcattgcgtgactcttcatgaaattgatgttatcaacagcagaacgctaggggtttttggctctctttactggtgatactggtgaaattcgtgctgaagttagggaacaaattgatacaaaggttgcagaatggagggaggaagggaaggctgagattgttcctggtgtccttttcattgatgaagtgcacatgctagacattgagtgcttttctttcttaaatcgtgctctggaaaatgatatggctcctatcttagttgtagcaaccaatagagggatcactactatcagaggaactaactacaaatctccccatggtattccaattgattttcttgatcgcttactcatcatctctacacagccatatacagaagaggaaattaggaaaatccttgacattaggtgccaagaggaagatgtagaaatgtctgaagatgccaaggttttgctgacaaagattggagttgatacatctttaagatacgccatacaccttattacagcttctgcattagcttgccaaaagcggaagggcaaggttgtggaaatggaagacatcagccgagtgtacgagctgttctatgacgtgaagagatcaactcagtacttgatggagtaccagagccagtatatgtttaatgaggtgccaactgcagaaggagatgaagatgatgccacggctatggtttcttaacaatttctcagcttgtatcacttgaaatcttataaaatcttgaaatgtaatttaaagtactaaactgatgcattaactaggtcttctgagaggggagcagtgtgctgttttgataa

SEQ ID NO: 8867 - DNA, 1506 bp, Helianthus annuus
tccgctaagattattaacaaacatggtggaactaaaagtctcagagagccgagacctaacccgaatcgagcgaataggcgctcattctcacatccgcgggctgggccttgactcagccttagaaccccgtgccagttctgaaggtatggttggtcagaccacagcccgtaaagcagctggcgttatcgttcagatggtgaaggaaggtaaaatcgcaggtcgagccgttcttctcgccggacagcccggaacaggcaagaccgccattgccatgggcatggctaagtcaatcggactcgaaactccgttcgccatgcttgcaggcagcgagcttttttcgctggagatgtctaaaacagaagcacttatgcaagcttttaggaaggctattggtgtaaggatcaaagaggagaccgaagtgatcgaaggggaagttgttgaaatccagatcgaccgtccagcggtgaccggagcggcatcgaaaaccgggaagttgactttgaagacgacggagatggagacggtgtatgatcttggggcgaagatgatcgaagcattggggaaggataaggttcagagtggcgatgtgattgcaatcgataaggcttcggggaagataacgaaactcgggaggtcgttttcgcggtctagagattatgatgcaatggggccgcaaacgaagttcgtacagtgtccggatggcgagctacagaagcggaaagaagtggtgcattgcgttacacttcatgaaatcgatgttatcaatagcagaacacaggggtttcttgctcttttcacgggcgacaccggtgaaatacgagcggaggtccgagaacaaatcgacacaaaggttgcggagtggcgagaggaaggaaaagccgagatcgtgccaggtgtcctcttcatcgacgaagtccacatgctcgacatcgagtgtttctcattcctaaaccgtgccttagaaaacgacatggcaccgatactagtcgtcgccaccaaccgaggaatcacaaccattcgcggcacaaactacaaatcgccacacgggataccaatcgatttcctggaccgactcctcatcatctccacacaaccctacaccgaagaagacattcgcaagattctagatatacggtgtcaagaggaagatgtggatgtatcagaagatgcaaaggttttgttgacgaaaatcggggtggacacatcgctaagatatgcgataaacttgattacgtcagccgcgttggcttgtcaaaagaggaaagggaaggttgttgagatggaagatgttagtcgcgcttacgagctgttttgggatgtgaagagatcgacgcagtacttgatcgagtatcaacgcgactacatgttcagtgaaggaacaatgggggaggaagatgagatggtttcataatggttaaatgttagtgattaaaaaacatatgattggtattatcagtctaaaacctttagcaatcaatgtattgtgcttgatcatccagaatgatg

SEQ ID NO: 8868 - DNA, 1598 bp, Flaveria ramosissima
ttgatgcttcatatttcatcgtcttaagattagggcttttttccggtgacctaattccgacaagtaactcatccgccaccgcagattagggttcaggcgactctcgtcactgcaaaaatctttcataaaggagaacagcacaacacaggagcttctaccaaccaaagccaccaaacatggtggaactaaaagtctcagagagcagagacctaaccagaatagagcgaataggcgctcattctcacatccgcgggctgggtcttgactctgccttagaaccccgtgcagtctctgaaggtatggtaggccaaaccacagcccgtaaagcagctggagtcattgttcagatggtgaaagaaggtaaaatcgcaggtcgagctgttcttcttgcgggccagcccggaacaggcaagaccgccattgccatgggcatggctaagtcaattgggctagaaactccgttcgccatgcttgcaggcagtgagcttttttctcttgagatgtctaaaaccgaagcacttatgcaagcttttaggaaggcaattggtgtaaggattaaagaggagactgaagtgattgaaggggaagttgtggagatacagattgaccgtcctgcagtgactggagcagcgtctaaaacagggaagttgacattaaagacgaccgagatggagacagtgtatgatcttggggctaagatgatcgaagctttggggaaggataaagttcagagtggcgatgtgattgcaattgataaggcttcagggaaaataacgaagcttgggaggtcgttttcaaggtctagagattatgatgcaatgggccacaaacgaagttcgtgcagtgtcctgatggcgagctgcagaagaggaaagaggtggtgcattgtgttacacttcatgaaattgatgttatcaatagcagaacacaagggtttcttgctcttttcacgggcgacactggtgaaattcgagctgaggtcagagaacaaatagatacaaaggtcgcagagtggcgagaagaaggaaaggctgagatcatcccaggtgtactcttcattgatgaagtccacatgcttgacatcgagtgtttttcatttctaaaccgtgccttagagaacgatatggcacccatactagttgttgccaccaaccgaggaaccacaaccattagaggcacaaactacaaatcaccacatgggataccaattgatttcctggaccgcctgctcatcatctccacacaaccctacaccgaagatgacattcgcaagattctagatataaggtgtcaagaggaggatgtggatgtatctgaagatgcaaaggttttgttgaccaaaatcggggtggacacatctctaagatatgctataaacctgattacatcggctgcattggcttgccaaaagaggaaagggaaggtcgttgagatggaagacgtgagtcgtgttatgagctgtttgggatgtgaagaggtcaacacagtacttgattgagtatcagagccagtacatgttcaatgaagcaacaatggcggaagaagatgagggcgctatgatggttgataaggtaggtagctgctgcttgtaatggtta

SEQ ID NO: 8869 - DNA, 1632 bp, Aquilegia formosa
ggtttcgtcttctttcaaattcaaattccaaagttttctctgaatcaattgagaaaaagagtttttaattttgcttcaaagaaatcgaagatggcagagataaaactctcagaatcgcgagatttaactcgtatagaacgtataggagctcattcacacattcgtggactcggtcttgactcagctttagaagctagagttgtatcagaaggtatggttggacaaactaaagctcgaaaagcagcaggaatcattcttcaaatgattaaacaaggtaaaatagcaggtcgagcaattctattagcaggtcaacctggaacaggaaaaacagctattgcaatgggtatggctaaatctttaggagaagaaaccccttttgctatgatggctggtagtgaattgttttcacttgaaatgtcaaaaactgaagctttaaaacaagcttttaggaaagctattggtgttagaattaaagaagaaacagaaattattgaaggtgaagttgttgagattcaaattgatcgtcctgcggttactggggtggcgtcgaaaacagggaaattgacgttgaagtcgactgatatggaaactgtttatgatttgggtgctaagatgattgaagcattggggaaacagaagattcaaagtggggatgtcattgcgattgataaggcttcaggaaagattactaagcttgggaggtcgtttgctaggtctagagattatgatgctatgggacctcagactaagtttgtgcaatgtcctgagggggagttgcagaagagaaaggagattgtgcattgcgttacgcttcatgaaattgatgtcataaacagcaggacacagggttttcttgccctttttaccggggatactggtgagattcgtgcagaagtgagggaacagattgacacaaaggtggccgagtggagggaggaagggaaagcagagatagtgccaggtgtcttgttcattgatgaggtgcacatgcttgacattgagtgtttctcattcctgaatcgtgccttagagaatgatatggcaccgattttagttgtggctactaacagaggcatcacaacaattcgtggtactaactacaagtccccacatggtataccaattgaccttttagaccgtctcctcatcatctcaactgaaccatacacaaaggaggaaatccgtaagattcttgatatccggtcccaggaggaagatgttgagatgtctgaggatgcaaaagttttattgacaagaattggggttgaagcttcactaaggtatgcaatccacctcatcacagcagctgcattggcttgccagaagcggaagggaaagattgtagaaattgaagatatcagtcgtgtataccagttgttcctggatgtaaaaagatcgtcccagtatttaacggagtatcagagccaatatatgttcagtgagacgccattaaaagaaggagacgatgaggaagaaactactgctatgcattcttgagttcaatggcttgaaactgaggaaagctttcttgatcaaagctttcggcagaatcgttgtatgcacatactgttgtggagttatagtattgccacaagtttatgtattttaagtccatgtcacctgcccgtagga

SEQ ID NO: 8870 - DNA, 1648 bp, Gossypium raimondii
gcagtctctcacaaaaccctaaaccctgcctttcccttcctcaatcatccaatgacggagctgaaactctccgagagccgagacctgacccgaatcgaacgcattggggctcattcccacatacggggcctaggcctcgactcctctctggagccccgtgacgtctcggaaggaatggtgggccaagcacaagctcgtaaagccgccggtgtcatcctccaaatgatcaaagacggtaaaattgctggccgtgctatcttattagcgggacaacctggaactggcaaaactgccattgccatgggcatggcgaaatctcttggccttgaaacccctttctcgatgctctctggcagcgaaatcttctcccttgagatgtcgaaaaccgaagctttaatgcaagcgtttcgaaagtccatcggagtaagaatcaaagaagaaactgaaataatcgaaggcgaagtcgttgaaatccagattgaccggccggcagtttctggggcggcttcaaaaactgggaaattaacgcttaaaacgacggatatggagaccgtttacgatttgggggcgaagatgatcgaggcattagggaaagagaaagtgcagagtggagatgtgatagctattgataaagcttcaggaaaaataacgaagcttggaaggtcattttcaaggtcgagggattacgatgctatgggtccgcaaacaaagttcgtgcaatgtccagacggagagttgcagaaaagaaaagaagtcgtccattctgttacgcttcatgagatcgatgttattaacagcagaacccagggatttctagctcttttcactggggatactggtgaaatccgtgctgaggtgagagaacaaattgacacgaaggtggcagagtggagggaggaagggaaggctgaaatcgtgcctggtgttctctttatcgatgaggttcacatgcttgatatcgagtgcttttctttcctgaaccgtgctcttgagaatgagatggccccgatattagtcgttgctacaaatagaggaataacttcaatccgtggcacaaattacaaatcccctcatggaattccaattgatcttcttgatagactactaatcatcactactcagccttattctgaggatgaaattcgtaagattctagacatcaggtgccaagaggaagatgtagagatgtctgaagatgcaaaacaactgttgaccaaaattgggcacgagacctccttgagatatgctatccatctgatcacggcttctgcattgaattgccggaagcgaaaggggatggttgtggaagtgcaggacatcactcgtgtttacagtctatttctggatgtaaggagatcaacgcagtacttgatggagtaccaaaaagaatacatgttcaatgaagcatcaattgttgatggtggggatgctgatgccatgcatgattgatagttccttgacttatggttatcccatggcgctactgcaactattatttggtagtttcacagtgaatttttatgctataccgggtcttaatcccgtggtagtatctgtaaatgaaagtgttggatttacgtccggatgaatttttgaattataacaaaactgaacttccgttttcaattgtccttcaaagattaatacc

SEQ ID NO: 8871 - DNA, 1858 bp, Gossypium raimondii
ctcaaaactctgcagtctctcacaaaaccctaaaccctgcctttcccttcctcaatcatccaatgacggagctgaaactctccgagagccgagacctgacccgaatcgaacgcattggggctcattcccacatacggggcctaggcctcgactcctctctggagccccgtgacgtctcggaaggaatggtgggccaagcacaagctcgtaaagccgccggtgtcatcctccaaatgatcaaagacggtaaaattgctggccgtgctatcttattagcgggacaacctggaactggcaaaactgccattgccatgggcatggccaaatctcttggccttgaaacccctttctctatgctctctggcagcgaaatcttctcccttgagatgtcgaaaaccgaagctttaatgcaagcgtttcgaaagtccatcggagtaagaatcaaggaagaaactgaaataatcgaaggcgaagtcgttgaaatccagattgaccggccggcagtttctggggcggcttcaaaaactgggaaattaacgcttaaaacgacggatatggagaccgtttacgatttgggggcgaagatgatcgaggcattagggaaagagaaagtgcagagtggagatgtgatagctattgataaagcttcaggaaaaataacgaagcttggaaggtcattttcaaggtcgagggattacgatgctatgggtccgcaaacaaagttcgtgcaatgtccagacggagagttgcagaaaagaaaagaagttgtccattctgttacgcttcatgagatcgatgttattaacagcagaacacagggatttctagctcttttcactggggatactggtgaaatccgtgctgaggtgagagaacaaattgacacgaaggtggcagagtggagggaggaagggaaggctgaaatcgtgcctggtgttctctttatcgatgaggtgcacatgcttgatatcgagtgcttttctttcctgaaccgtgctcttgagaatgagatggccccgatattagtcgttgctacaaatagaggaataacttcaatccgtggcacaaattacaaatcccctcatggaattccaattgatcttcttgatagactactaatcatcactactcagccttattctgaggatgaaattcgtaagattctagacatcaggtgccaagaggaagatgtagagatgtctgaagatgcaaaacaactgttgaccaaaattgggcacgagacctccttgagatatgctatccatctgatcacggcttctgcattgaattgccggaagcgaaaggggatggttgtggaagtgcaggacatcactcgtgtttacagtctatttctggatgtaaggagatcaacgcagtacttgatggagtaccaaaaagaatacatgttcaatgaagcatcaattgttgatggtggggatgctgatgccatgcatgattgatagttccttgacttatggttatcccatggcgctactgcaactattatttggtagtttcacagtgaatttttatgctataccgggtcttaatcccgtggtagtatctgtaaatgaaagtgttggatttacgtccggatgaatttttgaattataacaaaactgaacttccgttttcaattgtccttcaaagattaataccattgcctgtggtcaggatcaggatgctctgaaagttaagcatgtcaagttatgggttttctaccacgtctcagatacttgtcacactgttctttgctgtgactatatcttgtatgcatggcagacacaggccctaaacgaattgcatagaagcataataacaggaaacatatgagcaattcaagcactatttggcaaac

SEQ ID NO: 8872 - DNA, 1876 bp, Lotus japonicus
aaaatccagcagacacagcacactccacccaaactctcaaaaccctaacaattaacaaaaaccctttctccgtatccctcttccgccgcgaccatggcggagctcaagctctcggagagccgcgacctcacacgcatagagcgcgtcggcgcccactcccacatccgcggcctcggccttgactcctccctcgagccacgcgacgtctccgaaggcatggtcggccaggtctccgcccgcaaagccgccggcgtcatcctccagatgattaaggacggcaaaatcgccggtcgcgccgtcctcctcgccggccagcctggaaccggcaagaccgccatcgccatgggtatggccaagtccctcggcctcgaaacccccttcgccatgatcgccggcagcgagctcttctcgcttgagatgtcgaagactgaggctctcacacaggccttccgtaaggccattggtgttcgcatcaaggaggagaccgaggtcatcgagggtgaggttgtggaagtcaacattgaccgtccttcagtctccggagctgccgcgaagaccgggaagctgacgctgaagacgacggagatggagacggtgtatgatctcggcgctaagatgattgaggcgcttgggaaggagaaggtgactggtggtgatgttattgccattgacaaggcttcagggaagattacaaagctgggaaggtcgttctctcggtcgagggatttcgacgcgatggggccgcaggtgaagtttgtgcagtgccctgatggagagttgcagaagaggaaggaggtcgtgcattgcgtcactcttcatgagattgatgttatcaatagcagaacacagggatttctggctcttttcactggtgataccggtgaaattcgcgcagaagtcagagagcaaatcgataccaaagtggcagagtggagagaagaaggaaaagcagagattgtgccaggtgttcttttcattgatgaggtgcacatgcttgacatagaatgcttttcattcctcaatcgagctctagagaatgagatgtctcccatattagttgttgctaccaacagaggcatcaccactattcgaggcacaaattacaaatccccacacgggattcccattgatttacttgaccgactcctcatcatctccactcaaccttatactgaggatgatattcgcaagattctggatatcagatgccaagaggaagatgtagatttgactgaaggtgcaaagcggttgttaaccaaaataggtgtagaaacatccttgagatatgctattcatctaatcacagctgctgcattggcatgcctaaagcgaaaggggaagacagtagagttggaagatataaaccgggtttacaatctgttcttggatgtcaaaagatcgacacagtacttgatggaatatcaaagtcagtacatgttcagtgaaacaggagaagttgatgaagatgatgcaaatgttaatgctaatgctatggtctcctaaaattagcgaatttcagcttgagagtttgtaattatctgctcagtcggcaatttattgcatgaggcctgtgcacttgacttgagtttgatatcaatcatcagctgttttctgtggtttaactgcaatatctattttatgcatgtgagaggctgtaatgtatttgtgttactactgaacttttccctgactcggttctcttttgttattttttattttgctgtgtcatgcgtgcttatcaagcccaattcattgtaatttttaggtacgcgcggactcttcactccatatgccccattattttttacatgttttagcacgtttgaatcaacatctgatttcttataatcaattataaaatacaaaagctattcac

SEQ ID NO: 8873 - DNA, 1512 bp, Centaurea maculosa
ggctgaggaggacgacactcgatcaattcggccatctgtgatttctgaaaactcttgcaaaaaaagaaccaataccgaccaactatggtggaggtaaaagtctcggagagcagagacctaacccgaattgaacggataggcgcgcactcccacatccgtgggctgggtctcgactcagccctagagcctcgtgaggtctctgaaggtatggtcgggcaaaccaccgcccgtaaaggcgcaggagtcatcgtgcagatggtcaaagaaggtaaaattgcaggtcgagccgttcttctcgccggccagcctggaaccggaaaaaccgccatcgccatgggaatggccaaatccattggactggagaccccgttcgccatgatggcaggtagcgagcttttctctctcgagatgtccaaaacggaagcccttatgcaagcttttaggaaggcgattggtgttaggattaaagaggagaccgaagtgatcgaaggggaggttgtggaaatccaaatcgatcgtcccgcggtggccggagcggcgtcgaaaacggggaagttgaccctgaagacgacggagatggagacggtttacgatcttggggcgaagatgatcgaggctttggggaaggataaagtgcaaagcggcgatgtgattgcaatcgataaggcttcggggaagatcacgaaactcgggaggtcgttttcgaggtctagagattacgatgcaatgggaccgcaaacgaagttcgtgcagtgtcccgatggggagttgcagaagcggaaagaggtggtgcattgcgttacgcttcatgaaatcgatgtcatcaatagcagaacgcagggtttccttgcccttttcacgggcgacactggcgaaatacgagcggaggtgagggaacagatcgacacgaaggttgccgagtggcgggaggaaggaaaggcggagatcatcccgggtgttttgttcatcgacgaagtccacatgctcgacatcgagtgtttctcgttcctcaaccgcgccttggaaaacgacatggccccgatactggtcgtcgccaccaaccgcggaatcacaacgatccggggcacaaactacaaatccccacacgggatcccgatcgatttcctcgatcgcctgctcatcatatccacacagccttactcggaagaagagatccggaagattctcgacataaggtgcggagaggaagacgtagacgtttcggaagatgcgaaagtgttgttgacgaaaatcggggtggagacgtctctgagatacgcgataaacctgataacatcggcttcattggcgtgccagaaacggaaagggaaggtggtggagatggaagacgtgagtcgggtttacgagctgtttggggacgtgaagagatcgacgcagtacttgatggagtatcagagccaatatatgttcagtgaaggtgcaacaatggaggatgatgaaaccaacatgatggtttgagtcccattgtaattgtggtattatgactttaaa

SEQ ID NO: 8874 - DNA, 2021 bp, Chenopodium quinoa
cttcaactcttccttcccatttcctcctcccctatttcgctaaaccccccaaaacccttcttctctctccctctccaagccgctgcaaacccttaacaatggcggaactcaaactctcagaaagcaaagaccttacaagaatcgaacgcattggagcccactcccacatccgaggcttaggcctagactctaccctcgaaccccgcctcacttccgaaggtctagtcggccaactcccggcccgcaaagccgccggcgtcatcctccaaatgatcaaagacggcaaaatcgccggccgcggagtcctcatcgccggccaacccggcaccggaaagaccgcaattgcaatgggtctcgcaaaatcactcggccacgaaaccccatttgctatgctatctgggtctgaaatcttctcgctcgagatgtcgaagacggaagcgctgatgcaagcgttccgccgtgctattggggtgagaatcaaggaagaggctgaggtgattgagggtgaggttgttgagattcaggtggaccgccctgcggttgctggggcggcatcgaagacggggaaattgacgttgaagacgacggatatggagacggtttatgatttggggactaagatgattgaggcgcttagtaaggagaaggttcaaagtggggatgtgattgctattgataaagcttctgggaagatcactaagcttgggagatcgttttcgaggtcgagggattacgatgctatggggccgcatactaagtttgtgcagtgccctgatggggagttgcagaagaggaaggaggttgtgcattgtgttactcttcatgagattgatgttattaacagcagaacccagggattcctagcactcttcactggagatactggtgaaattcgtgctgaagtaagggaacaaatcgacacgaaggtagctgagtggagggaagaagggaaggctgagattgtcccaggggttctgttcattgatgaggtacacatgttggatgttgagtgcttctctttcttaaatcgtgctttggagaacgagatggcaccaatattagtagttgcaaccaacagagggcatacaaggatcagagggaccaattacagatctccacacggcatgcccattgatttgcttgatcggttgcttataattgctactcaaccctacacagaggaggagattcgcaagatcttggagatcagatgtcaagaagaggatgtagaaatgactgaagaggcaaaagttcttttgacaaagattgcaatggaaacatcactccggtatgctatcaacctgataaattcctctgcgttggcttgtcaaagacggaaggcaaagtcagtggagatggaggatgtgagcagggtttatcagctatttctggatgtgaagaggtcaacacagtacttaatggagtatcaaaaccaatacatgttcaatgcagtacctggagtagaggtgaatgaagatgagaatgctgacatgatcgcttgatataaatatgtattgtattaactgtaagctcttgaaatgaaagtttggtgctcatcaccgttctgggtaattttggattatgatcatcctaactagtgtgcatttttttttttttccttttttccttttcctttcttttttttcttgtctttgaagcaatatttctgagttgctgcagtcagaggtagaagccagtagttaaatgcttaaattacattaatggtgcaacggaacctaatttcaagcagtagatggcgatcgaaccgtattacatcagcatcattgttatctaatgagctgcagctaccgccgtcggtccttcactgaccaccaccccttctccctcccctgcctcgaaccactaatttacgacacacaacaaacacgacacgcacatcgccttacggacaaaacgaggaacggcgtactaataattataagtagcgtagggaccagctagacgtataccgtacacgaaggtcgtagaatactagtatagtctacagtacagtagtacgg

SEQ ID NO: 8875 - DNA, 1764 bp, Abies balsamea
tcggacactctaaaaatcagtttcacaaacgatgtcccgtggaaaagaagtattagcggattcgtcacagttccctgaagtttgctcatcttcatctccactctattcgagcctactaccaaaaattttgcaaccgtatcgaggtttctgtccatttcaacacggagcagcaacgtatgaaagcttgacagctttctcgagggttttggtttacattttaatccttgacccggcctctgtatagtttgcgtttattatcgaactttttgaaaattaataggtttcagaaagagccatggcggagctaaagctgtcggagacgagggatttgacgcgcatagaacgaataggtgcccattcgcacatcagaggcctaggcttggatgatgccctagaagcccgcaaggtttcacagggtatggtagggcagacatctgctagaaaagccgcaggggttattttggaaatgattaaggaaggaaaaatagcaggccgcgcagttttgctggccgggcagccggggacaggtaagaccgccatagccatgggcatggctaaatccctgggcgaagaaaccccctttgcaatgatggcaggcagtgaaattttttcgttagacatgagcaagacggaggctttgacacaggcgttcaggaaggcaataggggttagaattaaagaagagactgaaattattgaaggcgaagttgtcgagatacagatagatcggcccgccacgtcgggcgccgcggcaaagactgggaaattgacattgaagaccacggagatggagactgtgtatgatttggggagcaagatgatcgaggggttgagcaaggagaaggtccagagtggggatgtgattgcgatcgataaagcttctggtaagattacgaagttggggcggtcttttgcaaggtccagggattatgatgcgatggggccacagaccaagtttgtgcaatgtccggatggagaactgcagaagcgcaaagaggtggtacattgtgttactctgcatgaaattgatgtcatcaacagcaggacacaagggtttcttgccctctttacaggagatactggagaaatccgttctgaagtaagggaacagattgacagtaaagttgctgaatggagggaagaaggcaaagctgaaattgtaccaggtgtgctttttattgatgaagttcacatgcttgacattgaatgtttctcattcctgaatcgtgctcttgagaatgagatggcaccaatattggttgttgcaactaatcgtggtatcacaaaaatccgtgggacaaattacaagtccccacatggtatacccattgatctcttggaccgcctgctcatcatttcaacacagccatatacagaagatgagttgcatcagattcttgatataagatgtgaagaagaagacgttgaaatgtcagaggatgccaaggaacttctaacaaagataggtgctgagacatcattacgctatgccattcaattaatcacagcagctgcactagcttgccagaaacgaaagggtaaacttgttgaactcgaggatgttagcagggtttaccaattatttgtggatattaagaggtcaacacaattccttatggaatatcaggagcaattcatgtttaatgaagtccctggcgatattgaagaagacacaatggctgaatgattgttttccttattctacatttttcaaaaaggagtataattctgtattggggacaagcagcataaatattagagaaa

SEQ ID NO: 8876 - DNA, 2224 bp, Pinus pinaster
taaaaagaaacggccaaaattctttcttcgtatactcgtttatagagaatagatatcgataccctaaaccccgaaacgacatgaacatcataactctgttcaaaagaaacgggcagaaaatccaaaaccctattatagccattcaaattcctcattaactagtccggcagcccgttttgaaccaggaaaaatctgaaaaccctaaattcaccattactgacgacccgtgaaaaaaaaacattcatggatttgccttagacgctaaagttttctatccgaatctcaccatcatttcaaacgtatgaggttttctgtccatttcatccctgcgtagcatctaatgaaagtttggcagtttcctcgagggtttcggccaacattttaacccgcgacatcgagttctttatagtttgtctttttagttcagccttttgaaacttaacaggtttcaaacggtgattatcggaaagagccatggcggagctaaagctatcggagaccagggatttaacgcgcatagagcgaataggcgcccactcacacatcagaggcttaggcttggatgatgcattagaagcccgaaaggtttcacagggtatggtaggacagacatccgctagaaaagctgcaggggtgattctggaaatgattaaggaaggaaaaatagcaggccgcgcagttttgttggccgggcagccgggaacaggaaaaactgccatagccatgggtatggctaaatccctaggcgaagaaaccccctttgcaatgatggcaggcagtgaaattttttcattagacatgagcaagaccgaggctttgacacaggctttcaggaaggcaataggggttagaattaaggaagagactgaaatcatcgaaggcgaagttgttgagatacagatagatcggcccgctacttcgggcgctgcggcaaagactgggaaattgacattgaagacgacagagatggagactgtgtatgatttggggagcaagatgatcgaaggtttgagcaaggagaaggtccagagtggggatgtgattgcgatcgataaagcttctgggaagattacaaagttggggcggtcttttgcgaggtccagggattatgatgcaatggggccgcagaccaagttcgtacagtgcccggatggagagctgcagaaacgcaaagaagtggtgcattgcgttacgctgcatgagatcgatgtcatcaatagcaggacgcaagggtttctggccctctttacaggagatactggagagatccgttctgaagtgagggaacagattgacagtaaagttgctgaatggagggaagaaggcaaagctgaaattgtaccaggtgtgctttttattgacgaagtccatatgcttgacattgaatgcttctcatttttgaatcgtgctctagagaatgagatggcaccgatattggttgttgcaacaaatcgtggcattacaaaaatccgtggaacaaattacaagtccccacatggtatacccattgatctattagaccgcctgctcattatttcgacacagccatacatggaagatgagatgcgtcaaattcttgatataagatgtgaagaagaagatgttgaaatgtcggatgatgcaaaggaactgctaacaaagatagcagttgagacatcattgcgctatgccattcacttaatcacagcagctgcactagcctgccagaagagaaaggggaaatttgttgagcttgaggatgttagcagggtttaccaattatttgtggatattaagaggtcaactcaattccttatggaatatcaggagcaattcatgtttaatgaggtccctggtgagattgaagaagacaatatggttgtataattgtttttgcagaacttctatatttcccaacaaagactataattctgtatttgggactcacagcagaaacatcagctaaataacggagagtacaagatctggtgttttactgatactacttgcaatattttagctaggtattgcatttttttggtactggatagtgcttcagttggtttgcttgaccaaatttttgcacataaatctatattgcagtaaatgccacttcaggtgctgtaaatgcctggtatggccttgaaatacatttctggctgtttgaatgcatcccacgtgtggtaaacacatttatgagctgtatgaatgcatcccacatgagggaacacgtttctgagctgta

SEQ ID NO: 8877 - DNA, 1777 bp, Quercus alba
ctactctctctctctctctctctttctccttcacaagccaacaatggtggaggtaaagctatcagagagccgagacctaacccggatagagcgcataggcgcacactcccacatcaggggcttaggtctagactcttccctcgaaccccgcgaagtctccgaaggcatggtgggccagacctctgcccgaaaagccgccggcgtcatcctccagatgatcagagatggcaaaatcgccggccgcgccgtcctcttagcgggtcagcccggcacaggcaagaccgccatagctatgggcatggccaagtccttaggcctcgaaaccccattcgctatgctcgccggcagcgagctcttctctctggaaatgtccaaaaccgaagccctaatgcaagcctttcgcaaggccattggcgtgcgcatcaaggaagaggccgaggtgatcgaaggcgaggttgttgagatccaaattgaccgccctgcagttgctggggccgcctctaagaccgggaagctcacgcttaagactacggaaatggagactgtttatgacttgggtgctaagatgattgaggctcttgccaaggagaaggtgcagagtggcgatgtcatcgccattgataaggcttcggggaagataacaaagcttgggaggtccttttcgcggtccagggagtacgacgccatgggacctcagacaaagttcgtgcagtgtcctgatggggagcttcagaagaggaaggagctcgtgcattctgttactcttcacgaaatcgatgtcatcaacagcaggacacaaggatttctagctctcttcactggtgatactggtgaaatccgtgcagaagtgagggaacaaattgacacaaaggtggcagagtggagggaggaaggaaaggcagagatagtgcctggtgtcctcttcattgatgaggtgcacatgcttgatattgaatgcttttctttcctgaatcgtgctttggagaatgagatggctccaatattggttgtcgctaccaacagagggatcactacaatccgaggcacaaattataaatctccacatgggattccaattgatctccttgatcgccttctcattatcacaactaaaccttacacagaggatgaaatccgcaagattttggacatcagatgccaagaggaagatgtggagatgtctgaagaagcgaagcgattgttgactaaaattggtgtagaaacatcgttgagatatgccatccatctcatcacagctgctgcattgtcttgccagaagcgaaagggaaggattgtggagatggaggacattaaccgagtttatcatctgtttttggatgtgaagagatcaacacaatatttgatggagtttcaaaaccagtacattaatgaaactgcagatggtgacgaagaagatgccaatgccatggagtcttgagagttggtttggaagtatgtgattatacatgtgcctttatttattatttgccaaagcctgctattgactaagggtaactctgcttgatgtgtttttcatgcacctagttgggattaacagtagtctgttagttttcacttttcactgtgcaagtgcatactgtatgtttgtaggactgaccattgcaattgtttgttagatagttcttgtgtctggaaaaatattatgcatttttcaagctatcaggcacttttggtttacagtttgctaacggaaatgaggcatgcacttaatgcgtaatctctgaaatttagaatatagtgtggatggtattttgtc

SEQ ID NO: 8878 - DNA, 2049 bp, Pinus taeda
accatctgtgaaaaaaatattcatggatttgccttagacgctaaagttttccacccgaatctcaccataatttcaaacgtgtgaggttttctgtccatttcagccctgctcagcatctaatgaaagtttggcagtttcctcgagggtttcggccaacattttaacccgcgacatcgagttctttatagtttgtctttttagttcagccttttgaaacttaacaggtttcaaacggtgattatcggaaagagccatggcggagctaaagctatcggagaccagggatttaacgcgcatagagcgaataggcgcccactcacacatcagaggcttaggcttggatgatgcattagaagcgcgaaaggtttcacagggtatggtaggacagacatcagctagaaaagctgcgggggtgattctggaaatgattaaggaaggaaaaatagcaggccgcgcagttttgttggccgggcagccgggaacaggtaaaactgccatagccatgggtatggctaaatccctaggcgaagaaaccccctttgcaatgatggcaggcagtgaaattttttcattagacatgagcaagaccgaggctttgacacaggctttcaggaaggcaataggggttagaattaaggaagagactgaaattatcgaaggcgaagttgttgagatacagatagatcggcccgccacttcgggcgctgcggcaaaaactgggaaattgacattgaagacgacagagatggagactgtatatgatttggggagcaagatgattgaaggtttgagcaaggagaaggtccagagtggggatgtgattgcgatcgataaagcttctgggaagattacaaagttggggcggtcttttgcgaggtccagggattatgatgcaatggggccgcagaccaagttcgtacagtgcccggatggagagctgcagaaacgcaaagaagtggtgcattgcgttacgctgcatgagatcgatgtcatcaatagcaggacgcaagggtttctggccctctttacaggagatactggagagattcgttctgaagtgagggaacagattgacagtaaagttgctgaatggagggaagaaggcaaagctgaaattgtaccaggtgtgctttttattgacgaagttcatatgcttgacatagaatgcttctcatttttgaatcgtgctctagagaatgagatggcacccatattggttgtcgcaacaaatcgtggcatcacaaaaatccgtggaacaaattacaagtctccacatggtatacccattgatctattagaccgcctgctcattatttcgacacagccatacatggaagatgagatgcgtcaaattcttgatataagatgtgaagaagaagatgttgaaatgtcggatgatgcaaaggagcttctaacaaagatagcagttgagacatcattgcgctatgccattcacttaatcacagcagctgcactagcttgccagaagagaaaggggaaatttgttgagcttgaggatgttagcagggtttaccaattatttgtggatattaagaggtcaactcaattccttatggaatatcaggagcaattcatgtttaatgaggtccccggtgagattgaagaagacaatatggctgtataattgtttttgcagaacttttatatttcccaacaaagactataattctgtatttgggactcacagcagaaatatcagttaaacaaaggagagtacaagatctggtgttttactgatactacttgcaatattttagctaggtattgcatttttttttggtactggatagtgcttcagttagtttgctttgccatatttttgcacataaatctatattgcagtaaatgccacttcaggtgctgtaaatgcctggtatggccttgaaatacatttctggctgtttgaatgcatcccacttgtgggaaacacatttatgagctgtatgaatgcatcccacatgagggaaaaacgtttctgagctgtattggtattcgtatgatgcatttctaacactgaatctccctatt

SEQ ID NO: 8879 - DNA, 2093 bp, Pseudotsuga menziesii
caacgtatgaaagtttggcagtttcctctaaggttttggcctacattttaaccctcgacaccggcgtttgcatagtttccgtattttatcaagcctttcgaaacttaacaggttacgaacggtgattttttccagaaagagccatggtggagctaaagctatcggagaccagggatttaacgcgcatagaacgaataggcgcgcattcgcacatcagaggcctagggctggatgatgcattggaagcccgcaaggtttcgcagggtatggtagggcagacatccgctagaaaagctgcaggggttattttggaaatgattaaggaaggaaaaatagcaggccgcgcggttttgctggctgggcagccggggacaggtaagactgctatagccatgggaatggctaaatccctaggtgaagaaaccccctttgcaatgatggcaggcagtgaaattttttcattagacatgagcaagaccgaggctttgacacaagcattcaggaaggcaataggagttagaataaaggaagagactgaaactattgaaggcgaagttgtcgagatacagatagaccggcccgccacgtcgggcgccgcggcaaagactgggaaattgacattgaagacgacagagatggagactgtgtatgatttagggagcaagatgatcgaggggttgagcaaagagaaggtgcagagtggggatgtgattgcgatcgataaagcttctgggaagattacgaagttggggcggtcttttgcgaggtccagggattatgatgcgatggggcctcagaccaagttcgttcagtgtccggacggagagctgcagaagcgcaaggaggtggtgcattgcgttacgctgcatgagattgatgttatcaatagcaggacccaagggtttctggccctctttacaggagataccggagagatccgttctgaagtcagggaacagattgacagtaaagtcgctgaatggagagaagaaggcaaagctgaaattgtgccaggtgtgctttttattgatgaagtccatatgcttgacattgaatgcttctcatttttgaatcgtgcactagagaatgagatggcaccaatattggttgttgcaacaaatcgtggtatcacaaaaatccgtggaacaaattacaagtctccacacggtatacccatcgatctcttggaccgcctgctcatcatttcgacaaagccatataccgaagacgagatgcatcaaattcttgatataagatgtgaagaagaagatgtagaaatgtcagaggatgccaaggaacttctaacaaagataggggtcgagacatcactgcgctatgccattcacttaatcacagcagctgcactagcttgccagaagcgaaaggggaaacttgttgagcttgaggatgttagtagggtttaccaattatttgtggatgttaagaggtcaacacaattccttatggaatatcaggagcaattcatgtttaatgaggtccctggtgagattgaagaagacacaatggttgaataattgttttcctagaaatcctaggtttcctgaacaaagagtataattttgtattctgaaccagtatcagaaatgtcagatagacaaaggaaagtacaagatcagttgttttactgatctacttgtaatcatttagctgagaggaaattttgagcaagtagtggtaatatttggaaaattgtacagctaccttatgcagacgttgttttaggctagaaagtgcaggtctcttttttacttggtaatggataatgcttcagattagattgcttagtcaaattaccacagatagatgttcctttccaactttcaaaatgttttcctgtatgtcatatatttatattatagttcacttttggtcttcaccaaacatctccaactgttactgttgtgtacaagccaaagttcatgtagattgggatttatcccaatgaaaactagcagcttctactcatctatatatgcttctgcattctctgaagcattgatatgcttttgaatggatgcaaattccatgatcaatgtctaaattaaccttgggcttctcagcaataaatgttt

SEQ ID NO: 8880 - DNA, 1755 bp, Picea glauca
cattaacccattttccagcgtatatcgaacctgcaaaaccctgaaatccttaaactcattttcaccgacgacgtcctgcggaaaaaaacatccgtggatttgtcatacatcctaaagttgtctacccgaatctcttcataatttcaaccatatcgaggttttctgtccatttcagtcacgagcagcaacgtatgaaagtttgacagttttctcgagggttttgcccgacattttaaccttcgacaccggcctctgtataattggcgtgttttgtcgagccttttgaaacctaacaggtttccaacggtgaacttttttcggaaagagccatggcggagctgaagctgtcggagaccagggatttaacgcgcattgaacgaataggcgcccattcgcacatccgaggcttagggttggatgatgcattagaagcccgcaaggtttcacagggtatggtaggccagacatccgctagaaaagctgcaggggttattctagagatgattaaggaaggaaaaatagcaggccgcgcggttttgttggccgggcagccggggacaggtaagaccgccatagccatgggcatggctaaatccctaggcgaagaaaccccctttgcaatgatggcgggcagtgaaattttttcattagacatgagcaagaccgaggctttgacacaggcgttcaggaaggcaataggagttagaatcaaggaagagactgaaattatcgaaggcgaagttgtcgagatacagatagatcggcccgccacgtcgggcgctgcggcaaagactgggaaattgacattaaagacgacagagatggagactgtgtatgatttggggagtaagatgatcgaggggttgagcaaggagaaagtccagagtggggatgtgattgcgatcgataaagcttctgggaagattacgaagttggggcggtcttttgcgcggtccagggattatgatgcgatggggccgcagaccaagttcgtgcagtgtccggacggagagctgcagaaacgcaaagaggtggtgcattgcgttacgctgcatgagatcgatgtcatcaacagcaggacccaagggtttctggccctctttacaggagatactggagagatccgttccgaagtcagggaacagattgacagtaaagttgctgaatggagggaagaaggcaaagctgaaattgtaccaggagtgctttttattgacgaagtccatatgcttgacattgaatgtttctcatttttgaatcgtgctctagaaaatgagatggcaccgatattggttgttgcaacaaatcgtggcatcacaaaaatccgtggaacaaattacaagtccccacatggtatacccattgatctcttggaccgcctgctcatcatttcgacgcagccatatacggaagatgaaatgcatcaaattcttgatataagatgtgaagaagaagatgttgaaatgtcagacgatgcaaaggaacttctaacaaagataggggttgagacatcattgcgctatgccattcacttaatcacagcagctgcattagcttgccagaagcgaaaggggaaatttgttgaactcaaggatgttagcagggtttaccaattatttgtggatattaagaggtcaacgcaattccttatggaatatcaggagcaattcatgtttaatgaggtccccggtgagattgaagaagacataatggctgtataattgttttcctagaaattctacatttcccaacaaa

SEQ ID NO: 8881 - DNA, 1836 bp, Lactuca sativa
attttgggccgggctaagcgcaatgataaaagtttctgatacctaaaaactaataagagaattgaatcaccctcttcggtctctcccggaaaacccagtcacacttcacaacatcggcccctaaacctaaactctctcatcggcctcaacagtcagcggctccggctcaccaagctaccactgaccaccgtctctctcgctgaccctgaaactctctcatcggctctcgctctcacctttaatctctcaatttctctgctgctgttgttgtcgagttttctaagttctaacaatggtggaggtgaaagtctctgagagcaaagacctaacccgaatcgaacgaatcggggcccactcccacatccgtgggctcggtcttgactctgccctagaaccccgggcagtctccgaaggcatggtgggtcaaaccactgcccgaaaagccgccggagtcatagtccaaatggtcaaagaagggaaaatcgcgggtcgggccgttctacttgcgggtcaacccggaaccggaaaaaccgccatagccatgggcatggccaagtcaataggacttgaaaccccatttgccatgctggcaggtagtgagcttttctctttagaaatgtccaaaacagaagctttaatgcaagcattcaggaaagcaattggtgttagaattaaagaagaaaccgaagtgattgaaggagaagttgtggagatccaaatcgaccgccctgcagtggccggagccgcctcgaaaaccgggaagttgactttgaagactaccgagatggagactgtgtatgatttaggagctaaaatgattgaagctttagggaaagacaaagtacaaagtggtgatgtgattgctatcgataaggcttccggaaagatcacaaaactcgggagatcgttttcgcggtctcgagattatgatgccatgggcccacaaacgaaattcgttcagtgtccagatggcgagttgcagaagaggaaagaagttgttcattgtgttacccttcatgaaatcgatgttatcaatagcaggacacaaggttttcttgctcttttcacgggtgacacaggcgagatacgcgccgaagtccgtgaacaaattgatacaaaagtggcagagtggcgagaggaaggaaaggccgagatcgtgccaggtgtcctcttcatagacgaagtccacatgctcgacatcgaatgtttctctttcctaaatcgtgctttagaaaatgacatggcgccgattctggttgttgcaacgaaccgagggatcacaacgattcgtgggaccaattacaaatcgccacatgggattccgattgattttttggatcggcttttgataatttctacacagccgtatacggaagaggatatccggaagattctagatataaggtgtggggaggaggatgttgatgtggcggaagatgctaaggttttgttgactaaaattggggtggagacgagtttaaggtatgcgataaatttgataacatcggctgctttggcttgtcagaagaggaaagggaaggtggtggagatggaggatgtgagtagggtttatgagttgttttgggatgtgaagagatcgactcagtatttgatggagtatcagagtcagtatatgtttagtgatgcacctgaggaagatgaagttaacatgatggtttgattatgattctgattgttgaattttgtgagtattaatgttctaagcttcatgttgtcaacaatagcacttctttatcttcaaatttagtagagtatgggccctatgggatatgcttcattatttaagagtgaattatatttttggttaaaaagttt

SEQ ID NO: 8882 - DNA, 1661 bp, Nicotiana benthamiana
agatagaaatataaacccccacaacataaaccctgaaccctaaactttgctctctctctcttcactctccttctacagagctgctctatagcaaactccaccatccatcaatggcggaggtgaaaatctcagagatgcgtgacctaacccgaatagaacgcataggtgcacactcccacattcgaggtctcggcctcgactcatcactcgaaccccgcctcagttccgaaggcatggtaggccaaacctccgctcgtaaagccgccggcgtgatagtcaaaatggttcaagaaggtaaaatcgcgggtagggctgtcctcctcgcgggtcaacccggtacgggcaaaacagctatagcaatgggcatggcgaaatcattagggcaagaaacccctttcgctatgctagcaggaagcgaactttactccctcgagatgtcgaaaacagaagcacttatgcaggcatttcgtaaagcaattggtgtgcggataaaagaagaggctgaagttattgaaggagaagttgtggaagtgcagattgataggccagctgtggctggggctgcgtcaaagacggggaagttgactttgaagactacggatatggagacagtttatgacttgggagggaaaatgattgaggctttagggaaggagaaagttcagagtggggatgttattgctattgataaggcttctgggaagataactaaattagggaggtcgttttcgaggtccagggattatgatgctatgggaccccagactaagtttgtacaatgtcctgaaggagagctccagaagaggaaggagattgtacattgcgttaccctccacgaaattgacgtcataaatagcagaacacagggatttttagcactatttacgggtgatactggtgagattcgtgctgaagtgagagaacaaatagataccaaggttgcagagtggagggaggaagggaaggcagagattgtgcctggtgtcctcttcattgatgaagtccatatgcttgacattgagtgtttctctttcctaaaccgagctctggaaaatgacatggcacctatattggttgttgctaccaatagaggcattactacaattcggggaacaaactacaaatccccacatgggattccaattgactttcttgatcgcctgctcatcatctctacacagccttacaaggaggaagaaattcgtaaaattctggacatcagatgccaagaggaggacgtagaaatgtctgaagatgcaaaaattttgttgaccaagattggggtgaatacatctttgagatatgccatccaccttattacttctgcagctctggcttgccagaagcggaaagggaagattgtggaagtggacgatgttactcgagtctataatctgttttatgatgtcaagagatccacacagtacttgatggagtatcagagccagtacatgtttaatgaagtaccaacaggagatgcagaagaagatgaaactactgccatggtctgctgaaagcttcttgactcgggattctagagattgagatcattcctaaattcagagttagctcagatttttgtacaaaactcgtctagtttgcaggtttaacaattatgtcttatttctttaagaacctagtttgattttctcattgctcct

SEQ ID NO: 8883 - DNA, 1806 bp, Citrus clementina
aatctgtagagaactagaaaaccataaaccctaaaccacactctatcaaaccacaaccatcaccagaatggcggagctaaagctatcggaaagccgagacctaacccgaatcgagcgcataggtgcacactcccatattcgtggtcttggtctagactcatccctagaagcgcgcgatgtctctgaaggcatggtgggtcagctccccgcccgtaaggccgccggcgtcatactccaaatgatcaaagaaggaaaaatcgcgggtcgggccgtcctcattgcggggcaacccggtactggtaaaaccgccatagcaatgggcatggctaagtctctcggccttgaaactccctttgccatgatctccggctccgaaattttctccctcgaaatgtcgaaaaccgaagccctaatgcaagcatttagaaaggctattggcgtgagaatcaaagaagaagccgaagttattgaaggagaagttgttgaggtgcagattgaccgccctgcaacatctggggcggcagcgaagacagggaagctgacactgaaaactacggagatggagaccgtttatgacttgggtgggaagatgattgaagcattgggtaaggagaaggtgcagagcggagatgtgattgctattgataaggtttcggggaagattacgaagcttgggaggtcgttttcgaggtctagagattatgatgcgatgggtcctcatactaagtttgttcagtgtcctgacggggagttgcagaagcggaaagaggttgtgcattgtgttactcttcacgagattgatgtgatcaacagcagaacacaggggtttttggcgctcttcactggtgatactggtgagatccgtgctgaagtaagggaacagattgacacaaaggtcgcagagtggagggaggaagggaaggcagagattgtgccaggtgtcctctttattgatgaggtgcacatgcttgatgtcgagtgcttttccttcctgaatcgtgctctggagaatgagatggctccaattttagttgttgctaccaacagagggatcactagaatcaggggcacaaactacaaatctgctcatgggattccgatggatcttctcgatcgcctactcatcatctctactaaaccctatactagggatgaaattcgcaaaattctagatatcagatgccaggaggaagatgtggagatggctgaagatgcaaagcaattgttgacccgtgttggggaaggaacatcgttgagatatgccatccatcttataacagctgctgcattggcatctcagaaacggaaaggaaaagttgtggaagttcaggacattgatcgcgtctaccgtctatttttggatgtacagagatcaactcagtatttgatggaataccagagtcagtacatcaatgaagtgacaatagaagctgatgaagatgatgccaatgccatggttccagaatagttcctccagacttgtgatattgagattatgcatcaatctcgccttgttaattgtagttattgccagtacttgcaacatttagctatgctttatccatacatatgtggcacgtgttttggtttaaatagttgtggatcttaccaccttccggtatgctacagtttgaaagatattggtttgttaattatgtgacaggctccggcgattccccagcgttataatgtttgatctcgaatctcgaatcacgaaacatggtgtggttgcatcctatatatgtcaaactggtgtgatcactatcgtggtgtcgatttcagaaattgcttaaagcctcaaatgga

SEQ ID NO: 8884 - DNA, 1799 bp, Citrus sinensis
aatctgtagagaactagaaaaccctaaaccctaaaccacacgctatcaaaccacaaccatcaccagaatggcggagctaaagctatcggaaagccgagacctaacacgaatcgagcgtataggtgcacactcccatattcgtggtcttggtctagactcatccctagaagcgcgcgatgtctctgaaggcatggtgggtcagctccccgcccgtaaggccgccggcgtcatactccaaatgatcaaagaaggaaaaatcgcgggtcgggccgtcctcattgcggggcaacccggtactggtaaaaccgccatagcaatgggcatggctaagtctctcggccttgaaactccctttgccatgatctccggctccgaaattttctccctcgaaatgtcgaaaaccgaagccctaatgcaagcatttagaaaggctattggcgtgagaatcaaagaagaagccgaagttattgaaggagaagttgttgaggtgcagattgaccgccctgcaacatctggggcggcagcgaagacagggaagctgacactgaaaactacggagatggagaccgtttatgacttgggagggaagatgattgaggcattgggtaaggagaaggtgcagagtggagatgtgattgctattgataaggtttcggggaagattacgaagcttgggaggtcattttcgaggtctagagattatgatgcgatgggtcctcatactaagtttgttcagtgtcctgacggggagttgcagaagcggaaagaggttgtgcattgtgttactcttcacgagattgatgtgatcaacagcagaacacaggggtttttggcgctcttcactggtgatactggtgagatccgtgctgaagtaagggaacagattgacacaaaggtcgcagagtggagggaggaagggaaggcagagattgtgccaggtgtcctctttattgatgaggtgcacatgcttgacgtcgagtgcttttccttcctgaatcgtgctctggagaatgagatggctccaattttagttgttgctaccaacagagggatcactagaatcaggggcacaaactacaaatctgctcatgggattccgatggatcttcttgatcgcctactcatcatctctactaaaccctatactagggatgaaattcgcaaaattctagatatcagatgccaggaggaagatgtggagatggctgaagatgcaaagcaattgttgacccgtgttggggaaggaacatccttgagatatgccatccatcttataacagctgctgcattggcatctcagaaacggaaaggaaaagttgtggaagttcaggacattgatcgcgtctaccgtctatttttggatgtacagagatcaactcagtatttgatggaataccagagtcagtacatcaatgaagtgacaatagaagctgatgaagatgatgccaatgccatggttccagaatagttcctccagacttgtgatattgagattatgcatcaatctcgccttgttaattgtagttattgccagtacttgcaacatttagctatgctttatccatacatatgtggcacgtgttttggtttaaatagttgtggatctttccaccttccggtatgctacagttggaaagatattggtttgttaattatgtgacaggctccggcgattccccagcgttataatgtctgatctcgaatcaggaaacatggtgtggttgcatcctatatatgtcaaactggtgtgattactatcgtggtgtcaatttcagaaattgcttgaagcctcaaatgga

SEQ ID NO: 8885 - DNA, 1590 bp, Vinca minor
agtcacaactatggcggaggtgaaaatctctgagacgcgagacctaaccagaatcgaacgaataggcgcccattctcacatccgtggcttgggtctggactcgggccttgagccccgtgccgtctccgaaggcatggtgggtcaatcaaccgccagaaaagccgccggaatcattgtcaaaatggttcaagacggaaaaattgccggccgggctgttctccttgcgggtcaacccggttcaggaaagaccgccattgctatgggcgttgcaaaatcaataggtcaagaaaccccttttgctatgcttgcaggtagtgagcttttctcgctggagatgtcgaaaaccgaggctttaatgcaagcttttagaaaagctattggggttaggattaaggaagagacggaggttattgaaggggaagttgtggaggttcaaattgaccggcctgcggtggctggagcggcttccaagactgggaagttgactttgaagacgacggagatggagactgtgtatgacttgggagctaagatgattgaagctttggggaaggagaaggtgcagagtggggatgttattgccattgataaagcttctgggaagattagtaagttagggagatctttttcgcggtctagggactatgatgctgttggtccgcatactaagttcgtgcagtgccccgatggggagctgcagaagcggaaagagattatgcactgcgtcactcttcatgagattgatgttatcaacagcagaacacaagggtttctggctctgtttaccggtgatactggtgaaattcgtgccgaagtcagggaacaaattgatacaaaggttgcagaatggagggaggaaggaaaggctgagattgttcccggtgtcctgttcatcgatgaagtgcacatgcttgatatcgagtgcttttccttcctaaatcgcgctctggagaatgatatggctcctatcttaattgtagcaaccaatagagggttccccaaaattcgaggcacaaactacaaatctgcacacggtatcccaaccgattttcttgatcgtttactaatcattcatacacagccatatacagaagacgaaatcaggaaaatcctcgacattaggtgccaagaggaagacgtagaaatgtctgaagatgccaaggttttgctgacaaagatcggagtcgatacatctttgagatacgcaataaacctcatcacagctgctgcattgtcttgccagaagagaaagggtaaggttgtggaaatggaagacattagccgagtttacgagcttttttatgatgtgaagagatcaactcagtacttgatggaataccagagtcagtatatgtttagtgaggttccaactactgaaggggatgaagatgagaccactgcaatggtttcataaccttttcttggctcctatgactaaacagatgaattaacaaggtatttctgggctgcttgtttagagcagttttctgttctgattattattaaaggctggtctagtacatagtagttcaattataagctcctgcttgctcatggatgttatttgtttatggattggtttttcgtttg

SEQ ID NO: 8886 - DNA, 1555 bp, Catharanthus roseus
ccaaaacctctctcacggctctcaccctctttctcgtcgtttccagccatggcggagctgaaaatctctgagatgcgagaccttaccagaattgaacgaattggtgcccactcccacatccgtggcctgggtctagactcggcgcttgagcctcgtgccgtttctgagggcatggtgggtcagacatctgctagaaaagctgccggtgtcattgtcaaaatggtccaagaaggaaaaattgctggtcgggcagttctccttgcgggtcagcctggctccgggaagacagccattgccatgggaatggcaaaatcacttggccaagaaaccccttttgctatgctcgcaggtagtgagcttttctcgcttgagatgtcgaaaactgaagccctgatgcaagcctttaggaaagctattggggttagaattaaggaagagacggaggttattgaaggtgaagtagtggagattcaaattgacgaccagctgttgctgagcagcatccaagactgggaaattgcgttaaagaccacggagatggagactgtgtatgacttaggagcaaagatgattgaagctctggggaaggagaaggtgcagagtggggatgtcattgctattgataaagcttctgggaagatttcaaagttagggagatcgttttcgcggtctagggattatgatgctgttggtccgcacactaagttcgtgcagtgcccagatggagaacttcagaagcggaaagagatcgtgcattgtgtgacccttcatgagattgatgttattaacagcagaacgcagggggtttctggctctctttaccggtgatactggtgaaattcgtgctgaagtcagggaacaaattgatacaaaggttgcagaatggagggaggaagggaaagctgagattgtacctggtgtcctgttcattgatgaagtgcacatgctggacatcgagtgtttttcttttctaaatcgtgctctagaaaatgatatggctcctatcttagttgtagcaaccaataggggaatcacaacaatccggggcactaattacaaatctccgcatggtattccaatcgattttcttgatcgtttgctcatcatatctacacagccatatacagaagacgaaatcaggaaaatcctggacattaggtgccaagaggaagatgtagaaatgtctgaagatgccaaggtgttgctgacaaagattggagtcgatacatctttaagatatgccatacacctcatcacagctgctgcactggcttgccagaaacggaggggaaggttgtggaaatggaagatatcagtcgggtgtacgagctgttttatgatgtgaagagatcaactcaatacttgatggaataccagagtcagtatatgtttaatgaggtgccaactgcagaaggggatgaagatgatgcctcagcaatggtttcataacaataacttagctattctgaaatgtaatttataaaattaaactgatgattaactatgtctttctgtggctggctgcttgtttgttgcagcgttcatcattttcatg

SEQ ID NO: 8887 - DNA, 2159 bp, Picea glauca
caacccacaatactggaacaaagcaaaataaaacccaccaaaaccgtagtctcgccattcaaactctgcattaacccattttccagcgtatatcgaaccagcaaaaccctgaaatccttaaactcattttcaccgacaacgtcctgcggaaaaaaacatccgtggatttgtcatatatcctaaagttttctacccgaatctcttcataatttcaaccatatcgaggttttctgtccatttcagtcacgagcagcaacgtattaaagtttgacagttttctcgagggttttgcccgacattttaaccttcgacaccggcctctgtataattggcgtgttttgtcgagcctttgaaacctaacaggtttccaacggtgaacttttttcggaaagagccatggcggagctgaagctgtcggagaccagggatttaacgcgcattgaacgaataggcgcccattcgcacatccgaggcttagggttggatgatgcattagaagcccgcaaggtttcacagggtatggtaggccagacatccgctagaaaagctgcaggggttattctagagatgattaaggaaggaaaaatagcaggccgcgcggttttgctggccgggcagccggggacaggtaagaccgccatagccatgggcatggctaaatccctaggcgaagaaaccccctttacaatgatggcgggcagtgaaattttttcattagacatgagcaagaccgaggctttgacacaggcgttcaggaaggcaataggagttagaattaaggaagagactgaaattatcgaaggcgaagttgtcgagatacagatagatcggcccgccacgtcgggcgctgcggcaaagactgggaaattgacattaaagacgacagagatggagactgtgtatgatttggggagtaagatgatcgaggggttgagcaaggagaaggtccagagtggggatgtgattgcgatcgataaagcttctgggaagattacgaagttggggcggtcttttgcgcggtccagggattatgatgcgatggggccgcagaccaagttcgtgcagtgtccggacggagagctgcagaaacgcaaagaggtggtgcattgcgttacgctgcatgagatcgatgtcatcaacagcaggacccaagggtttctggccctctttacaggagatactggagagatccgttccgaagtcagggaacagattgacagtaaagttgctgaatggagggaagaaggcaaagctgaaattgtaccaggagtgctttttattgacgaagtccatatgcttgacattgaatgtttctcatttttgaatcgtgctctagaaaatgagatggcaccgatattggttgttgcaacaaatcgtggcatcacaaaaatccgtggaacaaattacaagtccccacatggtatacccattgatctcttggaccgcctgctcatcatttcgacgcagccatatacggaagatgaactgcatcaaattcttgatataagatgtgaagaagaagatgttgaaatgtcagacgatgcaaaggaacttctaacaaagataggggttgagacatcattgcgctatgccattcacttaatcacagcagctgcattagcttgccagaagcgaaaggggaaatttgttgaactcaaggatgttagcagggtttaccaattatttgtggatattaagaggtcaacgcaattccttatggaatatcaggagcaattcatgtttaatgaggtccccggtgagattgaagaagacataatggctgtataattgtttttgcagaaattctatatttcccaacaaagtagatttctatatttgggacatgcagcagaaatatcagataaacaaaggaaagcacaagataaggtgttttaccgatctacttgtaatcatgtagctgaggcgaaatttttgagcaagtagtggtgtttagaaaaatgtacagctaccttatgcagacattattgtttttgagctagaattgcatgtctctttttttcttggtactggatagtgcttcagattagtttgcttaaccaaattcttgcacataaataatcctttccaatctccaaagaatcttcctgtattcttttatatatttaacagtcaatcatgctcttcatcaaacatctcca

SEQ ID NO: 8888 - DNA, 1809 bp, Phaseolus vulgaris
tcagtttcacaaccttactctcccaaaaccctcaaaaccctaattaaccccttattctcccaccgccgctaccatggcggagctcaaactctccgagagccgcgacctcacccgtattgagcgcgtgggcgcgcactcccacattcgcggcctcggtctcgactcctcactcgagccgcgcgccgtctccgagggcatggttggtcagactgccgctcgcaaggccgccggcgtcatcctccgcatgattaaagacggaaagattgccggccgtgcggtcctcctcgcgggccagcctggtaccggcaagaccgccatcgccatgggcatggccaagtcccttggtctcgaaactcccttcgccatgatcgcagccagcgaaatcttctccctcgagatgtccaagaccgaggcgctcacccagtcctttcgtaaggccattggcgtgcgcataaaggaggacaccgaggtcatcgagggtgaggtcgtcgaggtccatatcgaccgccctgcggcggccggtgccgcctccaagaccgggaaactcacgctgaagaccaccgaaatggagaccgtttacgacctcggcgcgaagatgattgaggcgctggggaaggaaaaggttagcagtggtgatgttattgcgattgataaggccaccggcaagattaccaagctcgggaggtcgttttctaggtcaagggacttcgacgctatggggccgcaggtgaaatttgtgcagtgccctgatggggagttgcagaagaggaaggaggtcgtgcattgcgtcactcttcatgagattgatgttatcaatagcagaacacagggatttctggcgcttttcactggcgatacaggtgaaattcgtgcagaagtcagagagcaaattgacaccaaagtggcagagtggagagaagaaggaaaggctgagattgtgcctggtgttcttttcattgatgaggtgcacatgcttgacatagagtgtttttcattcctgaatcgggctctagagaatgagatggctcccatattagttgttgctaccaacagaggcatcacaactattcgaggcacgaattacaaatccccacatgggattcccattgaccttctggatcgactgctcatcatctctactcaaccttacacagaggatgaaattcgcaagattctggatatcagatgccaagaggaagaagtagaaatgactgaaagtgcaaaacatttgttaaccaaaataggtgtagaaacatctttgagatatgctattcatctaatcacagcagctgcactggcatgccaaaagcgaaagggaaaggcagtggagttggaagatataaatcgggtttacaatctgtttttggatgtgaaaagatcaacacagtacctaatggagtatcaaagtcagtatatgttcagtgatacaggagaagctgatgaagatgaaaccaatgccatggtctcttagatttacaaacatcagctagagagtttgtaagtacccggttagtctttgtacaagttgcagaaatttgttctatctggttcttcattgcacttcaattagtcttatacagttcaccagaagttttcagtggttgaactctgctcatgactttgcaacttatatattttgaacacgagaagctgtaccgaatttctgttactactgagcatttcatccttatttttttttgctgtatcatgcatgcacaacaatcaacagagagtgctttaacagtaatttattagacatggtttgctgtaagcagtcaaaatgtcacaggtggaaaaatatgtgccgtt

SEQ ID NO: 8889 - DNA, 1738 bp, Trifolium pratense
gcactcgctctctctcaacaaaacccctaaaccctaaaacctccttcatctccaatactccactctccccgtcgccgctgcaaccatgacggagctcaaactatccgaaactcgcgacctaacacgcatagagcgcgtcggagctcactcccacatccgcggccttggtctcgactcctccttagagccacgcgatgtctcagaaggcatggtcggccaagtctccgctcgtaaagccgccggcgtcatcctccagatgataaaagacggtaaaatcgccggccgcgctgtcctcctcgccggacaaccaggaaccggcaaaaccgccatcgccatgggaatggcaaaatccctaggtcttgaaacaccgttcgctatgatcgccggaagtgaactcttctcactcgagatgtcgaagaccgaagcattaacacaagcgtttcgtaaagcaattggtgttcggattaaggaagaaacggaggttattgaaggtgaagttgttgaggttcagattgaccgtcctgctgtttctggtgcggctgcgaagacggggaagttgacgctgaaatctacggagatggagactgtttatgatcttggtgcgaagatgattgaggctattgggaaggagaagattacgagtggtgatgtgattgctattgataaggcttcggggaagattacgaagcttggtagatcgttttctaggtcgagggatttcgatgctatgggacctcaggtgaagtttgtgcagtgtcctgatggagagttgcagaagaggaaggaggttgttcattgtgttactcttcatgagattgatgttattaatagcagaacacagggatttctggctcttttcaccggtgatacaggtgaaattcgtgcggaagtcagggaacaaattgacactaaagtggcagagtggaaagaagaaggaaaggcagagattgtgcctggtgtccttttcattgatgaggtacacatgcttgacatagagtgcttttcgttcctcaatcgagctctggagaatgaaatgtctcccattttagttgttgctaccaacagaggcattacaactattcgtggcacaaattacaaatccccacacgggattcccattgatctacttgatcgcctactcatcatctctactcaaccttatactgaggatgaaattcgcaagattttggatatcaggtgcccaagaggaagacgtagacatgagtgaaggcgcaaagcatttgttaaccaaaataggtgtagaaacatccctacgctatgccattcatctaatcacagcagctgctttggcatgccaaaagcgaaaggcaaagacagtggaattagatgatataaatcgggtttacaatttgtttttggatgtcaaaagatcgacacagtacttgatggaatatcaaagtcaatacatgttcagtgaaacaggtgaagttgatgaagaggatgccaatgctatggtcccttgaaattcatgcgcatcagtttgagactttgtaattatctgagctgacatattagtgtaagttgcagcaatttattttatgatttggtgggtcattgcagttgtcttgtattagatatttgagcaggagcagtttttccaaggttgaatttcaatatctacgcgttcacgtggaggcttcactgtgtttctgctaaacttttcaatgatttcttttttatattttgtaatgtcatgtgtgctctattatgctcaaaa

SEQ ID NO: 8890 - DNA, 1838 bp, Capsicum annuum
actttccctagttcttccactgtatcaatggcaatgggtgaggtaaaaatctcagaaatgcgtgacttaacccgaattgaacgaataggagcacactcacacattcgcggcctcggtctcgacaacaatctggaacctcgtttgtcatctgaaggtatggtaggacaaacctccgcacgtaaagctgcgggcgtaattgtcagaatggttcaacaaggtaaaattgccggtcgggctgttctattagcgggtcaacccggaacaggtaaaacagcaatagcaatgggaatggctaaatcgttagggattgaaacaccatttgcgatgttagctggtagtgagctttactcattagatatgtcgaaaactgaggcgttaatgcaggcctttaggaaggctattggggttagaattaaggaagaggctgaggttattgaaggtgaagttgtggaggtgcaatttgataggcctacggtatcaggagctgcatcgaagacggggaaattgacgttgaaaacgactgatatggagacggtgtatgatttgggggcgaagatgattgaggcgttagggaaggagaaggttcaaagtggggatgttattgcgattgataaggcgtctgggaagattacgaaattagggaggtcattttctaggtcgagggattatgatgcatggggccgcagctaagtttgtgcagtgtccggaaggggagctgcagaagaggaaggagattgtgcattgcgttacgcttcatgaatcgatgtcataaatagcagaacacagggatttttagcactgtttacgggtgatactggtgagattcgtgctgaagtgagagaacaaatagacaccaaggttgcagagtggagggaggaaggaaaggcagaaattgtgcctggtgtcctcttcattgacgaagtacatatgcttgacattgagtgtttctctttcctaaaccgagctctggagaatgacatggcacctatattggttgttgcgaccaatagaggcattactacaatccggggaacaaactacagatccccacatgggattccaattgactttcttgatcgcctgctcatcatctctacacaaccttacaaagaggaagaaattcgcaaaatcctggacatcagatgccaagaggaggatgtagaaatgtctgaggatgcaagagttctattgaccaagatcggggtgaatacctctttgagatacgccatccaccttatcacttctgcagcattggcttgccaaaaacggaaagggaagattgtggaagtggaagatattactcgagtctataatctgttttatgatgtgaagagatccacacagtacttgatggagtatcagagccagtacatgtttaacgaaatgtcagcaggagaggccgaagaagatgaaactactgcaatggtgtcctgaaagcttatcgacttgggattcaggaggttgcaacttagctttggcgagaaggccttactgttcaagctcgaggtattttccaaggacatgatgatactgtagaaaatgttcagttcttgccttccaggctgcacgtggtctgagtaagaagtcaaaggagcagattgtggacattgatgctgctgatgtgaactatgaattggcagttttggaatatgttgaagacatttacagcttctacaaactagctgagagtgagacaagagttcatgactaattgattcacagcctaccacaagtttgagcttaatcaagaaactctttacctcacaatctacattgttgattgctacctcgctgtggagactgcatcaagaagggaactgcagttggtgggcattagt

SEQ ID NO: 8891 - DNA, 1999 bp, Cicer arietinum
atatatttatgaaaggcaccatttaactatatgaaagaaaaaccagtaaaggtcccatagaagagtagagagcacacattccaaaccttaaaccctaaaacccatttcgttccctgtaatcaatccactttcgccgctgcaaccatgacggagctaaagctatcagagagccgtgacctaacgcgcatagagcgcgtgggagctcactcgcacatccgcggcctaggtctcgactcctcattagagccacgcgacgtctcagaaggcatggtcggccaagcctccgctcgcaaggccgccggcgtcatccttcaaatgattaaggacggtaaaatcgccggccgtgccgtccttctcgctggacaacccggaacaggtaaaaccgccatcgccatggggatggccaagtcactaggcctcgaaacgccgttcgccatgatcgccggaagcgagctcttttcactcgagatgtcgaaaactgaagccttaacacaagccttccgcaaagccatcggcgttcgcatcaaggaagaaacggaggtgattgaaggcgaggtcgttgaggttcaaatcgaccgtccggcggtttccggcgccgccgctaagacggggaagttgactctaaagtcaacagaaatggagacagtttacgacctcggcgctaagatgattgaagcgatagggaaggaaaaagttactagtggtgacgtcattgcaattgataaggcttcagggaagatcacgaagcttggtagatcgttctctcggtcgagggatttcgacgccatgggaccgcaggtgaagttcgtgcagtgtcctgatggagagttgcagaagagaaaggaggttgtgcattgtgttactcttcatgagattgatgtcattaatagcagaacgcagggattcctggctcttttcactggtgatacgggtgaaatccgtgcagaagttagggaacaaattgacactaaagtggcagagtggaaagaagaaggaaaggcagagattgtacctggtgtccttttcattgacgaggtacacatgcttgacatagagtgcttttcgttcctcaaccgtgctctggagaatgagatgtctcccatattagttgttgctaccaaccgaggcatcacaactattcgaggcactaattacaaatcaccacatgggattcccattgatctacttgaccgcctactcatcatccatactcaaccttatactgaggatgaaattcgcaagattctggatatcagatgccaagaggaagacgtagacatgagtgaaggtgcaaagcatttgttaaccaaaataggtgtagaaacatccctacgctatgccattcatctaatcacagcagctgctttggcgtgccaaaagcgaaaaggaaagacagtggaattggatgatataaatcgggtttacaatttgtttttggacgtcaaaagatcaacacaatacttgatggaatatcaaagtcaatacatgttcagtgaaacaggagaagttgaagaagatgatgccaatgctatggtcgcctgaaatttatgcacatctttagagtttgtaattatctgagctgtcattatttgtttaggttgcagtaatttatttcatgatctggtatgtcattgcacttgtcttgtatttgatattgaacaccagtagtttttcgaaggttgaattgcaatatctactgtgttcacgtgagatattgtactgaattttgtttctactgaacttttaaaaaactttatatttgctgtatcattatgttcatgctcattttcttgctcaagttatcaatagagagtagtccaagagtaatttgttggtagatactatgtgacagatgctcaaattttgttaattgacatctgtgagttgatcgaggaatgcaagaaatatttcagaaacaaaaatgatattctcacactcaggtgaggtatgagaactgtatgtaagagagatagaaagagaaactgagaaaaataaagca

SEQ ID NO: 8892 - DNA, 1873 bp, Gossypium hirsutum
aaccctgcctttcccttcctcaatcatccaatgacggagctgaaactctacgagagccgagacctgacccgaatcgaacgcattggggctcattcccacatacggggcctaggcctcgactcctctctggagccccgtgacgtctcggaaggaatggtgggccaagcacaagctcgtaaagccgccggtgtcatcctccaaatgatcaaagacggtaaaattgctggccgtgctatcttattagcgggacaacctggaactggcaaaactgccattgccatgggcatggccaaatctcttggccttgaaacccctttctctatgctctctggcagcgaaatcttctcccttgagatgtcgaaaaccgaagctttaatgcaagcgtttcgaaagtccatcggagtaagaatcaaggaagaaactgaaataatcgaaggcgaagtcgttgaaatccagattgatcggccggcagtttcaggggcggcttcaaaaactgggaaattaacgcttaaaacgacggatatggagaccgtttacgatttgggggcgaagatgatcgaggcattagcgaaagagaaagtgcagagtggagatgtgatagctattgataaagcttcaggaaaaataacgaagcttggaaggtcattttcaaggtcgagggattacgatgctatgggtccgcaaacaaagttcgtgcaatgtccagacggagagttgcagaaaagaaaagaagttgtccattctgttacgcttcatgagatcgatgttattaacagcagaacacagggatttctagctcttttctctggggatactggtgaaatccgtgctgaggtgagagaacaaattgacacgaaggtggcagagtggagggaggaagggaaggctgaaatcgtgcctggtgttctctttatcgatgaggtgcacatgcttgatatcgagtgcttttctttcctgaaccgtgctcttgagaatgagatggccccgatattagtcgttgctacaaatagaggaataacttcaatccgtggcacaaattacaaatcccctcatggaattccaattgatcttcttgatagactactaatcatcactactcagccttattctgaggatgaaattcgtaagattctagacatcaggtgccaagaggaagatgtagagatgtctgaagatgcaaaacaactgttgaccaaaattgggcacgagacctccttgagatatgctatccatctgatcacagcttctgcattgaattgccagaagcggaaggggatggttgtggaagtgcaggacatcactcgtgtttacagtctatttctggatgtaaggagatcaacgcagtacttgatggagtaccaaaaagaatacatgttcaatgaagcatcaatcattgatggtggggatgccgattccatgcacgattgatagctccttcaggtctggttgaagacttttcgttatcccatggcgttactggaactattatttggcaaattaactgttacacagtgaatttgttttgtgatttgtatgcgatactgagtcttaatcccgtggatttacgtgccaaaacaaacttgtatgtggtcatcaaaaattgaagtcctgatgaattttagaatgatgacacagctgaagttctgttttcaacagattatccattggtccttcaaagattaatatcattgcctgtggtaaagaaagcttgcaggatatttatcatctaatccacgtgctctgaaagttaagcgtgtcaagttataggttttcttgcacgtctcaaatacttgtattcatggcagacacaagccctaaatgaattgtatgcaagcataataaaagaaaacatatgagcaatacaagccaaaaa

SEQ ID NO: 8893 - DNA, 1669 bp, Elaeis guineensis
caatttctctgattatcttctgaccccgtcttctacaccgatgtaaccaccaaagaccccatccaacatttccacccatcccgcttcgacgcccgtgactcggccttccaatcccacccgcagatcccttcaatcggtgtttgcggttcaaaacctcatctccccgccgtcgtggaaacgcggaagcggacgacgaccttatcacccatggccaccggttcgatcctcgaagccccagtcttgctcagggaaccgtccaaatttcggcctcgccctaatcctttcttccacaaattccaatcccgattgcctctctctcttcccacgagccataaattcatcagagtttctatccaatccgtcccaaatcctatggtggcgatccggccatgcgctgccgctgcgtactcctccctggaggagcggaacaaattcgcgagggcagttcttgaaaccctaagagcgctgaggaaatcggcgatcgccgtcatctttctagggttcctcctgacggccgatccacttcccgccctcgcggcctccgggggaaggatgggaggaagtgccttctcttcttcttctcggtcccattcttcttcttcttcttctcggtctcattcttcttcttctttgcattcttattcgagaccctcaatctctagcttctcgtactctgttccgtactacgctccttctccgttcggtgcaggaggaggtttagttcgggccgtcggggtgggcttcaactcggagggtggattcatcctccttatgttttgttttgcggcagttattttgctggctggaattatttcggaccagagggatggtggcagcgtcctcgctgacacccagaagacgagtgtcctcaaacttcaggtcggcttattgggcatggcacggtcacttcagaaggatcttgatcggattgctgaaactgcagacacatctactccagaggggttgagctatgtgttgacagagacaacattagctttgcttcgacatccagattgctgtatttctgcctactcatcggttgatgtaaaacggactatagaaggtggggagaaacgtttcaataagctttcaattgaggagcgaggtaaatttgatgaagagacacttgtcaatgtaaacaacattaaaaggcggaaaacaaccagccagagatcaaagggtttcagcaatgagtatattgtgattacaattctggttgctgctgagggtgtatataagctacctgttattaatgggagtgcagacttgaaggaggcactgcaaaagctggcatctataccctcccgtaaaactctggctgttgaggtgctgtggacccctcagaatgaaaatgatgcactttcagagcgggagctgctcgaagactaccccctcttgaggcccctgtaaggggagctgctctgagctgcccttcatagccaggtggttcatgtaaagaaaaatgttaatagataaatgtgataaaaaactaggatatgcagtacattatacaaaaaaaaaaactaggatatgcatctcacaaaatggtatttttctagtggaggacatgcagaactctattgacacagtaatttgttacaatatgttaggtcctggatcactgctagcatgccagtaatatgtgagtgtagtcattcattattcttgg

SEQ ID NO: 8894 - DNA, 1436 bp, Musa acuminata
ctcgcgtaagccacccggtctcttcctccaattccagccgcaggcctggggatttttccgcctcttcctcctccaacgacatactgtctttgagcttcaaatcttatctccgtcaccgaaaactcaagaagctcaatagggaatcggtggcctaatggtttccgcttcgctcttagaaaccatctccgtctttagagagccgcccaagtgcaggcctcagcgcctcctccgatggaatcctatccttcaacctcctctaccgcaattccctctcattagatctcggaagcccatcaggttcgccctcggatgctctcccaggccgccatccgccgccgccggcgacgagcagaagagacgccccctggacgcggcgctgcgagccgttctcgagaccttggatagactcaagaagcccgcggccgctatcatcttgatcgggttcctcctcaccgccgattcccacggcgccctcgcggcgtccggggggcgcatgggcgggaaggccttctcctcatcgccctcccggtcgcactcttcctcttcctggagttactcggctcctcccagctcgagattctcctactctgcgccctactacgcgccctcgccgttcggaggggggttctacgcgggaccggcatttggggtgggtttcggggcggggtcggggttcttccttctcatgatggggtttgcagcggtcattttgctctcggggttcctctcggaccgggcggacgatgggagcgtcctcacggccacgcagaagaccagtgtcatcaagctgcaggttggcctattgggcattgctcgatcatttcagaaagatcttgatcagattgctgaagctgcagacacatctactccagagggattgaattacattttgacagagacaacactggctttgctccgtcgtccggattgctgcatatctgcttactcttctgtggatgtgaaacgtagtatagaagatggcgagaaacgtttcaatcaactttcaattgaagagcgaggtaaatttgatgaagagacacttgtgaatgtgaacaacattcgaagacaaaagacaggcaaccaaacattcagaagtttcagcaatgagtacattgtggtcacaattctggtggctgccgagggtgtatacaaacttcctgtcataaatggaagtggggatttgaaagaggcactgcagaagctcggttctataccttctagcaaaacactggctgtggaggtgctatggacacctcaaaatgagaatgacacgctttcagaaagggagcttctcgaggactacccacttttgagacccctgtgagtggaagtcttttgttattgtactagaatatgaagttgatggacgacttgtagataaaaggatgtgtttgctagttgctttcttaggctaaaataaacactaaatatcccac

SEQ ID NO: 8895 - DNA, 1542 bp, Eucalyptus grandis
gaaatcctctctcctcctcctcctcctcctccaacggcattggcttccttccatggccacggccgcgaccctcttcctcttccagcccaggctccccgggtccggccgcaagtcgccgccttgcctccccggcgcccgccgcgcccgcctcggcacccgcgctccgagcttcggccccgaatccgtccgcggccgccgtggcgtcgccgggtgctccgcgcggcgcggggacccgcccgccgcggccccgagcgccgcgagcggctcgggcgcggaggatcgtccgcggaacccgctcgaggtcgtcctgagcgcggtcgcccgggccctggagtcgctcaagaggcccgccgtcgccgcgatcctgctcggcctgctgctcgcctacgatcctaactccgcattggccgcctccggcgggaggatgggcgggagttcgttttcgtcgtcgcgatcgtcgtcgtcgtcgtcgtcgtcttcgaggagctatacgacgagggcgcccagccctagcattccgtactcggctccgtattacgcgccctcgccgtttggtggagcctacgtggggccggcggtcggggtcggagtgggcgcggggtcgagcttcttcttgatatttatgggcttcgccgcgttccttctggtctcggggtttctctcggatcggtctgagggcggcgtgctcaccgcgacggagaaaacgactgtgctcaagctgcaggtgggattgttgggcatgggaaggtcacttcaaagagatcttaataagatagcggatgttgcagatacatcctcatctcagggtcttagctacgtcctgactgagacgacacttgctttactccgtcatcctgattattgcatctccggttattcatctgtggatgtgaagcggagcatggaggatggggagaagcgtttcaatcagctgtcaattgaagagcgagggaaatttgatgaagagacacttgttaatgtgaacaacataagaaaacaaagtaccaccagccagagatctagtggatttagtaatgagtacatagtgataaccattctagtggctgctgaaggagtccataaattgccttccattaatggtggtggagatctgaaagaagccttgcagaaacttgggtccattccctcgagcaaaatactagcagttgaggtgttgtggacccctcaaaatgaaaatgacacactatcagagagggagcttctcgaggattacccattactgaggcctttataagatatatgatgaggctttttcagaggtatgatcccagtcaaagttgtatgcttggagtgttttgtatagaataggtcctgtatagtatacaaaatgaataggttaataccattaaatttttgtaatcgagctgccaaggtacaggcttttattttctccctaccagctccatgactttaatgcctgtgagttgtatcttccaaggcttgagcttatgagatgcagaatgaagtttttgtatcttgattttcttgccagatgaatgggatttcctgaagtagttaatc

SEQ ID NO: 8896 - DNA, 1562 bp, Phalaenopsis aphrodite
cagaagttcaaatgaatggcggatgccggaggtgacgagtctactactctcttttctctgtaaaatatcttatcggcggcggcgctctctcctctccaccaccggcgataattttccgtgaaaactcaaaacctagctcttcaatgtattcggtttcgcttcttgaggcaatctcgatcatccgagattctccgagaaacaggctgccgtcccagaaatggaaccctctcttccataggagagtatcagaaggttttgttaggaatcccaggaccacacgattctgtacgcatttggctttgaagccgattgcaacgcaacgggtttcttctcctgacgcatcagaagaggaggggaatccatgggacgggttcgttacgaaggtgtttgatgcgttgaaagcgctgaagaagccggctatcgccgctttgttggttggagttctgctcacggtggatccgtttcgggcaattgcagcctctggagggaggatgggtgggagggctttttcatcttcatcatcatcgccatcttattcgaggagctactcagctccgcccagttctggattctcgtattctgtaccgtattatgcgccgtcgccattcggcgcggctggtggattctacgtggggccggtggtaggtgtcggattcggtgcgggatctgggctgttcattctgatgatgggatttgcggcgtttgtgctgcttacggggttcctatcggatcgatcggatgaaggcagtgttcttactgcggagcagaaaactagcgttctcaagcttcaggttggcttattgggcatggctcgttcattgcagaaagatcttaatcgaattgctgaaacagcagatacttctaccgctgaaggtttgaattatgtcttgacagagacagcattggctttgctgcgacatcctgattgttgcatctccgcgtattcatctgtggatgtaaaacgaagtgtagaagatggggagaaacgatttaatcaactttcgattgaggaaaggggtaagtttgatgaggagacacttgtaaatgtaaacaatattaagaggcaaagaacaacaagctatagttccaggtctttcagtaacgagtacattgtgataaccatccttgtggctgctgagggattgcacaagctacccgtcatcaacagtagtgcagatttaatgacggcgttacagaagttgggctctattcctgtcaacaaaactatggcagtggaggttttgtggacaccacagaatgaagacgacacgctatcagagcgtgaactcctggaagactacccgcttttgaggcctttgtaagaaagcaatgaaatcctgtacagatgcagcagaaaattctcaaacattatatatatattgtgaaaatggctactgtcaaagtttaaggtacaaatgatttctcaattttacccttatctgctctactatttacatgcaagtaactttcacgaaaccatatgtccatttgagaagaaagccagatagaacagtagtgtttttcttacctgtaactctgtaaattatgcttttttatttctc

SEQ ID NO: 8897 - DNA, 5831 bp, Cicer arietinum
tgagattttgctctctctgtctcttaatctcttataaggctttacaattcacatataaagagagtgaaagaaaaaaaaaattattaaaattgataataaaaaaaaacaaaagaaaaaaataaaaataaaaggagagaagggttatctatcaaagcttattagcaacaaggagaggctagaattgctctcaaatcttgaaaaaggttaaaaacttacaagacccttatcctatcttctttcaacacaatttcacaatatatcaacattcttctctcaaccatattattattataaagtcttttttctctcactctcttttttcccttcaagttcatcatcattcacatagtgccttattttttcatccattaaattactttcttttccaaatttttcttttttgttctttggttttgccaaaagggtagtgagaaaaaaaaatggctccaaaatcagggaaagggaaaacaaataaagctaaggcagagaagaagaaaaaggaagagaaagcagtggcaccttctcttgttgacattacaatagttactccttatgattcacaaattgtattgaagggtatctcaactgataagatacttgatgtgagaaagttattggctgtgaaggtggaaacatgtcattttacaaactattctttatctcatgaggttaaaggtcggagattaaatgacaaagttgaagttgttaccctaaagccatgtgttctaagaatggttgaagagaattactatgaagaggttcaagcagttacacacgtgcgaagactattggatattattgcctgcacaacaaggttcgggaagcccaaacgcaccataacaggcccagaatcaaagcccaagaaaaacggaaaggcccaaaatcaaaacaagagcagcgtgagtccacccgcgacacccaatggagattcccgggtcgggttaccgtcgtcggatccaccggcgtcgccgatttcggataatgtcggaatggtggcgattcatccaacgccgaagttgtcagatttttacgaattcttctctttctctcatctcactcctccgattttacatttgaagaaatgtgaaacgaaggatgaagatgatagacgcaaaggagattactttcagcttcaggttaaaatcagcaatgggaaaatgatagaagttgttgcttcagagaaaggcttttatagtgttggaaagctgtctctacagagtcacacattggttgatcttctgcaacagctcagtagaggtttttcaaatgcctatggatcattgatgaaagctttctcagaccgtaataagtttggcaatcttccatatggactccgatcgaatacatggcttgttcctccgtctgttggcgaatctctttcaaactttccagctctacctgctgaggacgaaaactggggtggtaatggtggtggccagggaagaaacagagcatacgatcttcgaccgtgggcgacagattttgctatattggcttctcttcctagcaaaactgaggaggagagggtgatcagagatcgaaaagcttttcttcttcacagtcagtttgttgatacatcgatatttaaggccgctgcagctatacagcatgtgatggaatccaagtctagtaagaagaatgaaatgaattctgttctgcatcaagatcaagtgggagacttattgattgtagtcaaacacgatgggaatggaaagtttgattctacactgaatgaacccagtaaacaaaatgagcatgttcagaagaatttaattaaagggttgtctgctgatgaaagtgtcaccgttaatgacacttcttccttgaccgttgttgtcgttaaccactgtggatatacagcaacagtaaaggtcgtcggtaatgcaaacgcaaagaagcctaaagttcaagatattgaaatagatgaccaaccagatggtggagcaaatgctcttaacatcaatagtttgagggtattgcttcacaagtctggagctgagttctcagaagggacattaacatccttgtcaaattttgatgacttggatgcttctaaagatcttgttaggaaagtggtagaagaatggacggaaaagataaaagaggagccaagtgtttcggaaaggtctattcgatgggaacttggttcttcttggatgcagcatctgcaaaaacaggaaacttcaaccgatgtcggttccgataacaagaatggaaatgttgagcaagctgtgaaaggtcttggaaatcaatttaaatttttgaagaagagggaaaagaaagcaagtgagttagatggtactgattctagggagccaaataatgacgaattaagtagttctaatgaattggagacactgctttctaaagaagccttttcgcgtatcaaagaatctggatctggtcttcatttgaagtcagtggatgaactcatcaatatggcacacaagttttatgatgaagttgccttgccaaagctggttacggacttcggatcccttgaactttctcctgtcgatggtcgaacgctgactgacttcatgcatttaagaggactaaagatgggatcattgggtgaagtggttaaacttgcagagaatcttccacacatacaatcactttgtattcacgagatgattactcgagcattcaagcatctacttaaagctgttattgcttctgtcaacaatgtagctgatttaccttcagtcattgcatcaacactgaattttttacttggagggtgtcgaactgaagataccgaccaaacatcaggcgatgatcatcgcctcaaaattcattggttacgttcatttttgtctcaaaggtttggatggacattaaaagatgaatttcaacatttgaggaagttatctattctcagaggactatgtcacaaggttggattagaattgttccctagagattatgacatggagtcccctaagccctttggaaagtatgatattatcagtcttgttcctgtctgcaagcatgttgggtgctcttcaatagatgggcgtaatttattggaatcatccaaaattgctcttgataaaggaaagcttgaggatgctgtgagttatgggacaaaggccttagcgaagatgatggctgtttgtggtccatatcatcgaaatactgcaagtgcatatagtcttctcgctgtggttctctaccacacaggagattttaaccaggctaccatttatcagcaaaaagccttggatataaatgaaagagagcttggacttgaccatcctgacacaatgaaaagctacggcgatctttctgttttctattatcgtctgcaacatattgagctggctctgaagtatgttaatcgtgccctattcctccttcatttcacatgtggtctgtctcatccaaatacggctgcaacatatatcaatgtagctatgatggaagaaggcatgggtaatgttcatgtggcccttaggtatctgcatgaagctcttaagtgcaacaaaagattgttgggcgcagatcatatacagactgcagcaagctatcatgccatagccattgctctttcattgatggaagcatattctttgagtgtgcaacatgagcaaactacacttaagatacttcaagcgaagcttggtgcagaagatctccggacacaggacgcggctgcatggctagaatattttgaatcaaaagcaatagagcagcaagaagcagcgaaaaatggaactccaaagacagatacatccattgcaagtaaaggtcaccttagtgtttcagatctcctggattttattagtcctgacaatgattcaaaaggaaatgatgctcaaaggaaacagcggcgtccaaagatacttccaataagtgataacaacggtcaagaacatgatgatgctgctgcaatagcggatgacggtgttttggttgacaacgtaaaagatgtcaaaacaacggtagaaggaaatgtcaatgaaacaaacgccacacatgattccgatgaaccaaaagatattggtggtgatctcagcaggcacaagccagtgacaagcgaagctgtttatgagacgtcgtccgatgaaggttggcaagaagccaattcaaaagggcggtcaggtaacggtgctaaccgcaagtccgggcgcagacaacggcctaatctatcgaagctcagcattcacaaagaaaccagttacaggaatgacactacttccctgccccaaaaaggagctccaaaagtaacttcggctttgttatctccatctagacaatcaaaaacttcgaaagctttgttgtcctcgaaaatctcatcttctccggcatcattgagttcattggcttcaaagtctatatcatacaaagaagtggctgtagcaccaccaggtacagttttaaagccattgttggaaaaaactgaggtagaaaaggtaaacgatgaaaatgagacgcagaaacaagaagcttctattgaaaaatctatagctgaagcagttcaacagcaagatgaaaaagaagtaattcatgatgaatctgaaaaagaaagttctgcatccgaactcgagaaggtttccctttcatctgatcagacaaaacctacagaaacaaatggaagtaagctttcagctgcagccaaaccattcagtccaggaacgttgtctgcgtctcgccatttaaatcccgttcccgtggcaagcatatatgatgcaaatgggagtcaaggaatacttgtggagcctgtgcttcctcctgctgctgcaagggtcccttgtggtcctcgatcaccattgtattacagaaccaactatactttccgcatgaaacatggatcatcgaagataagggaaataagtggatccggcggtccaagaatcatgaatccacatgctcccgagtttgttccaagaagtgcctcccaaatagaaactagtgatgccaattcaaatgtctccagtgatgaaaataagagcagtccttcaaaacacagtctttcggaatctgagaagtcagagatagcaaggcagatattgctgagttttctagtgaaatctgttcatcaaaatgctgatgctgtggatgaggctaaaattactgaaggagaagttgaggatttggaaaattcttctgatgaagtagctaaagacagtgctgtcataaaaataacttatggaactgatgaaaagaacaagacagtggttaattccagtgatgacggtgaagagcaagataaattagacggtgaaggatttgtagttgtaacaaacaggagaaaaagcagacagaaaatcacaaacggagttccagaattgtacaatcagcagtcgatttgtgcttcggttcgttgatcagagtcatgaaatgaatcaccattgctccaaatttgtttgctttgtctggccaaagctcttgacatcataatattgttaatagtatatgacctctttccatagaattttggtcatttaattcattttgatttttgtttatataataagttaattaggtttctcttttgctttctatataataaactttgtcctcatacttggaaattttgttttgtcaataagaagctgattggttcacttcagtcttattgtatggtatcttatattgccatgatagttttgttaaactcataaaattattttccaatgaagttggtgaggatgctacttataccccacaaagttgtggattcaaaattttgtgagaagaatgccgttgtcaaagttctttgaggtctacgttgactctggtaattgaaaggtatatttttgcacttccttgttactagctcaacataataacttgagacacttgaattgctttttgaaatataa

SEQ ID NO: 8898 - DNA, 5263 bp, Cicer arietinum
tttgttctttggttttgccaaaagggtagtgagaaaaaaaataggctccaaaatcagggaaagggaaaacaaataaagctaaggcagagaagaagaaaaaggaagagaaagcagtggcaccttctcttgttgacattacaatagttactccttatgattcacaaattgtattgaagggtatctcaactgataagatacttgatgtgagaaagttattggctgtgaaggtggaaacatgtcattttacaaactattctttatctcatgaggttaaaggtcggagattaaatgacaaagttgaagttgttaccctaaagccatgtgttctaagaatggttgaagagaattactatgaagaggttcaagcagttacacacgtgcgaagactattggatattattgcctgcacaacaaggttcgggaagcccaaacgcaccataacaggcccagaatcaaagcccaagaaaaacggaaaggcccaaaatcaaaacaagagcagcgtgagtccacccgcgacacccaatggagattcccgggtcgggttaccgtcgtcggatccaccggcgtcgccgatttcggataatgtcggaatggtggcgattcatccaacgccgaagttgtcagatttttacgaattcttctctttctctcatctcactcctccgattttacatttgaagaaatgtgaaacgaaggatgaagatgatagacgcaaaggagattactttcagcttcaggttaaaatcagcaatgggaaaatgatagaagttgttgcttcagagaaaggcttttatagtgttggaaagctgtctctacagagtcacacattggttgatcttctgcaacagctcagtagaggtttttcaaatgcctatggatcattgatgaaagctttctcagaccgtaataagtttggcaatcttccatatggactccgatcgaatacatggcttgttcctccgtctgttggcgaatctctttcaaactttccagctctacctgctgaggacgaaaactggggtggtaatggtggtggccagggaagaaacagagcatacgatcttcgaccgtgggcgacagattttgctatattggcttctcttcctagcaaaactgaggaggagagggtgatcagagatcgaaaagcttttcttcttcacagtcagtttgttgatacatcgatatttaaggccgctgcagctatacagcatgtgatggaatccaagtctagtaagaagaatgaaatgaattctgttctgcatcaagatcaagtgggagacttattgattgtagtcaaacacgatgggaatggaaagtttgattctacactgaatgaacccagtaaacaaaatgagcatgttcagaagaatttaattaaagggttgtctgctgatgaaagtgtcaccgttaatgacacttcttccttgaccgttgttgtcgttaaccactgtggatatacagcaacagtaaaggtcgtcggtaatgcaaacgcaaagaagcctaaagttcaagatattgaaatagatgaccaaccagatggtggagcaaatgctcttaacatcaatagtttgagggtattgcttcacaagtctggagctgagttctcagaagggacattaacatccttgtcaaattttgatgacttggatgcttctaaagatcttgttaggaaagtggtagaagaatggacggaaaagataaaagaggagccaagtgtttcggaaaggtctattcgatgggaacttggttcttcttggatgcagcatctgcaaaaacaggaaacttcaaccgatgtcggttccgataacaagaatggaaatgttgagcaagctgtgaaaggtcttggaaatcaatttaaatttttgaagaagagggaaaagaaagcaagtgagttagatggtactgattctagggagccaaataatgacgaattaagtagttctaatgaattggagacactgctttctaaagaagccttttcgcgtatcaaagaatctggatctggtcttcatttgaagtcagtggatgaactcatcaatatggcacacaagttttatgatgaagttgccttgccaaagctggttacggacttcggatcccttgaactttctcctgtcgatggtcgaacgctgactgacttcatgcatttaagaggactaaagatgggatcattgggtgaagtggttaaacttgcagagaatcttccacacatacaatcactttgtattcacgagatgattactcgagcattcaagcatctacttaaagctgttattgcttctgtcaacaatgtagctgatttaccttcagtcattgcatcaacactgaattttttacttggagggtgtcgaactgaagataccgaccaaacatcaggcgatgatcatcgcctcaaaattcattggttacgttcatttttgtctcaaaggtttggatggacattaaaagatgaatttcaacatttgaggaagttatctattctcagaggactatgtcacaaggttggattagaattgttccctagagattatgacatggagtcccctaagccctttggaaagtatgatattatcagtcttgttcctgtctgcaagcatgttgggtgctcttcaatagatgggcgtaatttattggaatcatccaaaattgctcttgataaaggaaagcttgaggatgctgtgagttatgggacaaaggccttagcgaagatgatggctgtttgtggtccatatcatcgaaatactgcaagtgcatatagtcttctcgctgtggttctctaccacacaggagattttaaccaggctaccatttatcagcaaaaagccttggatataaatgaaagagagcttggacttgaccatcctgacacaatgaaaagctacggcgatctttctgttttctattatcgtctgcaacatattgagctggctctgaagtatgttaatcgtgccctattcctccttcatttcacatgtggtctgtctcatccaaatacggctgcaacatatatcaatgtagctatgatggaagaaggcatgggtaatgttcatgtggcccttaggtatctgcatgaagctcttaagtgcaacaaaagattgttgggcgcagatcatatacagactgcagcaagctatcatgccatagccattgctctttcattgatggaagcatattctttgagtgtgcaacatgagcaaactacacttaagatacttcaagcgaagcttggtgcagaagatctccggacacaggacgcggctgcatggctagaatattttgaatcaaaagcaatagagcagcaagaagcagcgaaaaatggaactccaaagacagatacatccattgcaagtaaaggtcaccttagtgtttcagatctcctggattttattagtcctgacaatgattcaaaaggaaatgatgctcaaaggaaacagcggcgtccaaagatacttccaataagtgataacaacggtcaagaacatgatgatgctgctgcaatagcggatgacggtgttttggttgacaacgtaaaagatgtcaaaacaacggtagaaggaaatgtcaatgaaacaaacgccacacatgattccgatgaaccaaaagatattggtggtgatctcagcaggcacaagccagtgacaagcgaagctgtttatgagacgtcgtccgatgaaggttggcaagaagccaattcaaaagggcggtcaggtaacggtgctaaccgcaagtccgggcgcagacaacggcctaatctatcgaagctcagcattcacaaagaaaccagttacaggaatgacactacttccctgccccaaaaaggagctccaaaagtaacttcggctttgttatctccatctagacaatcaaaaacttcgaaagctttgttgtcctcgaaaatctcatcttctccggcatcattgagttcattggcttcaaagtctatatcatacaaagaagtggctgtagcaccaccaggtacagttttaaagccattgttggaaaaaactgaggtagaaaaggtaaacgatgaaaatgagacgcagaaacaagaagcttctattgaaaaatctatagctgaagcagttcaacagcaagatgaaaaagaagtaattcatgatgaatctgaaaaagaaagttctgcatccgaactcgagaaggtttccctttcatctgatcagacaaaacctacagaaacaaatggaagtaagctttcagctgcagccaaaccattcagtccaggaacgttgtctgcgtctcgccatttaaatcccgttcccgtggcaagcatatatgatgcaaatgggagtcaaggaatacttgtggagcctgtgcttcctcctgctgctgcaagggtcccttgtggtcctcgatcaccattgtattacagaaccaactatactttccgcatgaaacatggatcatcgaagataagggaaataagtggatccggcggtccaagaatcatgaatccacatgctcccgagtttgttccaagaagtgcctcccaaatagaaactagtgatgccaattcaaatgtctccagtgatgaaaataagagcagtccttcaaaacacagtctttcggaatctgagaagtcagagatagcaaggcagatattgctgagttttctagtgaaatctgttcatcaaaatgctgatgctgtggatgaggctaaaattactgaaggagaagttgaggatttggaaaattcttctgatgaagtagctaaagacagtgctgtcataaaaataacttatggaactgatgaaaagaacaagacagtggttaattccagtgatgacggtgaagagcaagataaattagacggtgaaggatttgtagttgtaacaaacaggagaaaaagcagacagaaaatcacaaacggagttccagaattgtacaatcagcagtcgatttgtgcttcggttcgttgatcagagtcatgaaatgaatcaccattgctccaaatttgtttgctttgtctggccaaagctcttgacatcataatattgttaatagtatatgacctctttccatagaattttggtcatttaattcattttgatttttgtttatataataagttaattaggtttctcttttgctttctatataataaactttgtcctcatacttggaaattttgttttgtcaataagaagctgattggttcacttaaacaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 8899 - DNA, 1897 bp, Saccharum officinarum
cgcgttcccgtgccgtctgctgacatcagccaagcagccgagaaccgaagacagagagaagagaaactccagccgccgagctcacccgccgcgaccgggaccggcaaagatggccgacggcagcgcctccgcctcgccgccctccttttctccgcaccagtaccaccgcgacgccatcaagtcctcagtgcgcaatacagctgctaatcggaggagggagcaggctcttgcaatagggaaggaaagaagggaagctttgatgcgtgcaaagcgtgtatgtcgagctcctctttccggcagtgatgaggctgtagcagaagacggtgacatggttattgatgaggggaaagcagatcttgaggctagaacgactcaggctgttgaggaactgaaatctgctttgtcaagccagggaaaaggggcacagaagaggaagatagaggtgcttcgtgctttaaggcgtttgttgtctcagtctgaagtacctccagttgatgctgcaattaaagctggagcagtccctctgttagtgcagtatctgtcgtttggatcatcagatgaacaattgctagaggcagcttggtgccttacaaacatagcggccggggaacctgaggaaactaaatccttacttcctgctctaccattgctcattgctcaccttggtgagaagagctccacacttgtcgcggaacaatgtgcatgggccattggtaatgttgctggtgaaggagcagagctgagaagcacattacttgctcaaggtgctttgtggcctcttgcccgtttaatgatgtcaaataagggttctacagcaagaactgctgcttgggcattgtcaaatctcatcaagggacctgattctaaggctgcgaatgagcttattggcatcaacggcgtactgaatgcaatcacacggaacttggaaaaagcggatgaagaacttgcaactgaggtggcatgggtagttgtctatctttcagcactttcagaaaaagctaccagcctaatagtaagaagttcggtgccacagttgctgatcgggcgccttctagcatctgaaaacttgcagttgctcattccggtacttcgcggtttaggaaatcttgtagctggtgatggttacatggttgattcagtcctaattgttggaaacagtgtcacagatcaagccttatcaagtcttataaaatgtttgaagagcgacaatagggttctcaagaaggaggcatcatgggctatgtcaaatatagcagcaggcagtttcgagcataagaaactgatatttgctagtgaggcgactcctttgctgatgcacctcctcaggactgcacaatttgacatccgcagggaagcagcatacaccctgggcaatctgtgtgttgtgccagcaggcagtggtaatcccccaaacataatcattgaacatttagttgctatcgtagatggtggagcccttccaggatttataaatttggtgagatcagctgatatagagagtgcgagacttgggcttcagttcctggaactggtgatgagaggataccccaacagccagggtccaaagctcgtggaggcagaggacggcatcgaggctatggagaggttccagttccatgagaacgaggtcatgaggactatggccaatggtttggttgataaatactttggtgaagactatggcctcgagtgagttccttgtgccgcgctgatacatctgggtaaacatcgtagagctgttcgtgggtttgaaatgtaacagtgctagaacagaaggatgcccgttcatcatggtaaccatgtaatttagcccttgattctgtagttggaaatgtgaatgtgttgagtgtgaaactgaccgtgagctatagaagtatggatagtggaaaccgtcgat

SEQ ID NO: 8900 - DNA, 5625 bp, Setaria italica
catgaaattagtatttgttgcttacttgcttccactttactctcggcccgagtctccaaatccgggcagaggggagacgacgggaagaaaaactcgaagacgcagccgacgagctccgccgccggagctcagagatggacgacggaagcgcctccgcctcgccgtcctccgcttctccgcaccagcaccaccgcgacgcaatcaagtcctcagtgcacaattcagcatctagccggaggagggaacatgctattgcagtagggaaggaaagaagggaagccttgatgcgtgcaaagcgtgtatgtcgggctcctctttctggcaatgatgagactgtgatggaagagggcgatatggtcattgatgagaagaaggcagatcttgaggcacagacagctcaagctgttgaagaactgaaatctgctttatctacccagggaaaaggggctcagaagaagaagatagaggtgcttcgtgctttaagacgattattgtcacagtctgaagtacctcctgttgaagcagcaattaaagctggagcgatccctcttctagtgcaatatctgtcatttggatcatcagatgaacagttgctagaggcagcttggtgccttacaaatatagcagcaggggaaccagaagaaactaagtctttattgcctgctctaccattgctcattgctcaccttggtgagaagagctccacccttgttgctgagcaatgtgcatgggccattggtaatgttgctggtgaaggagcagacctgagaagcaaattacttgctcaaggtgctttgtggcctcttgcccgtttaatgctgtcaaacaagggttctacagcaaggactgcggcttgggcattgtcaaatcttatcaaggggcctgatcccaaggctgcgaatgagcttattagcattgatggtgtgctgaatgcaatcataaggaacttggagaaagcggatgaagagctagcaactgaggtggcgtgggtagttgtttatctttcagcactttcagaaaaagctaccagcctaatagtaagaagttctgtgccacaattgttgattggacgcctcctagcatcagagaacttgcaattgctcattccggtacttcgcagtttaggaaatcttgtagctggtgatggatacatggttgattcagtcctaactgttggaaacagtatcacagatcaagccttatcgagtcttataaagtgtttgaagagtgacaatagggttctcaaaaaggaggcatcatgggccatgtcaaatattgcagcaggcagtttcgagcacaagaaattgatttttgccagtgaggcaatgactttgctgatgcacctccttacgactgcacaattcgacatccgcagggaagcggcatacaccctgggcaatatgtgtgttgtcccagcaggaaatgctgcgcctccaaacataattgtggatcatttggtcgctatcgtaaatggtggagcccttcctggatttataaatttggtgagatctgctgatatagaaagtgcgagacttgggcttcaattcctcgaactggtgatgagggggtaccccaatgggcaaggtccgaagctcgtggagagcgaggacggcatcgaggctatggagaggtttcagttccatgagaacgagctgatgaggaatatggccaacgggttggtcgacaaatactttggcgaagactatggcctcgagtgagttcctggtgccatgcatacatctgcgtaaacttgaagctcttgatgggttgaaaatgtgaattgtgaaatgtactctcacggtcctcgaacagaaggatgtgctgatcagatcggtggccatgtaacttagcccttgataccaatgcatcggatgcctgtagttggaaaatgtgagtgcgtgaagcgtgaactgactatgaactaaggatatgctggtaaactgtcgatatgcatcgctttggcatgttgtacgatatacaagtgctgaaataaaaatgatctgctgtttcccgtgtcttgcgggccatttgcccaggtaacttaaaatatgaacaaactgttgctgaacaaaatatggacaaactgaacaagcagcctagcggtggtgtgatttctcaccaactcaacagttcaccatagttacagcagtagaacacttttatctttctagatcaaaaatcgctagtactaatttgaagctgaactaaacacgagtcatcagaagctacgacgcggaggctttcgtcttgctcttgtccctcgcgcgcatttcgtcgagcacgtccctggcgggcggcgagatggtggcctcccactcggcgaggtccgcctccgccaacgcggcctcctcgtcgagccccagcctcctcatccccctcgccatcaccctgtacacgtactcgtccacgtcgaggcctccctccctgaccgccgcctcgtacaccttccacgccgcgcgtcccctgtccctcgccaccagcgcgcgcagcagcctggtgagcttgtacacgtcctcctccccgtccacgaacccgccgccgcgcgccttctcctccaggaacgcctccacgagcgcgtccacggcggcgcccgcttcgtcgtcgccgccggaggccgccgccgccggcgcggaggagacgaaggtggcgtagagcgccgggtccgggcggtaccagggctcgccgcgcgcgacgtggagcgcggcgagggcgagggaccagtggccctggcgctggagctcggccatggcggccacgaggtcggccttgaggaggcggccgagcgcggacgcggccgccgcggaggccgccgcaggggagcggtccgcggcggtgaggcgcttcagggattggatgcccaggatggcctccgtggagagggaccgcccccgctggagcgggccccggttgtcccgcgggccgcaggtgatgattgagaccgtcctgggccgcgccgtgggcgccggcgctgggcgcgagcccggcgtggggcgcgggacgaagaggagggacgccattggagtggacggaagcgaggaagcggaaggggaagagaggagaggagatgggtttctgatgggattttgacgacgggctgggagccgtccgatccttctcaatattcgcgcgccatgatacgaagtggggtccgcatggcaggtccgtcaggggcattattctcctctcgcctgccaggaaattaaaaaaaatatcatggcaatcactcagctcagctgagctgacgaagcagcagcagccaaccaaccaccgggagaaaagcaaccaaccagtccatgcctcccacgcttccccgattccaagcactagtcagctgccattccgttccatccattggctatttggctccaccccctcccccactcctcatcactctccgtgctctgctctgctctgctgatctgctcgaatcggcgcgggttccagttgacacgccgcgagcgccaatggcggccgccgcggtcctggttgcagtactggcgctgtcctgccgcgcggcgtccggcatggctacggcagctgtgacggcggaggcggaggcagaccgcatcgcgagcctgccgggccagccgccggtcaagttctccatgtactccgggtatgtcaccgtcgacgcggccgcggggcgggcgctcttctactggctcatcgaggcggccggcgcgcccgcggcgtccgcgccgctcgtactctggctcaacggcgggcccgggtgctcctccgtcggctacggcgcgtccgaggagctcggcgccttccggatcaaccccgacggcaggtcgctctccaggaacccctacccctggaacaaagtggccaacatgctgttcctggactcgccggccggcgtcggctactcctactccaacaccaccgccgatctgtacaccgccggagacaacaagacagctcatgatgcgtacaatttcttggtgaattggttggagcggtttccgcagtacaagcatcgcgatttctacatcacaggagagagctacgcaggtcactatgtgcctcagctgtctcagctagtatacgagaacaacaaaggaattgaaaagccaatcctaaatttcaaaggcttcatggttgggaatgcggtaattgacgattaccatgactacattggcacatttgagtactggtggacgcatgggcttatctccgatgaaacctatcagaagttgcggttggcctgtgaatttgattcagcagagcacccctctaaggagtgcaacaagatcaatgatattgctgaagcagagcatgggagtattgacgcatacagcatctacacgcccacttgtaagaagacttcacttcataagcgcaggcaaataaggggaagaacgccctggttgccgagaggatatgatccctgcaccgaaaagtactccgaaaagtactacaacttacccgaggtgcagaaagctttacatgccaatgtcactggaataccgtatgcctgggtagcctgcagtgatccaatttatgactactggaaagattcaccgaagtccatgcttcctatttatcgtgaacttatcgcggcaggcataaggatatgggtcttcagtggtgatgctgattccgttgtccccctcaccgcgacaagatactccattgatgcgctctctctaccaacagtgacaaactggtatccttggtatgacaatggagaggttggtggatggtgccaagtgtacaagggcttgacactggtaacagtccgcggtgcagggcacgaggttgccctccaccgtccacggcaaggcctgaagctattcgagcacttcctgcgcgatgagcccatgtccaaggctgtagatagcattcaaacgttttagaatgtgctatctcgattgatggagaagaaaaaacaggctgcgtcaagccatgtagttgtaaaagccatggtgaacgcatttcgcctgcgcaataaatcgacgtcgatcggccgtcacatctttgcctttcggatttcttgcgtacatgcaattcctttccagaggaacggcaaaaactacgaaattcctgcaaaaaaatccttcgatccaaacagggcaaattcgcaatgtagtttcgtttcaagctgcacgagaacatgtgtaccaatcacgattcgtctcggactgcgctaggcaaggtagcacagcagcattcccattcggccattccacgccttccacgcttccccgaatcctcagctaccaccattccgttccattccattggctccccactccaagaccacccctccatttgctctgctgctcttatccaatcagcgctcctccattgacccaccgcgagcgccaaatcgccaatggcggccgccgcggccgcggccctggccgccgtactggcgctgtcctgctgtaacgtcgcgtcggccacggcggaggcggaggcggaccgcatcgcgagcctgccggggcagccgccggtcaacttctccatgtactccgggtacgtcaccgtcgacgcggccgcggggcgggcgctcttctactggctcatcgaggcggccggcgtgcccccggagtccgcgccgctcgtgctctggctcaacggcgggcccgggtgctcctccgtcggctacggcgc

SEQ ID NO: 8901 - DNA, 2188 bp, Sorghum bicolor
taaataggcctataatgtgtgtgtgtgtttttttttatagtgggcctagaatgtgttgacccacaatagcgaaggcaccatgcccgtttccgtcccgtttgcttacatcaccaagcagccgaggaccagagtcagagagaagaaaaactccagccgccgagctcagccgccgcgaccgggaccggggaagatggccgacggcagcgcctccgcgtcgccgccctccgtttctccgcaccaccagtaccaccgcgacgccatcaagtcctcagtgcgcaatacagctgctaaccggaggagggagcaggctcttgcaatagggaaggaaagaagggaagctttgatgcgtgcaaagcgtgtgtgtcgagctcctctttctggcagtgatgaggctgcagcagaagatggtgacatggttactgatgaggggaaagcagatcttgaggctagaacgactcaggctgttgaggaactgaaatctgctttgtcaagccagggaaaaggggcacagaagaggaagacagaggtgcttcgtgctttaaggcgtttgttgtctcaatctgaagtacctccagttgatgctgcaattaaagctggagcagtccctctgttagtgcagtatctgtcatttggatcatcagatgaacaattgctagaggcagcttggtgccttacaaacatagcggcaggggaacctgaagaaactaaatccttacttcctgctctaccattgctcattgctcaccttggtgagaagagctccacacttgtcgcggaacaatgtgcatgggccattggtaatgttgctggtgaaggagcagaactgagaagtacattacttgctcaaggtgctttgtggcctcttgcccgtttaatgctgtcaaataagggttctacagcaagaactgctgcttgggcattgtcaaatctcataaaggggcctgattccaaggctgcgaatgagcttattggcattgacggcgtactgaatgcaatcacacggaacttggaaaaagcggatgaagaacttgctactgaggtggcatgggtagtggtctatctttcagcactttcagaaaaagctaccagccaaatagtaagaagttctgtgccactgttgctgatcgggcgccttctagcatctgaaaacttgcagctcctcattccggtacttcgcggtttaggaaatcttgtagctggtgacggttacatggttgattcagtcctaactgttggaaacagtgtcacagatcaagccttggcaagtcttatcaagtgtttgaagagcgacaatagggttctcaagaaggaggcatcatgggccatgtcaaatgtagcagcaggcagtttcgagcataagaaactgatatttgctagtgaggcgactcctttgctgatgcacctcctcaggactgcacaatttgacatccgcagggaagcagcatacaccctgggcaatctgtgtgttgtgccagcaggcagtggtaaccccccaaacataatcgttgatcacttagttgctatcgtagatggtggaggccttccaggatttataaatctggtgaggtcagctgatatagagagtgccagacttgggcttcagttcctggaactggtgatgagaggataccccaacaatcaaggtccaaagcttgtggagagggaggatggcatcgaggctatggagaggttccagttccatgagaacgaggtgatgaggaatatggccaatggtttggttgacaaatactttggtgaagactacggtctcgagtgagttccttgtgccccgctgatacatctgggtaaacatcgacatcgtagagctgttcgttggtttgaattgtaacagtgctagaacagaaggatgcccgttcatcatggttaccatggaatttagtccttgatatgtagctggaaatgtgaatgtgttgagtgtgaaactgaccgtgagctggaaatgtgaagtatggataggggaaaacgtcgacagactttgacatcttgtacaatacgaaataaatagcctggctgttttctttctcttgcggccatttgccaatccaaatttgaaatttaaacagattgctgcaacagcaagttgtaagggtgtatgtgctgcaactgcaatgatcatctgctaaacacatgcttttattctgtaatggatggccgtatgatttctaga

SEQ ID NO: 8902 - DNA, 2094 bp, Sorghum bicolor
gcccgtttccgtcccgtttgcttacatcaccaagcagccgaggaccagaatcagagagaagaaaaactccagccgccgagctcagccgccgcgaccgggaccggggaagatggccgacggcagcgcctccgcctcgccgccctccgtttctccgcaccaccagtaccaccgcgacgccatcaagtcctcagtgcgcaatacagctgctaaccggaggagggagcaggctcttgcaatagggaaggaaagaagggaagctttgatgcgtgcaaagcgtgtgtgtcgagctcctctttctggcagtgatgaggctgcagcagaagatggtgacatggttattgatgaggggaaagcagatcttgaggctagaacgactcaggctgttgaggaactgaaatctgctttgtcaagccagggaaaaggggcacagaagaggaagacagaggtgcttcgtgctttaaggcgtttgttgtctcaatctgaagtacctccagttgatgctgcaattaaagctggagcagtccctctgttagtgcagtatctgtcatttggatcatcagatgaacaattgctagaggcagcttggtgccttacaaacatagcggcaggggaacctgaagaaactaaatccttacttcctgctctaccattgctcattgctcaccttggtgagaagagctccacacttgtcgcggaacaatgtgcatgggccattggtaatgttgctggtgaaggagcagaactgagaagtacattacttgctcaaggtgctttgtggcctcttgcccgtttaatgctgtcaaataagggttctacagcaagaactgctgcttgggcattgtcaaatctcataaaggggcctgattccaaggctgtgaatgagcttattggcattgacggcgtactgaatgcaatcacacggaacttggaaaaagcggatgaagaacttgctactgaggtggcatgggtagtggtctatctttcagcactttcagaaaaagctaccagccaaatagtaagaagttctgtgccactgttgctgatcgggcgccttctagcatctgaaaacttgcagctcctcattccggtacttcgcggtttaggaaatcttgtagctggtgacggttacatggttgattcagtcctaactgttggaaacagtgtcacagatcaagccttggcaagtcttatcaagtgtttgaagagcgacaatagggttctcaagaaggaggcatcatgggccatgtcaaatgtagcagcaggcagtttcgagcataagaaactgatatttgctagtgaggcgactcctttgctgatgcacctcctcaggactgcacaatttgacatccgcagggaagcagcatacaccctgggcaatctgtgtgttgtgccagcaggcagtggtaaccccccaaacataatcgttgatcacttagttgctatcgtagatggtggaggccttccaggatttataaatctggtgaggtcagctgatatagagagtgccagacttgggcttcagttcctggaactggtgatgagaggataccccaacaatcaaggtccaaagcttgtggagagggaggatggcatcgaggctatggagaggttccagttccatgagaacgaggtgatgaggaatatggccaatggtttggttgacaaatactttggtgaagactacggtctcgagtgagttccttgtgccccgctgatacatctgggtaaacatcgacatcgtagagctgttcgttggtttgaattgtaacagtgctagaacagaaggatgcccgttcatcatggttaccatggaatttagtccttgatatgtagctggaaatgtgaatgtgttgagtgtgaaactgaccgtgagctggaaatgtgaagtatggataggggaaaacgtcgacagactttgacatcttgtacaatacgaaataaatagcctggctgttttctttctcttgcggccatttgccaatccaaatttgaaatttaaacagattgctgcaacagcaagttgtaagggtgtatgtgctgcaactgcaatgatcatctgctaaacacatgcttttattctgtaatggatggccg

SEQ ID NO: 8903 - DNA, 2179 bp, Triticum aestivum
cctgtccccttagttcccgttggtccgtttggccgttaggtctacgtcgtactaggaacggacgggccgaccgacgacgtaggttagtatacgacagagtacgcgggcggacgtacggtcttgcttagtctccgccccgtccccggtttggtccgttcctatcatcaccgagcctcgcagccgtcgagctccgccgccgtaaacgatggccgacggcaacgcccccggctcgccggcttcttcgctccagagccaccgctacgccatcaaatcctcagtgcacaatacggcagctagccggaggcgtgaacaggctatagcaatagggaaggaaagaagggaagccttaatgcgtgcaaagcgtgtgtgccgtgccccactttctggcagcgatgaggctacaattgaagatggtgatatggttattgacgagaaagcagatcttgaaacaagaactgctcaagctgttgaagaattgaaatcagctttgtcaagccagggaaaaggggcccagaagaagaagatagaggcacttcgtgcagtgagacgcgtgttgtcacagtctgaagtacctcccattcaagtagcaattaaagctggggcagttcctcttttagtgcaatatatgtcctttggatcttcagatgaacagttgctagaggctgcttggtgccttacgaacatagcagctggggagccagaagaaacaaaatccgtgctgcccgcattaccattgcttgttgctcaccttggtgagaagagctccacacttgttgctgagcaatgtgcatgggccatcggtaatgttgctggtgaaggagcagacctgagaagcacattaattgcacagggtgctttgtggcctcttgcccgcctaatgctatcaagcaagggttctacagcaagaactgctgcttgggcattgtcaaatctcatcaaggggcctgatcccaaggctgcgtatgagcttattaacatcgatggtgtgctaaatgcgatcataaggaacttggaaaaggcggacgaagagttagcaactgaggtggcatgggtagtggtatatctttcagcactttcagaaaaagctatcagcttaatagtacgaagccatgtgcctcagttgctgattggacgcctgctggcatctgagaacttgcagttgctcattccggtgcttcgtggtttagggaatcttgtagccggggatgaatacatggttgattcaatcctaattgttggaaacagcatcacagatcaagctttatcaagtctcataaaatgtttgaagagtgacaatagggttctcagaaaggaggcttcatgggcattgtcaaatatagcagcaggcagctttgagcacaagaaattgatttttaccagtgaggcgacgccttcgctaatacacctcctgacgagtgcacagtttgacattcgcaaggaagcagcttacaccctgggcaatctgtgtgttgtcccagcaggaagtaccgagcccccgaacataatcaccgaacatctagtctcgatcataaatggtggagcccttccaggattcataaatttggtcaggtctgctgatatagagagcgcaagacttggacttcagttcctggaactggtgatgagggggtatcccaatggacagggtccacagcttgtggagaggggggatggcatcgaggccatggagaggttccagttccacgagaacgaggcgatgaggaacatggccaatgggctggtcgacaaatacttcggcgaggattacggcctcgagtgagcggcgactgtggccgccaatcctgcatctgtttgtgaacccagcagcagctgctcgtgtactcaaactgtaaaatgcaacttttttgtaaccgtggaatgtatacaagactgtctgaggtagcgtagttgctgtgtaacttggccatcttcatggatgtgtgtggcgatggggctgttgtagctggaagcttgaagtgagctgggtagctaccgtagtacagtgtgacctgtgtaagaagagaagattttgagtctttgagctatatattgtactagagaaatgctgttcaaactcttgctgaaaaccgttgcgactagctttgcataaaaagaaaagtaccgactgcgtgggcccgctcgtctagagactcgaccgacggacgacacgaggagaggg

SEQ ID NO: 8904 - DNA, 2121 bp, Zea mays
gtagatttttttttatatatatagcgggtctaaaatgtattttttcttatagcgggcctagaacgtgttgacccacaatagagaaaggcaccactgccgtttccgtcccgtttgcttacgtcaccaagccgccgagaaccagagacagacagagaagaaaaactgcagccgccgagctcagcctcagccgccgcgacggggacagggaaagatggccgacggcagtgcctccgcctcgccgccttccgtttctccgcaccagtaccaccgcgacgccatcaagtcctcagtgcgtaatacagctgctaataggaggagggaacatgccattgcaatagggaaagaaagaagggaagccttgatgcgtgcaaagcgtgtatgccgagctcctctttctggcagtgatgaggctgcaggagaagagggtgacatggttgttgatgaggagaaagcagatcttgagactagaacgactcaggctgttgaggagctgaaatctgctttgtcaagccagggaaaaggtgcacagaataggaagacagaagtgcttcgtgctttaaggcgtttgttgtcccagtctgaagtacctccagttgatgcagcaattaaagctggagcagtccctctattagtgcagtctctgtcatttggatcgccagatgaacaattgctagaggcagcttggtgccttacaaacatagcggcagggaaacctgaggaaactaaatccttacttcctgctctaccattgctcattgctcaccttggtgagaacagctctacacttgtcgcggaacaatgtgcatgggccattggtaatgttgctggtgaaggagcagagctgagaaacacattacttgctcaaggtgctttgtggcctcttgcccgtttaatgctgtcaaataagggttccacaacaaggactgctgcttgggcattgtcaaatctcatcaaggggcctgattccaaggctgcgaatgaacttattggtatcgacggcatactgaatgcaatcattcggaacttggaaaaggcggatgaagaacttgtaactgaggtggcatgggtggttgtctatctttcagcactttcagaaaaagctaccagcctaatagtaagaagttcgatgccacagttgctgatcgggcgccttctagcatctgaaaacttgcagttgctcattccggtacttcgcggtttaggaaatcttgtagccggtgatggttacatggttgattcagtccttattgttggaaacagtgtaacagatcaagccttatcaagtcttatcaagtgtttgaagagcgaccatagggttctcaagaaggaggcatcatgggccatgtcaaatatagcagcgggcagttttgagcacaagaaactgatatttgctagtgaggcgactcctttgctgatgcacctcctcaggactgcacagtttgacatccgcagggaagcagcatacacgctgggcaacctgtgtgttgtcccagcaggcagtggtaaccccccaactataatcgttgagcatttagttgccatcgtagatggtggagcccttccaggatttataaatttggtgaggtcggccgatatagagagtgcgagacttgggcttcagttcctggaactggtgatgagaggataccctgacagccagggcccaaagctcgtggagacagaggacggcattgaggccatggagaggttccagttccatgagaacgagatgatgaggaatatggcgaatggtttggttgataaatactttggcgaagactatggcctgtgagttgtgccgccgatacatctgggtaaacgtggagctatttgtgggtttgaaatgtaacgatcctggaacagaaggatgcgccgttcatcatggtttccatgtaatttagcccctaatatatagctggaaatgtgaatgtgttgaaactgaccgtgagctggagatgttaagtgtggataccttagatagacatagactgacatcttgcacagtgcttcctctatctcaaaatattttttcgtctcgtattttaagtgtggaaatgttggagatgctcttagagtacaaatatatgactgattaatctgatgatgtttataatgtaccat

SEQ ID NO: 8905 - DNA, 2017 bp, Zea mays
gtcccgtttgcttacgtcaccaagccgccgagaaccagagacagacagagaagaaaaactgcagccgccgagctcagcctcagccgccgcgacggggacagggaaagatggccgacggcagtgcctccgcctcgccgccttccgtttctccgcaccagtaccaccgcgacgccatcaagtcctcagtgcgtaatacagctgctaataggaggagggaacatgccattgcaatagggaaggaaagaagggaagccttgatgcgtgcaaagcgtgtatgccgagctcctctttctggcagtgatgaggctgcagcagaagagggtgacatggttgttgatgaggagaaagcagatcttgagactagaacgactcaggctgttgaggagctgaaatctgctttgtcaagccagggaaaaggtgcacagaataggaagacagaagtgcttcgtgctttaaggcgtttgttgtcccagtctgaagtacctccagttgatgcagcaattaaagctggagcagtccctctattagtgcagtctctgtcatttggatcgccagatgaacaattgctagaggcagcttggtgccttacaaacatagcggcagggaaacctgaggaaactaaatccttacttcctgctctaccattgctcattgctcaccttggtgagaacagctctacacttgtcgcggaacaatgtgcatgggccattggtaatgttgctggtgaaggagcagagctgagaaacacattacttgctcaaggtgctttgtggcctcttgcccgtttaatgctgtcaaataagggttccacaacaaggactgctgcttgggcattgtcaaatctcatcaaggggcctgattccaaggctgcgaatgaacttattggtatcgacggcatactgaatgcaatcattcggaacttggaaaaggcggatgaagaacttgcaactgaggtggcatgggtggttgtctatctttcagcactttcagaaaaagctaccagcctaatagtaagaagttcgatgccacagttgctgatcgggcgccttctagcatctgaaaacttgcagttgctcattccggtacttcgcggtttaggaaatcttgtagctggtgatggttacatggttgattcagtcctaattgttggaaacagtgtaacagatcaagccttatcaagtcttatcaagtgtttgaagagcgaccatagggttctcaagaaggaggcatcatgggccatgtcaaatatagcagcgggcagttttgagcacaagaaactgatatttggtagtgaggcgactcctttgctgatgcacctcctcaggactgcacagtttgacatccgcagggaagcagcatacacgctgggcaacctgtgtgttgtcccagcaggcagtggtaaccccccaagtataatcgttgagcatttagttgccatcgtagatggtggagcccttccaggatttataaatttggtgaggtcggccgatatagagagtgcgagacttgggcttcagttcctggaactggtgatgagaggataccctgacagccagggcccaaagctcgtggagacagaggacggcattgaggccatggagaggttccagttccatgagaacgagatgatgaggaatatggcgaatggtttggttgataaatactttggcgaagactatggcctgtgagttgtgccgccgatacatctgggtaaacgtggagctatttgtgggtttgaaatgtaacgatcctggaacagaaggatgcgccgttcatcatggtttccatgtaatttagcccctaatatatagctggaaatgtgaatgtgttgaaactgaccgtgagctggagatgttaagtgtggataccttagatagacatagactgacatcttgcacagtgcttcctctatctcaaaatattttttcgtctcgtattttaagtgtggaaatgttggagatgctcttagagtacaaatatatgactgattaatctgatgatgtttataatgtaccat

SEQ ID NO: 8906 - DNA, 1975 bp, Pennisetum glaucum
gagatcaaccaagaaatcgctcgggaaagaggtggagacgacgcgaaggaaagaaaactcgaagacgcagccgacaagctccgccgccggaattcagagatggccgacggaggcgcctccgcctcgccgtcctccgctactccgcaccagcaccaccgcgacgccctcaagtcctcagtgcacaattcagcgtctagccggaggagggaacatgctattgcagtagggaaggaaagaagggaagccttgatgcgtgcaaagcgtgtatgtcgtggcgatgatgagactctcatggaagagggtgatatggccattgatgagaagaaggcggatcttgaggcacggacagctcaagctgttgaagaactgaaatctgctttatcaacccaggggaaaggggctcagaagaagaagatagaggtgcttcgcgctttaagacgattattgtcacagtccgaagttcctcctgttgaagcagcaatcaaatctggagcgatccctcttctagtgcaatatctggcatttggatcatcagatgaacagttgctagaggcagcttggtgccttacaaatatagcagcaggggaaccagaagaaactaagtctttattgcctgcgctaccattgctcattgctcatcttggtgagaagagctccacccttgttgctgagcaatgtgcatgggccattggtaatgttgctggtgaaggagcagacctgagaagcaaattacttgctcaaggtgctttgtggcctcttgcccgtttaatgctgtcaaacaagggttctacatcaaggactgcggcttgggcattgtcaaatcttatcaaggggcctgatcccaaggctgcgaatgagcttattagcattgatggtgtgctgaatgcaatcataaggaacttggagaaagcggatgaagagctagcaactgaggtggcgtgggtagttgtttatctttcagcactttcagaaaaagctaccagcctaatagtaagaagttctgtgccacaattgttgattggacgcctcctagcatcggagaacttgcagttgctcattccggtacttcgcagtttagggaatcttgtagctggtgatggatacatggttgattcagtcctaactgttggaaacagtatcacagatcaagccttatcgagtcttataaagtgtttgaagagtgacaatagggttctcaaaaaggaggcatcatgggccatgtcaaatattgcagcaggcagtttggatcacaagaaattgatttttgccagtgaggcaaggacctggttgatttacctccttacgactgcacaattcgacatccgcagggaagcagcatacaccctgggcaatctgtgtgttgtcccagcaggaaatgctgcgcctccaaacataattgtggatcatttggtcgctatcgtgaatggtggagcccttcctggatttataaatttggtgagatctgctgacatagagagcgcgaggcttgggcttcagtttctggaactggtgatgaggggatacccagatgggcaaggtccaaagctagtggagaatggggacggcatcgaggctatggagaggtttcagttccatgagaatgagctgatgaggaatatggccaatgggttggtcgacaaatatttcggcgaagactatggcctcgagtgacttcctgtgtaaatttgaagctcttgatgggttgaaaatgtggattgtgaaatgtactctcactgtcctcgaacagaagatgtgttgatcagtcggcggcaatgtaattttagcccttgaggccttgataccaatccatcaggtgctgtagttggaaaatgtgagtgtggatgctgtagttggaaaatgtgtgtgtgaagcgtgaactgactagagtatgaactaaggatagtgccagtaaactgtctatatcgatatgcatttgctttggcgtgtaaagtgctgaaataaaatagacatttgc

SEQ ID NO: 8907 - DNA, 2017 bp, Hordeum vulgare
ataataaaactgaactatctcgaacccggcccaccgtacggtcttgcttagtctccgccccgtccccggtttggtccgttcctatcatcaccgagcctcgcagccgtcgagctccgccgccgtaaacgatggccgacggcaacgcccccggctcgccggcttcttcgctacagagccaccgctacgccatcaagtcctcagtgcacaatacggcagctagccggaggcgtgaacaggctatagcaatagggaaggaaagaagggaagccttaatgcgtgcaaagcgtgtgtgccgtgccccactttctggcaacgatgaggctacaattgaagatggagatatggttattgatgagaaagcagatattgaaacaagaactgctcaagctgttgaagaattgaaatcagctttgtcaagccagggaaaaggagcccagaagaagaagatagaggcacttcgtgcagtgagacgtgtgttgtcacagtctgtagtacctcccattcaagtagcaatcaaagctggggcagttcctcttctagtgcaatatctgtcctttggatcttcagatgaacagttgctagaggctgcttggtgccttacaaacatagcagctggggagccagaagaaacaaaatccgtgctgcccgcattaccattgcttgttgctcaccttggtgagaagagctccacacttgttgctgagcaatgtgcatgggccatcggtaatgttgctggtgaaggagcagacctgagaagcactttaatcgcacagggtgctttgtggcctcttgcccgcctaatgctatcaagcaagggttctacagcaagaactgctgcttgggcattgtcaaatctcatcaaggggcctgatccgaaggctgcgtatgagcttattaacatcgatggtgtgctaaatgcaatcataaggaacttggaaaaggcggacgaagagttagcaactgaggtggcatgggtggtggtatatctttcagcactttcagaaaaagctatcagcttaatagtacgaagccatgtgcctcagttgctgattggacgcctgctggcatctgagaacttgcagttgctcattccggtgcttcgtggtttagggaatcttgtagccggggatgaatacatggttaattcaatcctaattgttggaaacagcatcacagatcaagctttatcaagtcttataaaatgtttgaagagtgacaatagggttctcagaaaggaggcttcatgggcattgtcaaatatagcagcaggcagctttgagcacaagaaattgattttcaccagtgaggcgacaccttcgctaatacacctcctgacgagtgcacagtttgacattcgcaaggaagcagcttacaccctgggcaatctgtgtgttgttccagcaggaagtactgagcccccgaacataatcaccgaacatctagtctcgatcataaatggtggagccctcccaggattcataaatttggtcaggtctgctgatatagagagcgcaagactcggtcttcagttcctggaactggtgatgagggggtatcccaatggacagggtccacagcttgtggagaggggggacggcatcgaggccatggagaggttccagttccatgagaacgaggcgatgaggaacatggccaatgggctggtcgacaaatacttcggtgaggattacggcctcgagtgagcggtgactaccgccgcctcgccaatcttgcatctgtttgtgaacccagcagcagctgctcgtgtactcaaactgtaaaatgcaacttttttgtaatcgtggaatgtatacaagactgtctgaggtagcgtagttgctgtgtaacttggccatcgccatggacgtgtgtggcgatgcggttgttgtagctggaagcttgaagtgagctgggtagctaccgtagtacagtgtgacctgtataagaagaaaagattttgagtttttgagttatactccctctatacctaaatattgttagttagggaaaattagtc

SEQ ID NO: 8908 - DNA, 1917 bp, Brachypodium distachyon
ggagatggtctaaccgagcaatctcgagctgggcccactctacggtcttgcttactcggtcttctccccgtcccgtcccgtttggttccaaccatcgccgagctcccgccgccgtaaaagatggccgacggcaacaccccggcctcgccgcctcccgcttctccgctccagaggcaccgctacgccatcaagtcctcagtgcacaataccgcagctagccggaggcgggaacaggctatcgcaatagggaaggaaagaagggaagccttgatccgtgcaaagcgcgtgtgccgcaccccgctttctggtagcgatgatgctggcattgaggaggatgatatggttgttgataaggagaaagaaggtcttgaagcaagaactgctcaagctgttgaagaattgaaatcagctttgtcaagccaggggaaaggggcccagaagaagaagacagaggtgcttcgtgctttgagacgcttgctgtcacagtctgaagtacctccaattgaagcagcaattaaagctggagcagttcctcttttggtacaatatctgtctttcggatcttcagatgaacagttgctagaggccgcttggtgccttacaaacatagcagctggggaaccagaagaaacaaaatcgttgctgcccgcattaccattgcttgttgctcaccttggtgaaaagagctccacacttgttgctgagcaatgtgcgtgggccattggcaatgttgctggtgaaggagcagatctgagaagcacattactcgcacagggtgctttgtggcctcttgcccgcttaatgctgtcaagcaagggttcggcagcaagaactgctgcatgggcattgtcaaatctcatcaaggggcctgatcccaaggctgtgaatgagcttattggcatcgagggtgtgctaaatgcgatcgtacagaacttggaaaaggcggatgaagagctagcaactgaggtggcgtgggtagtggtatatctttcagcactttcagaaaaagctattagcttaatagtgagaagccatgtgcctcagttgctgattcgacgtctgctagcatctgagaacttacagttgctcattccggtacttcgtggtttaggaaatgttgtagctggggatggatacatggttgattcaatcctaattgttgggaacaatatcacagatcaagctttatcaagtcttataaaatgcttgaggagtgacaatagggttctcaggaaggaggcttcatgggtattgtcaaacatagcagcaggcagctttgagcacaagaaattgatttttaccagtgaggccacacctgtgctgatacacctcctgaataatgcacaatatgatatccgtaaggaagcagcctacaccctgggcaacctgtgtgttgtcccagcaggaagtagtgaacccccaaacataatcgtggaacatttagtctcgatcataaacagtggagccctcccaggattcataaatttgctcagatctgctgatatagagagcgcgagacttggacttcagttcctggaactggccatgaggggatatcccgatggacaaggcccaaatcttgtggagagggaggatggcattgaggctatggagaggttccagttccacgagaacgatgtgatgaggaacatggcgaatggattggttgacaagtatttcggtgaggattacggcgtagaatgagagccggtgttgttggatgccatccatccatccatacatacatacatagacctggatgaactcagagttgtgctcagattgtaaaacgcatgcattcttgtgcatgcaatcgtagaacacaatgctgttgaatgtctttgtgattgcccagtgttcctccccgctaacctgcaggcactggcatacgagtccgagtgggacaagaagtcgatc

SEQ ID NO: 8909 - DNA, 1805 bp, Brachypodium distachyon
ctctacggtcttgcttactcggtcttctccccgtcccgtcccgtttggttccaaccatcgccgagctcccgccgccgtaaaagatggccgacggcaacaccccggcctcgccgcctcccgcttctccgctccagaggcaccgctacgccatcaagtcctcagtgcacaataccgcagctagccggaggcgggaacaggctatcgcaatagggaaggaaagaagggaagccttgatccgtgcaaagcgcgtgtgccgcaccccgctttctggtagcgatgatgctggcattgaggaggatgatatggttgttgataaggagaaagaaggtcttgaagcaagaactgctcaagctgttgaagaattgaaatcagctttgtcaagccaggggaaaggggcccagaagaagaagacagaggtgcttcgtgctttgagacgcttgctgtcacagtctgaagtacctccaattgaagcagcaattaaagctggagcagttcctcttttggtacaatatctgtctttcggatcttcagatgaacagttgctagaggccgcttggtgccttacaaacatagcagctggggaaccagaagaaacaaaatcgttgctgcccgcattaccattgcttgttgctcaccttggtgaaaagagctccacacttgttgctgagcaatgtgcgtgggccattggcaatgttgctggtgaaggagcagatctgagaagcacattactcgcacagggtgctttgtggcctcttgcccgcttaatgctgtcaagcaagggttcggcagcaagaactgctgcatgggcattgtcaaatctcatcaaggggcctgatcccaaggctgtgaatgagcttattggcatcgagggtgtgctaaatgcgatcgtacagaacttggaaaaggcggatgaagagctagcaactgaggtggcgtgggtagtggtatatctttcagcactttcagaaaaagctattagcttaatagtgagaagccatgtgcctcagttgctgattcgacgtctgctagcatctgagaacttacagttgctcattccggtacttcgtggtttaggaaatgttgtagctggggatggatacatggttgattcaatcctaattgttgggaacaatatcacagatcaagctttatcaagtcttataaaatgcttgaggagtgacaatagggttctcaggaaggaggcttcatgggtattgtcaaacatagcagcaggcagctttgagcacaagaaattgatttttaccagtgaggccacacctgtgctgatacacctcctgaataatgcacaatatgatatccgtaaggaagcagcctacaccctgggcaacctgtgtgttgtcccagcaggaagtagtgaacccccaaacataatcgtggaacatttagtctcgatcataaacagtggagccctcccaggattcataaatttgctcagatctgctgatatagagagcgcgagacttggacttcagttcctggaactggccatgaggggatatcccgatggacaaggcccaaatcttgtggagagggaggatggcattgaggctatggagaggttccagttccacgagaacgatgtgatgaggaacatggcgaatggattggttgacaagtatttcggtgaggattacggcgtagaatgagagccggtgttgttggatgccatccatccatccatacatacatacatagacctggatgaactcagagttgtgctcagattgtaaaacgcatgcattcttgtgcatgcaatcgtagaacacaatgctgttgaatgtctt

SEQ ID NO: 8910 - DNA, 2208 bp, Festuca arundinacea
ccgtacggtctcgcttagtcttctccccgtcccgtttttgttcctatcatcaccgagtctcgcagccgtcgagctccgccgccgtaaaagatggccgacggcaacaaccccgctccgccgtctgcagcttctccgctccagagccaccgctacgccatcaagtcatcagtgcacaatacagcagctagccggaggcgtgaacaggctgtagcaatagggaaggaaagaagggaagccttaatgcgtgcaaagcgtgtgtgccgcaccccactttctggcagcaatgagtctgcaattgaagatggtgatatggttattgatgacgagaaagaaggtcttgaaacaagaactgctcaagctgtccaagaattgaaatcatctttgtcaagccaggggaaaggggcccagaagaagaagattgaggcacttcgtgctttgagacgcctgttgtcacagtctgaagtacctcctattgaagtagcaattaaagctggggcagttcctcttttagtgcaatttctgtcctttgggtcttcagatgaacagttgctagagacagcttggtgccttacgaacatagcagctggacaaccagaagaaacaaaaaccttgcttcctgcactgccattgcttattgctcacctcggcgagaagagctccacacttgttgctgaacaatgtgcatgggccatcggtaatgtcgctggtgaaggatctgatctgagaagcacattactcgcacagggtgctttgttgcctcttgcccgcttaatgttgtcaaacaagggttctacagcaaggactgctgcttgggcattgtcaaatctcatcaaggggcctgatcccaaggctgtcaatgagcttattaagatcgagggtgtgttaaatgcgatcacaagggacttggaaaaggcggatgaagagctagcaactgaggtggcttgggtagtggtatatctttcagcactttcagaaaaagctatcagcttaatagtaagaagtcatgtgcctcagttgctgattgcacgcctactggcatctgagaacttgcagttgcttattccggttctccgtggtttaggaaatcttgtagctggggatggatacatggttgattcagtcctaatagttggacacagtatcacagatcaagctctatccagtcttataaaatgtttgaagagtgacaatagggttctcagaaaggaggcttcatgggcattgtcaaatatagcagcaggcagctttgagcacaagaaattgatttttaccagtgaggcgacacctttgctgatacacctcctgacgagtgcacagtttgacattcgtaaggaagcagcttacaccctggggaatctgtgtgttgtctcagcaggaagtactgaccccccgaacataatcaccgaacatttagcatcaatcataaatggtggagcccttccaggattcgtaaatttggtcaggtctgctgatatagagagcgcaagacttggacttcagttcctggaactggtcatgagaggataccccaatggacagggtccagcgctcgtggagaggcaggacggcatcgatgccatggagaggttccagttccacgagaacgaggcgatgaggaacatggccaatgggctggtcgacaagtactttggcgaggattacggcctcgagtgagctgccgttccgacatctgtttgtgtactgtaaaatgcaaccttttgcgatcgtggaatacagtgctgtctgtatgaagtagcgtagtttgccgtgtaacttagccatcgccgtggttggcggcgatggttgatgtagctggaacaaccgaacaatgtgacaggcttgaagtgagctgtgtagctatggtagtacacatgttgtgaattgtacaagaagagaacagttttgagtgttgagctgtattgcactatagaaatgctgaaagttgtgtgtctacttatcattccctgtactacagagaaccttgcaactatgtctttacagttccagatcatgcttagattaaatggataaacacttgctgtaagcctgtaacaacagtaaagtgaagctgcgagtgtaacaacggttcactgatttcttgagcatgatctgtggcagatgtgtcacacacttctatagttctataggtctacagttacatcagcatcatcattttactctcagtgcaaaaaaatactagtatactct

SEQ ID NO: 8911 - DNA, 1170 bp, Zea mays
tactccacagcgcagagatgaatgagaccagtcgccctctgccccaggcaaagctgcagctgcagctgccacagcggtgaccacgcacgctgcaccgcaccgcaccgacgggtgagacctgctgtgtccaccaaccgtgagcccagcaggcgaccgacgacgctagcttagactaggaaccaacaatggccacgcgccacctgctcctcctcctgctcgccgcgctgctcccggcggcggccacggcggacccggacgcggtgcaggactactgcgtgccggacacgggcggcgggcgcgggcgcgggcgggccgtggatctagcgctgctcccgtcctacccgtgcaggagccccgccaacctgacggcggcggacttcgccttcgcgggcgtgcgcgccgcgggcaacttctccgcggacacggggttcgcgggggtgtcggtgacccccgcgcagttcccggcgctgcacaccctcggcgtgtccttcgcgcgcgccgacctgtccgcggcgggcggggtcaacccgccgcactaccacccgcgcgccaccgagacggcgctggtcctggccggccgcgtctacgcgggattcgtcgactcgggcggccgcgtcttcgccaaggtgctcgagaaaggggaggtcatggtgttcccgcgcgccatggtgcacttccagatgaacgtcggcgacgagccggccacggtgtacggcaccttcaacagcgagaaccccggcatcgtgcgcatcccggcgaccgtgttcgggtccgggatcaaggacgccgtcctcgagagggcgttcggcctcgagccggaggagctccgccggctccagaagaggttcgggcctcctcccaagaccaagacggcggagatggacgattgatcggaagatcaggcactcgcgatcaagggggacatgattaattgattagttatattaagagcagcagactttgtgatctctggaatatatctccttccatttgttaatgtctgtatgaattatttggcggtggacggtggttatcatggaccgataatgccggtacgtacagatgggatgggcatgtggggttaggtgtcacattcaagtgtctacgagatgtttatgggtttatatatattgttaataaagcaggccgactttatttgctctggatgat

SEQ ID NO: 8912 - DNA, 1846 bp, Panicum virgatum
aagccgacacttaacaactggacatcagcacgcgcctgattattgaacagtaacctaatactaacagtagcacgttacacgtaggacggtgtgtcgcatatcatagtttatagagttgtaacatgtctatttatttatatatatgtatgtacaaagatgggatcactcgatcgccctcctccccaggcaaagctgcagctgcaaactagctgatgcgagacaccggtgaccacgcaccgacgggcaacgagtgagacctccgcatcaacgaccaaccgcgagccaagcgacgaccgacacagtcacacaggatggcggcgcaccatatcctcctcttgctcgccgcgctgctcccggcggcggccacggcggaccccgacgccgtgcaggactactgcgtgccggacgccgccgggcgcgggcggcccctggagctggcgctgctgccgtcctacccgtgccggagccccgccaacctgacggcggccgacttcgccttcgccggcgtgcgcgccgcgggcaacttctccgcggacacgggcttcgcgggggtgtccgtcacgcccgcgcagttcccggcgctgcacaccctgggcgtctccttcgcccgcgccgacctctccgcggcgggcggggtgaacccgccgcactaccacccgcgcgccaccgagacggcgctcgtcctggcgggccgcgtctacgcgggcttcgtcgactccggcggccgcatcttcgccaaggtgctcgagaagggggaggtcatggtgttccccagggccatggtgcacttccagatgaacgtcggcgacgagccggccacggtgtacggcacgttcaacagcgagaaccccggcatcgtgcgcatcccggccaccgtgttcgggtccgggatcagcgccggcgtcctcgagagggcgttcgggctctccccggcggagctccgccggctcgagaagaggttcggcccgcccaagaccaagctgtcagagatggacgattaggtagttagttaatcagctggtgaagtggtgatcagatcagccattgtggtggcgcatggttaattactagttttgaattgttaatgtgatgatgttgtgtatgatactccctccttccccgtttataaggcacacacgcatatcaagattcaaacatttatatctttgaccaataatttaactattaatttttaatttttataatataaattttatatgattggattcgccatcaaatatagtttacaatgattataaatttataatcataagtgatataatatatgacaaataaatggtcaaagtatcgtttggaagaccgtgccatgttccaccgtgccttataaacgaggaaggagggagtatgaattatttggcggtggttgtggtggatcgatattgtgatatagacttgaatgattagaggcttttgatttggaggtgtatgttggtacagatgggcagttaggtgtcacactcgatagagtgtgaattgtctatgacatgtttatcttaaacaaattggtaaagaagatcgacttttagtttgttgtgcatcatagtttctctgcgcatgccaaagttagatcaagcagaacgtgcaatgcaacttattgaggtggtgctcggtaaagttactgcacctacaccttcatgaatagtgttacactagtccaataaaaaaattaattaactgtaacccatgaatagcttaaatggtcaaaggaggtggttatacagtacacacatgtgctgaaatcttgtatgtttgacgatctaagtctcattgataagtatattcctctcgttattaatacgtcaattttcattctgtggcggtgtgc

SEQ ID NO: 8913 - DNA, 1345 bp, Panicum virgatum
cctgattattgaacttgaacaataacctaatactaccattagcacgttacacgtaggacggtgtgtcgcatatcatagtttatagagttgtagcatgcctatttatttgtatatatgtatgtacaaggatgagatcactctattgccctcccagctccccaggcaaagctgcagctgcaagcctgcaactagctgatgcgagacagtggtgaccacgcaccgacgagcaacgagtgagacctctgcatcaacgaccaaccgcgagccaagcgacgaccgacactagctagctggtagcaaccaagcaggatggcagcgcatcacctcctcctgctgctcgccgcgctgctcccggcggcggcaacggcagaccccgacgccgtgcaggactactgcgtgccggacgccggcgggcgcgggcggccgctggagctggcgctgctgccgtcgtacccgtgccggagccccggcaacctgacggcggccgacttcgcgttcgccggcgtgcgcgccgcgggcaacttctccgcggacacgggcttcgcgggggtgtccgtcacgcccgcgcagttcccggcgctgcacaccctgggcgtctccttcgcccgcgccgacctctccgcggcgggcggggtgaactcgccgcactaccacccgcgcgccaccgagacggcgctcgtcctggcgggccgcgtctacgcgggcttcgtcgactccggcggccgcatcttcgccaaggtgctcgagaaaggggaggtcatggtgttccccagggccatggtgcacttccagatgaacgtcggcgacgagccggccaccgtgtacggcacgttcaacagcgagaaccccggcatcgtgcgcatcccgggcaccgtgttcgggtccgggatcagcgccggcgtcctcgagagggcattcgggctctccccggcggagctccgccggctcgagaagaggttcggcccgcccaagaccaagctgtccgagatggacgattaattagttagttataatcagctggtgagggtgatcagatcagccattgtggcggtgcatgattaattactattttacggtagactttgtgaattggagtacatttcttttgaattgttaatgtaatagtgatgtagtatgatatgaattattaggcggtggttgtggtgtgtcgatattgtgatatagacttgtaatgattagagccttttgatttggaggaggtgtatgttggtacagatgggcagttaggtgtcacattcgatcgagtgtcaaggatctatgacatgtttatcctaaacaaattggtaaagaagatcgactttagtttgttgtggatcataatttc

SEQ ID NO: 8914 - DNA, 1188 bp, Setaria italica
tttatatataagtatgtacaagatgagatcactcgccctcttccccaggcaaagctgcagctccaagtctgcaactagctgatgcaagacagtggtgaccagcgaccacgaaccgacgagtgagacctccgtgaccgaccaaccgcgagccagccaacgaccgacactagctagctagcaagcatccagggatggcggcgcatcacctcctcctcctcctgctcgccgtgctgctcccggcggcggccacggcggaccccgacgccgtgcaggactactgcgtgccggacgccggcgggcgcgggcggcccctggagctgtcgctgctccggacctacccgtgccggagccccgtcaacctgacggcgtccgacttcgccttcgccggcgtgcgcgccgcgggcaacttctccgcggacacgggcttcgcgggtgtctccgtcacgcccgcgcagttcccggcgctgcacaccctgggcgtgtcctttgcccgcgccgacctctccgcggcgggcggcgtcaacccgccgcactatcacccgcgcgccaccgagacggcgctcgtcctggcggggcgcgtctacgccggcttcgtcgactccggcggccgcatcttcgccaaggtgctcgagaagggggaggtgatggtgttccccatggggatggtgcacttccagatgaacgtcggcgacgagcccgccacggtgtacggcaccttcaacagcgagaaccccggcatcgtgcgcatcccggccaccgtgttcgggtccgggatcaagggcggcgtcctcgagagggcgttcgggctctccccggcggagctccgccggctcgagaagaggttcggcccgcccaagaccaagctgtccgagatggaggattagttacttaatcagccgttgtggcggtgcatgattaattactagtttacgggtagactttgtgattcggagtatatttcttttgaattgttaatgatgttgttgtagtatgaattatttggcggtggttgtcgtggatcgacattgtgatagacttgggaatgattagagcctttatttggaggtatatattggtacagatgggcggttaggtgtcacattcgatcgactgtcaagtgtccaacatgtttatcctatacaaattggtaaagaagatcgactttagtttgttgtggatcatgatttc

SEQ ID NO: 8915 - DNA, 1713 bp, Panicum virgatum
gcctcctaatcctcaaggtgcatcaatgcaactagtacagctctgtttgactgtttcctacttcctggaagctgccattgctattttccactgtttcttcagcttccaagcatcctgctgctcctttctaccgcagcaaccgtcactccgctccatttgaaggacaactgcacatctgcacacagcacacgcgtggataaaatatagtacaagttgcaaatttcatgattatggaaccaacctaaaagatacacgttgtgcagtgtgccgcaaatcatagtttatataatcacagacaacatgtctttatatgaatgtgtactacgaagatgatatcactccctaggcaaagctgcaactctagcaagctgatgagtgataagagccagcgcagtcgtgaccacgacgcaccgacgacgagtgagtgagacctgctgagtgctgaccagccgtgcgtgagccattccgacgacccaccgaccaacactagcgagtagcgtaccgaggaaccaagaatggctccccgcaggcatctcctcctccggctcgcggcggccgtagtgctgatcccggcggcgaccacggcggaccccgacgcggtgcaggactactgcgtgcctgacaccggcgggcgcgggcgggccgtggagctcccgctgctgccgtcctacccctgccggagccccgccaacctgacggcgtcggacttcgcgttcgcgggcgttcgcgccgcgggcaacttctcctccgacacgggcttcgcgggcgtctccgtcacgccggcgcagttcccggcgctgcacaccctcggcgtctccttcgcccgcgccgacctctccgccgccggcggggtgaacccgccgcactaccacccgcgcgccaccgagacggcgctcgtcctcgcgggccgcgtctacgccggattcgtcgactcgggcggccgactcttcgccaaggtgcttgctcgagaaacgggaggtcatggtcttcccgcgcgccatggtgcacttccagttgaacgtcggcgacgagcccgccacggtctacgggaccttcaacagcgagaaccccggcatcgtgcgcatcccggccaccgtcttcggctccgggatcaaggacggcgtcctcgagagggcgtttggcctctcaccggcggagctccgccggctggagaagaggttcagcccgcccaagaagaccaagacggtggcggggatggacgattagccatcagctaacactaatcattatgatacacggttgatcagcttcgaggtgcatcgttaattagtgtggagttctatggatagacgttctgagttgggacaatatttctttcgatttgttaatgtcgtctggaattatttggcggtggtggttgtcatggatcgatcgatatcatggatagactttaatttggaacgaatgattagagcctttgctagcaagaggtgtataaatgttggtacatagcggttaaatgtcacatctatactgttaaagaaggtcaactttagtttgttggggataatcatctctgtttacacgcatggcaagtgatcaatcatataaagacacctttagcttatgactcaaaggatgccatcaacaccctaataaactgcgtgctctccctcgctccccacgcggccagcgattttctagcaacgagcgacagacgatcgttgagtcttgagtggcgccgcgccgccg

SEQ ID NO: 8916 - DNA, 1079 bp, Triticum aestivum
cgttagccacacatttccaaagaccaactaggacgtcaacaagtgaagtgcagtgagcggacgcggtcgagcaaccaaaggatggcgctgcaccatcttggcctcctcctgctcgccgtgctgctcccggcggcggccatcggcgccgacccggacgccgtgcaggacttctgcgtgccggaccccgggcgcggccggcccgtggagctcaacctcatccgctcctacccgtgcaggagcccggccaacctcaccgcgggcgacttcgccttctcgggcgtgcgcgcggcgggcaacttctcggccgacacggggttcgcgggggtgtccgtcacgccggcgcagttcccgggcctgcacaccctcggcatgtccttcgcgcgcgccgacctctcggccgccggcggcgtcaacccgccgcactaccacccgcgcgccaccgagacggcgctcgtcctcgccggccgcgtctacgccggcttcgtcgacaccgggggccgcctcttcgccaaggtgctcgtggagggggaggtcatggtgttcccccgcggcatggtgcacttccagctcaacgtcggcgaccagcccgccaccgtctacggcaccttcaacagcgagaaccccgggatcgtgcgcatcccggccaccgtgttcgggtccgggatcagggacgccgtccttgagagggccttcgggctctcccccgaggagctccggcggatcgagaagaggttcggcgtgcccaagaaggccgagctggaggactagttaattcgtttattatacttcgttcgttgctggtcggccatggccgcatgtgcatgattagctgacaggtagacttgtgggttgggagtatgggcgatactacttatttcttttccatttgacattaatatatacttgtggatttatagtggtggttggtagggctcatccgtgtaatgatatgaaaagtgtaaggtatacaaatcttgaggcgagtatatatgatagtaccaaacaaattaatgttcatgtcactctagctaacactcacttcatccatgtcttcctttgagagaatggagggattggag

SEQ ID NO: 8917 - DNA, 1218 bp, Oryza sativa
gaacttttctaaccatctctgcacttccgggaaagcggccgatcgacgctttacaactgctcgtgcatgacaaaatacaagaataacctacggatcaatacctgcatgattactggcaatgatcaactcaccttacaagacatcagtgctcgactacatatgtactactatgtgcaaagcaagcagctgtccaccgacgaacgagtgacagaacgagcgtagaatcgatggcgcatcgtcgtcgttgtctcctcctcttgctcgccgtgctgctgccggcgatggcggcaaggggcgaccccgacgcggtgcaggacttctgcgtgccggacgccgggcgtgggcggccggtggagctcgccatgctcccggcctacccgtgcaggagccccgccaacctgacggcgggcgacttcgccttctcgggcgtgcgcgccgcggggaacttctcgccggagacggggttcgccggcgtgtccgtcaccccggcgcagttcccgggcctgcacaccctggggatgtccttcgcccgcgccgacctctcggcggccggcggcgtcaacccgccgcactaccacccgcgcgccaccgagacggcgctcgtcctcgccggccgcgtgtacgccgggttcgtcgactccggcggccgcctcttcgccaaggtgctcgagcagggggaggtgatggtgttcccgcgcgccatggtgcacttccagctcaacgtcggcgacacgccggccacggtctacggcgccttcaacagcgagaaccccggcatcgtccgcatcccggcgacggtgttcgggtccggcatcagggaggccgtcctcgagagggcgttcgggctcactccggcggagctccggcggctggagaagaggttcggcccgcccaagaaggcggagatggaggattagctagccgcttgtgcttgaccggccatggccggcggtcgtgtgcatgattaggttactccccgttagtgataattaatgggttatttcttttcatttcatttggttaatacagtactgtatcatttgtggaggtggttggaaatggtgattatagcctggtaatgatttgaggtgtaaggttggtagagaagtataaggaggcacagatgaatggaacaatcgagagggtaactcaacttcaaaatatgctcagttttgtgttttttttccggaaatggtgtttcgtgcagaatgtttgtac

SEQ ID NO: 8918 - DNA, 854 bp, Saccharum officinarum
ctggagctaggattaggaaccagcaatggctccgcgtgatctgctcctcctcctgctcgccgccgtgctgctcccggcgtcgtccacggcggaccccgacgcggtgcaggactactgcgtgccagacacgggcggtcgggccgtgcccgtggatccggcgcggctgccgtcctacccgtgcaggagccccaccaacctgacggcggccgacttcgcctccgcgggcgtgcgcgccgcgggcaacttctccgcggacaccgggttcgcgggggtgtccgtgacccccgcgcagttcccagcgctgcacaccctggggatgtccttcgcgcgcgccgacctctcggcggcgggcggcgtgaacccgccgcactaccacccgcgcgccacggagacggcgctcgtcctgagcgggcgcgtctacgcgggcttcgtcgactccggggggcgcctcttcgccaaggtgctcgagaagggggaggtcatggtgttcccgcgcgccatggtgcattttcagatgaacgtcggcgacgagccggccacggtgtacggcagcttcaacagcgagaaccctggcatagtgagaattccggcaaccgtgtcgggtcctggatcatggacgggtctttgatagggcgttggtcttctgccgaagagttccgcggttcataataggtcggccttccaaactatgaggtggaatggacatataatttgttattgtaataggcactgtatatggggatggttttatttttatatactgacgtcttttttctgttaattattttctctgtgtaaatatataatgtggtgtcctttgtttatatttgttttgtgctatgagagtattgtta

SEQ ID NO: 8919 - DNA, 2355 bp, Saccharum officinarum
gcgaacgaacacggacaaatatatcctcgctcgcagactcgcagtcgcagctactccccgccgccgccgcacctccgcccaccaccttttcccgggctccggcgatgtcggcggcgatcgggggcgccgagctccacggcttccggggcgcggcggcgcagctccccaggtcgcggatgctcgggaggccgatccgggtggcgccacccgccgcggccacgccgggcggcggcggcggcgcgtccgcgggcagcatacgcgccgtctccgcgcctgcgaagaaggatgcttctgaagttaagcgaagcaaggttgagataatcaaggaaaagagcaatttcctccggtaccctttgaacgaggagttggtctcggaggccccaaatatcaacgagagtgctgttcagctgatcaagtttcatgggagctaccaacaaactgaccgagatgtccgtgggcagaagaattactcgtttatgcttcggacaaagaatccctgtggaaaagttccaaaccaactttacttggctatggatacactagctgatgagttcggcatcggaacactccgcctgacgaccaggcagacattccagttgcacggcgttcttaagaagaacttgaagactgttctcagcactgtcataaagaatatgggctcaacattgggtgcttgtggcgatctcaacaggaatgtacttgcacctgcagcaccttatgtcaaaaaggatatcctttttgctcaacaaacagcagagaacattgcggcacttcttacaccacagtccggggcttattatgacctgtgggtggatggagagaagataatgtcagctgaagagcctcctgaggtcacaaaagcccgcaatgacaactcgcatggaacaaacttccctgactctcctgaaccaatctacggcatccagtatctaccgaggaagttcaagatcgcagttaccgcagctggtgataactctgttgacattctgaccaatgacatcggtgtcgttgttgtttcagatgatgcaggagaacctattggttttaacatctatgttggtggtggcatgggaagaacacaccgagtggaaactacattccctcggctggctgatccgttgggttatgttccgaaagaagatatattatatgctataaaggccatcgtcgtcacacagagggaaaatggaagaagggatgatcgcaagtatagtaggatgaagtatttgattgaccgttggggaatcgacaagtttcgggctgaagttgaaaaatattacgggaagaagtttgaaagtttccgaccattgccagagtggcagtttaacagctaccttggctggcaagaacagggtgatgggaaattattctatggagtgcatgttgataatggtcgtgttgctgggcaagcaaagaaaactctacgagagataattgagaagtataatttggatgttagtattaccccaaaccaaaatcttattttatgtgggattgatcaggcatggagagaacccattactacagctcttgcccaagctggcctgctggaaccacaggatgtggaccctctgaatttaacttccatggcatgccctgccttgccactgtgccctttggcacaaacagaagctgaacgggggatcttacccattcttaaacggattagaacagttttcaacaaggttggtatcaaggattcagagtctgtggttgtgaggataactggctgccctaatggatgtgctagaccatatatggcagagcttggttttgttggtgatggcccaaaaagttaccagatctggctgggtggaacaccaaaccagagtacgctagcagaatcatttatggataaagtgaaacttgatgacatcgagaaagttttggaacctctgttttcctattggaatagcactcgccaggaaggtgaatcttttggaagcttcacaaaccgaacgggattcgacaaattgaaagaggtagtgaacaagtgggcagagtcaccatcagccgcatgaagatttcacttccgtcagataaaatcccaggctcccagcacaattttggccacgggattaattaattatatgacgaaggctctccagataaacgagaaaaagaagttgtcaactccattgacaatagaaaaggaagactctttcgttggagttgctatgttaggtcgagtgatcaaatttttttgtgtgtgctttgaaggaaacctctgtgaacttgaataaattcctcgcggagttgtgcctgagaataaattcgaccgaggcgtttgtaagcttgaatcagttcctctcgatgttgtgcctgagagaataaattcgactgaggccttgttta

SEQ ID NO: 8920 - DNA, 3085 bp, Sorghum bicolor
ccgtagtccacttgtcagtggctggcacgggacgcgtggcctccacagtcgtcaggtgtggacagccgcgatgcttcaccactgccgttcgtgtcttcgccaccccatcccgcaccgcgtgcgtacaccgtggttcctatggatcactgacgcaccggcccctccgataccatcgccaatacgacgtcgagcatttcccatggaccgcgtccacgcgagtgatctccacccacatgcacccggtggggacctgccgccccaataaaagcaccgtacccgtcgtctgcgagccacgacccctcgacactgcgagcgaacgcggacaaatatatcctcgctcgtcagtcgcagctactccgccgccgccgcaactccgcacggccaccaccttcttccgggctccagcgatgtcggcggcgatcagaggagccgagttccccggcttccggggcgcggcggcgcagctccccaggtcgcggatgctcgggaggccgatccgggtggcgccacccgccgcggcccagccaggcggcggcggcgcgtccgcgggcagcatacgcgccgtctccgcgcctgcgaagaaggatgcttctgaagttaagcgaagcaaggttgagataataaaggaaaagagcaattttctcaggtaccctttgaacgaggagttggtctcagaggccccaaatatcaacgagagtgctgttcagctgatcaagtttcatgggagctaccagcaaactgatcgggatgtccgtgggcagaagaattactcatttatgctccggacaaagaatccttgtggaaaagttccaaaccaactttatttggctatggatacactagctgatgagtttggaatcggaacactccgcctgacgaccaggcagacattccaattgcacggagttcttaagaagaacttgaagactgttctcagcactgtcataaagaatatgggctcaacattgggcgcttgtggtgatctcaacaggaatgtacttgcacctgcagcaccttatgtcaaaaaggatatcctttttgctcaacaaacagcagagaacattgccacacttcttacaccacagtctggggcttattatgacctgtgggtggatggagaaaagataatgtcagctgaagagcctcctgaggtgacaaaagcccgcaatgacaactcacatggaacaaacttccctgactctcctgagccaatttatggcacccaatatctgccgaggaagttcaaggtcgcagttaccgcggctggtgataactctgttgatattctgaccaatgacataggtgtcgttgttgtttcagatgatgcaggagaacctattggttttaacatctatgttggtggtggcatgggaagaacacaccgagtggaaactacattccctcggctggctgatccgttgggttatgttccgaaagaagatatattatatgctataaaggccatcgtcgtcacacagagggaaaatggaagaagggatgatcgcaagtatagtaggatgaagtatttgattgaccgttggggaatcgacaagtttcgggctgaagttgaaaaatattacgggaagaagttcgaaagtttccgaccattgccagagtggcagtttaacagctaccttggctggcaagaacagggtgatgggaaattattctatggagtgcatgttgataacggtcgtgttggtgggcaagcaaagaaaactctacgagagataatcgagaagtataatttggatgttagtattaccccaaaccaaaatcttattttatgtgggattgatcaggcatggagagaacccattactacagctcttgcccaagctggcctgctggaaccacaggatgttgaccccctgaatttaacttccatggcatgccccgccttgccactatgccctttggcacaaacagaagctgaacgggggatcttacccattcttaaacggattaggacagttttcaacaaggttggtatcaaggattcagagtctgtggttgtgaggataactggctgccctaatggatgtgctagaccatatatggcagagcttggttttgttggtgatggcccaaaaagttaccagatctggctgggtggaacaccaaaccagagtacgctagcagaatcatttatggataaagtgaagcttgatgacattgagaaggttttagaacctctgttttcctattggaatagcacgcgccaggaaggtgaatcttttggaagcttcacaaaccgaacgggattcgacaaattgaaagatgtggtgaacaagtgggcagagtcaccatcagccgcatgaagatctcacttccatcagataaaatcccaggctcccagcacaattttggccacgggattaattaattatatgatgaaggctctccagataaaacgagaaaagaagttgtcaactccgttgacaacagaaaaggaaaggctcgcgttgcaattgctatgtttgttgggtcgagtgatcgaaatttgttgtgtgtactgtcaaggaaacctctgtgaacttgaataaattcttcgcagggttgtgcctgagaataaattggaccgaggcgtctgtgaactttgaatcagttcctcacgatgttgtgcctgagaataaattcgaccgagccatctgtgaacttaattcaattcatcacgaagttgtgccttagaataaattcgacagaggtgtccaattttcttggctctagccatgattggaacggccgcctgtaggctgtaccccctgtggtctaaggtcttgtttagatgtaaaatctttttgaattttcacattttagtatttttgtttgtatttgataaaaaattatccaattatggacttagtaggcttaatgatttgtctcgtgatttacagttaattgtataattaggtcttgtttagttcacccccaaaaaaaatttcaagattcctgtcacatcgaattttgtggcacatacatagagcattaaatataatcgaaaacaaaaactaattacacaatttgtctttaaataacgagataaatcctttgatcttagttagcctatgattggacaatctaa

SEQ ID NO: 8921 - DNA, 2891 bp, Sorghum bicolor
ccaccccatcccgcaccgcgtgcgtacaccgtggttcctatggatcactgacgcaccggcccctccgataccatcgccaatacgacgtcgagcatttcccatggaccgcgtccacgcgagtgatctccacccacatgcacccggtggggacctgccgccccaataaaagcaccgtacccgtcgtctgcgagccacgacccctcgacactgcgagcgaacgcggacaaatatatcctcgctcgtcagtcgcagctactccgccgccgccgcaactccgcacggccaccaccttcttccgggctccagcgatgtcggcggcgatcagaggagccgagttccccggcttccggggcgcggcggcgcagctccccaggtcgcggatgctcgggaggccgatccgggtggcgccacccgccgcggcccagccaggcggcggcggcgcgtccgcgggcagcatacgcgccgtctccgcgcctgcgaagaaggatgcttctgaagttaagcgaagcaaggttgagataataaaggaaaagagcaattttctcaggtaccctttgaacgaggagttggtctcagaggccccaaatatcaacgagagtgctgttcagctgatcaagtttcatgggagctaccagcaaactgatcgggatgtccgtgggcagaagaattactcatttatgctccggacaaagaatccttgtggaaaagttccaaaccaactttatttggctatggatacactagctgatgagtttggaatcggaacactccgcctgacgaccaggcagacattccaattgcacggagttcttaagaagaacttgaagactgttctcagcactgtcataaagaatatgggctcaacattgggcgcttgtggtgatctcaacaggaatgtacttgcacctgcagcaccttatgtcaaaaaggatatcctttttgctcaacaaacagcagagaacattgccacacttcttacaccacagtctggggcttattatgacctgtgggtggatggagaaaagataatgtcagctgaagagcctcctgaggtgacaaaagcccgcaatgacaactcacatggaacaaacttccctgactctcctgagccaatttatggcacccaatatctgccgaggaagttcaaggtcgcagttaccgcggctggtgataactctgttgatattctgaccaatgacataggtgtcgttgttgtttcagatgatgcaggagaacctattggttttaacatctatgttggtggtggcatgggaagaacacaccgagtggaaactacattccctcggctggctgatccgttgggttatgttccgaaagaagatatattatatgctataaaggccatcgtcgtcacacagagggaaaatggaagaagggatgatcgcaagtatagtaggatgaagtatttgattgaccgttggggaatcgacaagtttcgggctgaagttgaaaaatattacgggaagaagttcgaaagtttccgaccattgccagagtggcagtttaacagctaccttggctggcaagaacagggtgatgggaaattattctatggagtgcatgttgataacggtcgtgttggtgggcaagcaaagaaaactctacgagagataatcgagaagtataatttggatgttagtattaccccaaaccaaaatcttattttatgtgggattgatcaggcatggagagaacccattactacagctcttgcccaagctggcctgctggaaccacaggatgttgaccccctgaatttaacttccatggcatgccccgccttgccactatgccctttggcacaaacagaagctgaacgggggatcttacccattcttaaacggattaggacagttttcaacaaggttggtatcaaggattcagagtctgtggttgtgaggataactggctgccctaatggatgtgctagaccatatatggcagagcttggttttgttggtgatggcccaaaaagttaccagatctggctgggtggaacaccaaaccagagtacgctagcagaatcatttatggataaagtgaagcttgatgacattgagaaggttttagaacctctgttttcctattggaatagcacgcgccaggaaggtgaatcttttggaagcttcacaaaccgaacgggattcgacaaattgaaagatgtggtgaacaagtgggcagagtcaccatcagccgcatgaagatctcacttccatcagataaaatcccaggctcccagcacaattttggccacgggattaattaattatatgatgaaggctctccagataaaacgagaaaagaagttgtcaactccgttgacaacagaaaaggaaaggctcgcgttgcaattgctatgtttgttgggtcgagtgatcgaaatttgttgtgtgtactgtcaaggaaacctctgtgaacttgaataaattcttcgcagggttgtgcctgagaataaattggaccgaggcgtctgtgaactttgaatcagttcctcacgatgttgtgcctgagaataaattcgaccgagccatctgtgaacttaattcaattcatcacgaagttgtgccttagaataaattcgacagaggtgtccaattttcttggctctagccatgattggaacggccgcctgtaggctgtaccccctgtggtctaaggtcttgtttagatgtaaaatctttttgaattttcacattttagtatttttgtttgtatttgataaaaaattatccaattatggacttagtaggcttaatgatttgtctcgtgatttacagttaattgtataattaggtcttgtttagttcacccccaaaaaaaatttcaagattcctgtcacatcgaattttgtggcacatacatagagcatt

SEQ ID NO: 8922 - DNA, 2420 bp, Zea mays
cataccgtacccgtcgtccgcgagtcgcgacccctcgaccgtgcgaacgagcaaaggacaaatatcctcgctcgcagtcgcagctactacgccgccgcacctccgcccgccaccttcttcccggctccagcgatgtcgggggcgatcgggggcgccgaggtccacggcttccggggcgcagcggcgcagctcccgcggtcccgggtgctcgggaggccgatccgggtggcgccacccgccgcggcccggccgggcggtgcgtccgcgggtagcatacgcgccgtctccgcgcctgcgaagaaggacgcttctgaagttaagcgaagcaaggttgagataatcaaggaaaagagcaacttcctccggtaccctttgaacgaggagttggtctcagaggccccaaatatcaacgagagtgctgttcagctgatcaagtttcatggaagctaccagcaaactgaccgagatgtccgtgggcagaagaattactcgtttatgctccggacaaagaacccttgtgggaaagttccaaaccaactttatttagctatggatacactagctgatgagtttggcatcggaacactccgcctgacgaccaggcagacattccagttgcacggtgttcttaagaagaacttgaagactgttctaagcactgtcataaagaatatgggctcaacattgggtgcttgtggcgatctcaacaggaatgtacttgctcctgcagcgccttttgtcaaaaaagatatcctttttgctcaacaaacagcagagaacattgcagcactccttacaccacagtccggggcttattatgacctgtgggtggatggcgagaagataatgtcagctgaagagcctcctgaggtgacaaaagcccgcaatgacaactcgcatggaacgaacttccctgactctccggaaccaatctatggcacccagtatctaccaaggaagttcaaggttgcagttaccgcggctggtgataactctgttgatattctgaccaatgacatcggtgttgttgttgtttcagatgatgcaggagaacctattggctttaacatctatgttggtggtggcatgggaaggacacaccgagtggaaactacattccctcggctggctgatccattgggttatgttccaaaagaagatatattatatgctataaaggccatcgtcgtcacacagagggaaaatggaagaagggatgaccgcaagtatagtaggatgaagtatttgattgaccgttggggaatagataggtttcgggctgaagttgaaaaatattacgggaagaagtttgaaagtttccgaccattgccagagtggcagtttaacagctaccttggctggcaagaacagggtgatgggaaattattctatggagtgcatgttgataatggtcgtgttggtgggcaagcaaagaaaactctacgagagataattgagaagtataatttggatgttagtattaccccaaaccaaaatcttattttatgtgggattgatcaagcgtggagagaacccataactacagctcttgcacaagctggcctgctggaaccgaaggatgtcgaccccctgaatttaactgccatggcatgccctgccttgccactgtgccctttggcacaaacagaagctgaacgggggatcttacccattcttaaacgaattagagcagtcttcaataaggttggtatcaaggattcggagtctgtggttgtgaggataactggatgccctaatggatgcgctagaccatatatggcagagcttggttttgttggtgatggcccaaaaagttaccagatctggctgggtggaacaccaaaccagagtacgctagcagaatcatttatggacaaagtgaagcttgatgacatcgagaaggttttggaacctctctttacctattggaatggcacacgccaggaaggcgaatcttttggaagcttcacaaaccgaacaggattcgacaaattgaaagaggtagtgaataagtgggcagagtcaccatcagccgcatgaagatttcgctttcgttggataaaatcccaggctcgcagcacaattttggccacgggattaattatatgacgaaggaaatccagataagccgagaaatggaaaaaggaagactcgggttgtgagttgctatgtttgttgggttgagtgatcgaatttttttgtgtgtgctctcaaggagacctctgtgaacttgaataaactccacacggagttgtgccaaattagaccgaggcgtccgtgaacttgaatcagttcctcgggatgttgtgcctgagaataaatcccaccgaggcgtctgtgaacttaattcaattcgtcaggaagctgtgccttagaataaattcgacgggtgtccaattttcttgtcattctagcgagat

SEQ ID NO: 8923 - DNA, 2670 bp, Zea mays
ctcgaatccctgacgcatcggcccaccgatgccatcgccaatacaacgtcgagcatttcccgtggaccacgtccacgcgagtgatctccactggcataccccggtgggccccacctctccctcataaaacataccgtacccgtcgtccgcgagtcgcgacccctcgaccgtgcgaacgagcaaaggacaaatatcctcgctcgcagtcgcagctactacgccgccgcacctccgcccgccaccttcttcccggctccagcgatgtcgggggcgatcgggggcgccgaggtccacggcttccggggcgcagcggcgcagctcccgcggtcccgggtgctcgggaggccgatccgggtggcgccacccgccgcggcccggccgggcggtgcgtccgcgggtagcatacgcgccgtctccgcgcctgcgaagaaggacgcttctgaagttaagcgaagcaaggttgagataatcaaggaaaagagcaacttcctccggtaccctttgaacgaggagttggtctcagaggccccaaatatcaacgagagtgctgttcagctgatcaagtttcatggaagctaccagcaaactgaccgagatgtccgtgggcagaagaattactcgtttatgctccggacaaagaacccttgtgggaaagttccaaaccaactttatttagctatggatacactagctgatgagtttggcatcggaacactccgcctgacgaccaggcagacattccagttgcacggtgttcttaagaagaacttgaagactgttctaagcactgtcataaagaatatgggctcaacattgggtgcttgtggcgatctcaacaggaatgtacttgctcctgcagcgccttttgtcaaaaaagatatcctttttgctcaacaaacagcagagaacattgcagcactccttacaccacagtccggggcttattatgacctgtgggtggatggcgagaagataatgtcagctgaagagcctcctgaggtgacaaaagcccgcaatgacaactcgcatggaacgaacttccctgactctccggaaccaatctatggcacccagtatctaccaaggaagttcaaggttgcagttaccgcggctggtgataactctgttgatattctgaccaatgacatcggtgttgttgttgtttcagatgatgcaggagaacctattggctttaacatctatgttggtggtggcatgggaaggacacaccgagtggaaactacattccctcggctggctgatccattgggttatgttccaaaagaagatatattatatgctataaaggccatcgtcgtcacacagagggaaaatggaagaagggatgaccgcaagtatagtaggatgaagtatttgattgaccgttggggaatagataggtttcgggctgaagttgaaaaatattacgggaagaagtttgaaagtttccgaccattgccagagtggcagtttaacagctaccttggctggcaagaacagggtgatgggaaattattctatggagtgcatgttgataatggtcgtgttggtgggcaagcaaagaaaactctacgagagataattgagaagtataatttggatgttagtattaccccaaaccaaaatcttattttatgtgggattgatcaagcgtggagagaacccataactacagctcttgcacaagctggcctgctggaaccgaaggatgtcgaccccctgaatttaactgccatggcatgccctgccttgccactgtgccctttggcacaaacagaagctgaacgggggatcttacccattcttaaacgaattagagcagtcttcaataaggttggtatcaaggattcggagtctgtggttgtgaggataactggatgccctaatggatgcgctagaccatatatggcagagcttggttttgttggtgatggcccaaaaagttaccagatctggctgggtggaacaccaaaccagagtacgctagcagaatcatttatggacaaagtgaagcttgatgacatcgagaaggttttggaacctctctttacctattggaatggcacacgccaggaaggcgaatcttttggaagcttcacaaaccgaacaggattcgacaaattgaaagaggtagtgaataagtgggcagagtcaccatcagccgcatgaagatttcgctttcgttggataaaatcccaggctcgcagcacaattttggccacgggattaattatatgacgaaggaaatccagataagccgagaaatggaaaaaggaagactcgggttgtgagttgctatgtttgttgggttgagtgatcgaatttttttgtgtgtgctctcaaggagacctctgtgaacttgaataaactccacacggagttgtgccaaattagaccgaggcgtccgtgaacttgaatcagttcctcgggatgttgtgcctgagaataaatcccaccgaggcgtctgtgaacttaattcaattcgtcaggaagctgtgccttagaataaattcgacgggtgtccaattttcttgtcattctagcgagatgcctcatgccctcatgattggaacgaagtgaggcccttgtgtggtcggttgagaaactgggacatgggttgtgagcgctattttcaagtcgtctgattaaaacagtcgtccaattagtcag

SEQ ID NO: 8924 - DNA, 2000 bp, Pennisetum glaucum
gcctctgaagaaggatgcagctgaagtcaagcgaagcaaggttgagatcatcaaggaaaagagcaatttcctcaggtaccccttgaacgaggagttggtctcagaggccccaaatatcaacgatagtgctgtccagttgatcaagtttcacggaagctatcagcagactgatcgagatgtccgtgggcagaagaattactcattcatgctccggacaaagaatccttgtgggaaagttccaaaccagctttacttggctatggatacacttgctgatgagtttggcattgggacactccgtttgaccaccagacagacattccagctgcatggcgttcttaagaagaacctgaagactgttctcagcactgtcataaagaatatgggctcaacattgggtgcttgtggagatctgaataggaatgtgcttgcacctgcagcgccttatgtcagaaaagatatcctttttgctcaacaaacagcagagaacattgcagcactccttacaccacaatctggagcttattatgacctgtgggtggatggagagaagataatgtcagctgaagagcctcctgaggtcacaaaagcccgcaatgacaactcacatggaacaaatttccctgactctccggagccaatctatggcacccagtatctaccgaggaaattcaagattgcagttactacagctggtgataactctgttgatatcctgaccaatgacattggcgttgttgttgtctcagatgatgcaggagagcctgttggctttaacatctatgttggtggtggcatgggaaggacacaccgagtcgaaactacattccctcggctggctgatccattgggctatgttccaaaggaagatatattatatgctataaaggccatcgtcgtcacacagagggaaaatggaagaagggatgaccgtaagtatagtaggatgaagtatttgattgaccgttggggcatcgacaagttccgggctgaagttgaaaaatattatggcaagaagtttgaaagtttccgaccattgcctgagtggcagtttaacagctaccttggctggcaagaacagggtgatgggaaattattctatggagtgcatgttgataatggtcgtgttggtgggcaagcaaagaaaacgctacgggagataattgagaagtataatttggatgttagtattaccccaaaccaaaatcttattttatgtgggatcgatcaggcatggagagaacccatcactacagctcttgcacaagctggcctgctggaaccaaaggatgtggaccccctgaatttaacttccatggcatgccctgctttgccactgtgccctttggcacaagcagaggctgaacgtgggatcctacctattcttaaaagaattagagcagttctcaataaggttggtatcaaggattcggagtctgtggttgtgaggataactggctgccctaatggatgtgctagaccatatatggcagagcttggttttgttggtgatggcccgaaaagttaccagatctggctgggtggaacaccaaaccagagtaccctagcagaatcattcatgaacaaggtgaagcttgatgacatcgagaaggttttggaacctctgttttcctactggaacagcacgcgtcaggaaggtgaatcttttggaagcttcacaaaccgaacgggattcgacaaattgaaagaggtggtggacaagtgggtagagtcaccgtcagcggcgtaaagggatcactggctcgcagcacaatttttgtctccgggactactagcgtgcgtgacgaaaggctcttccaggtaaacgagagaagaggttgtcaaccgcgttgacaataaaaaaaacgaaggctcggtttggagtcattatgttttgttgggtcgagtgatcaaaatttttttgcgtgtgctttgaaggaaacctatgtgcacttgaataaattcctcgcaaaattgtgctccactgagaataaattcca

SEQ ID NO: 8925 - DNA, 6474 bp, Glycine max
gcccttcctttcttatcgtacaaaacctcccatcttatatctctgctttccctctgccattatttttcctctatcaaaattttcctccttctagtggatgaaacctaccctctccctctcatgcttcttctttcttattactactattatgcacacttcacttcattctccttcctctgaactctgaacactctttctctgcctcattttttttttttttcagtttctactttagacctatccatttcataatactactttgggttatatatataaagccattaaggacctttttcttttccctcttatccaatcatccaagtactataaaaacacctatttatatatatattgctttgaaactttgattgttttttcaattccaaaggagtggaaaatggcaccaagaaacagtcgcggaaaggccaagggagagaagaaaaagaaggaagagaaggttcttccggttgtcatagacatcactgtgaagcttctcgatgaaactcatgttctcaagggaatatcaacggacagaattatagatgttcgtcggcttttatcggtgaatacggagacgtgttatatcacaaatttttccctgtcgcatgaggtaagagggccacgtctgaaggatacggtggacgtgtccgcactgaagccctgcatcctcgatttagttgaagaggattacgatgaagaccgagcagtggcgcacgtgcgaagactcctcgatatcgtcgcctgcaccacgagcttcggtccgccgtcgccgaagaacgactccggtaccgtccagaaatccggcaagtccgaggcgccgccgtcgaagcaatcggcgaaagatgcggcggcggccgacctggacggcgagataagccactcgtgccctaagctggagaacttctacgagtttttctctctctcacacctcactgcaccaatccaatatgtgaagagaggttcgaggcggcacgtggaggagatatcggaggaggattatctgttctcgctggatgtgaaggtgtgtaacgggaaagtggtgcacgtcgaggcttgcagaaaggggttttacagcgttgggaagcagcggatactgtgccataatctggttgatctgttgagacagcttagcagagcttttgataatgctttcgatgatctcttgaaggcattttcagaacgtaacaagtttgggaatctcccatatggcttcagagccaacacgtggcttgttcctcctgttgctgcacaatcaccctcatcttttcctcctcttcctgtggaggatgaaacgtggggaggaaatgggggtggtcttggaagagacggaaagtatgatttggttccttgggctaatgagttttcatttattgcatccatgccttgcaatacagcagaagaaagacaagttcgtgatagaaaagcatttcttctgcacagcctgtttgttgatgttgccattttcagagcaataaaggccatcaaatatgttatggaagagcccaagtttagctgctcaattgtagaaaataatattatttacactgagagagtaggtgacttgaatatcaacgtcttgaaagatgtttctgttgcaagctataagattgatactaaaattgacagagttgaagctactggagtaaatcaaaaggatctactagagcgaaatatactgaaaggaatcactgctgatgaaaatactgctgcccatgatattaccactttaggtgtaattaatgtaagatattgtggttatgtggtcacagtgaaagttgagcgaggagttaatgaaaatgttgactctccatctcaacaaaatattgaattgtttgatcagccagagggtggtgccaacgcgctcaatattaacagtctgagattacttcttcacaatacaactccaccagaaaacaataaaccaatgtctcagatacaaacatttgagagtgaagagtttggtgcttcccatgcttttctggagaagctgattaaagaaagtcttgctaagcttgaggaagaagaaccaggtattgactattttgtaagatgggaacttggagcttgctggatacaacatttgcaagaccaaaataatacagaaaaagataagaaactatctttggagaaggctaagaatgaaatgaaggttgagggtcttgggaaaccccttaaagccctaaagaattataaaaagaaatctgattctagcaatactaattctgcaactgaatattcaaagtttaatcgggaggctgaaagccctccatttccctcaattgaatcccaacttgaaactacagaagctgagaatgagcttgttctgaaaaggatattatctgaggaagcttttacccgattaaaagaatcgggaactggacttcactgcaagtctatgcatgatttgattaacttatctcgaaaatattacacagacgttgctctcccaaaattggtagccgatttcggctcattggaactctcaccagttgatggacgcactctaactgattttatgcatactcggggtctacgaatgcgttctcttggacatgttgtcaagctttcagaaaagctttcacatgtccaatcactttgtattcatgagatgatagttcgagcttttaagcacatcctgcgggcagtaatttctgctgttgacaaggagaaaatggcttcatcaattgctggtgcattgaatttgctgcttggtgttcctgaaaatagagaattagataaatcacgtgaagttcacccattggtgtggaaatggctagagttgtttttgaagaagcgatttgattgggatcctaacaagttgaattacaaggatgtgaggaaatttgcaattttacgtggcttgtgtcacaaggtgggaattgagcttgttccaagggattttgatatggattccccaattccctttcaaaaatctgatattgtcagcttggtccctgttcacaagcaagcagcatgctcatctgcagatggaaggcagctcctagagtcatccaaaactgctttagacaagggaaagcttgaggatgcagttacctatggcacaaaggctcttgctaagctggtagcagtttgtggtccctatcatcggatgacagcgggagcctacagcctccttgctgtagttttatatcatactggagatttcaatcaggctacaatttatcaacaaaaagctttggatatcaacgagagagagttaggtctggatcatcctgataccatgaagagctatggggatcttgctgttttctattacagacttcaacacaccgagctggctctgaagtatgtgaagcgtgctttatatcttctgcatctaacatgtggcccatctcatccaaacactgctgctacttacattaatgtggctatgatggaagaaggtctgggaaatgtacatgttgctctccgatatcttcacaaagctttaaagtgcaaccaaagattacttggtgcagatcatattcagacagctgcaagttatcatgcaatagcaatagcactttcattgatggaagcatatccattgagtgtccagcatgagcaaacaactttgcaaattctgcgggcaaaacttggccctgatgacttgcgcacacaggatgctgcggcttggcttgagtattttgagtccaaggcttttgaacagcaagaagctgctcgaaatggtactcgaaaacctgatgcatcaatagctagcaaaggccatcttagtgtgtcagatttgcttgactacattaatcctaatactaaagggagagatgcagcagcaaagagaagaagccagataacaaaggtgagagcaacgtcttacccaaacgttgggatgtcaagttctgatgaatcttcaaaagaaattccaaaagaggcttcagatgaagaggtacaaatacccatactagtaggtagtgcagattctgagcaggaaaacaactctggacctgatttggaacaagctattttgaaacaaatatcggacgaaaagccacaaatttatgatgaaatcttgtctgaagcacatgctgaaggagaggatggatggcaaccagttcaaagaccaagatcagctggctcatatggccggagactgaagcagagacgggcaacacttggcaaagtttatagttatcaaaagaatgtggaagttggctcagaatctccttttgtaaggagtcctaatccgagtagtaggtattatttcttgaagaagcggacaatttcacatgggagttatacagatgatcataccgtaaacatcacccaaggtactaaatttggaaggaaagtagtcaaagctgttacatacagggtcaagtctgtgccctcaacttccaagccttgtgtaaatgagaaattagaaaatggggataagctgctcagttctcttccagaacctgatccaactgatgctaatccagttaagaagtctattgttagtcttggaaagtctccttcatacaaggaagtggccttagctcctccagggacaatctctaagtttcaggtctataatcctcaaagtgtgatttctgttagcagtgagcatgatggtggaaaacatgaagaggaagatattgaagctgatagaaatgttaatgttgatccaaccccgacagaggtaaatgatatggttaaagagaagaatgatgattctttatcagattctgtagatgactcacaggatgatactggagttgctattgaggggaaagaagaaactcagttgattgttgctgtgcaagataattgtatgagtgctgaggggcaatcaggagatgttgaagctcaaggagcagttgataacagcatattgattcatgcagtagatgatcatgtggattcttccaagcaagaacttgatgcaagtaattcatctgccagtttagaacctagtgataatacaaatcccacttctcagggtggtgaggatttaaaggtcaatgtatcaccatcaagtcagagtcatactgggggcatcccatataagaaattgtctgcatctgcagctccattcaacccatcacctgccattgcacgtgctgcaccaattgccatgaatatgactcttccttctggtcctagtgcagttcctgcaattggcccctggccagtaaacatgaatgttcatcctggacctactactgtgctacccacagttgccccaatgtgctcctctccgcaccatgcatatccatcacctccagcgacaccaaacatgatgcaaccgctgccatttgtgtatcctccttttactcagcctcaatcagtagcacctagcaactatcctgtcactagcagtgcctttcatgccaatcattttacatatttgaacccaacaatatctaagtttggtcccagtgctgtttggcctggttgtcatcctgtagaatttcctcttccagtacctattgttgaaccaatccgtgatcccatttcagagtcacaagttctgtgtcatggctctgaaagtccaagttcagcttcagttcttcctgaggacattgacagtattggggattccaatcaaggggtaaaaactttatcatcagagataagtgaagatgaagcagtgagagctggttcagaaaatataaaagaaaatggtaatatgaattttcacgggtctgaaaatgctgggaacaagcaaaatcaaaactttggttcaaatggcagctctagcagtagtgaaactaacatggatggtgagaaaacctttagcattttgattcggggaagaagaaatcgaaagcagactctgagaatgccaataagtttgcttactcgacctaatggctcacagtcatttaaggttatttataaccgtgtggttagaggaagtcatgctaccaagtctatgaatttgtcttctagtaaagattgtacagctactgcatagtccacagttctttgttgttactaatgaaatgttgcagaataattgtgggtaaagaagttctcataattttgcacaacagagacctggtatttccatcatttctggaattgaattacaaagtgccctgttgtatcagctcaagtttcatagctgcactatcttttgggaggtttccgatatctgtgtctatttaagatggaggattgtaggcttttcttcattaatataagtctacaggttcatcgcagtcagtttcggggtttctgaggtgccttcaaggtgaaaattttggttcccaatgtagttagacaattttgatataatgaattacgggactgatggatcgttctaattattatttttttgtaacaacattatcaatgactttgataataattttgttcaattgcataaactttcttaatttcttaatatgttgttatgtggtagtagtagttcttttttgttgattgagttaatatttagttgttacaattgaaatgatgtgaaggaacgtcatattaatgaaaatcattatttgtttaaatacataaagc

SEQ ID NO: 8926 - DNA, 6471 bp, Glycine max
gcccttcctttcttatcgtacaaaacctcccatcttatatctctgctttccctctgccattatttttcctctatcaaaattttcctccttctagtggatgaaacctaccctctccctctcatgcttcttctttcttattactactattatgcacacttcacttcattctccttcctctgaactctgaacactctttctctgcctcatttttttttttcagtttctactttagacctatccatttcataatactactttgggttatatatataaacccattaaggacctttttcttttccctcttatccaatcatccaagtactataaaaacacctatttatatatatattgctttgaaactttgattgttttttcaattccaaaggagtggaaaatggcaccaagaaacagtcgcggaaaggccaagggagagaagaaaaagaaggaagagaaggttcttccggttgtcatagacatcactgtgaagcttctcgatgaaactcatgttctcaagggaatatcaacggacagaattatagatgttcgtcggcttttatcggtgaatacggagacgtgttatatcacaaatttttccctgtcgcatgaggtaagagggccacgtctgaaggatacggtggacgtgtccgcactgaagccctgcatcctcgatttagttgaagaggattacgatgaagaccgagcagtggcgcacgtgcgaagactcctcgatatcgtcgcctgcaccacgagcttcggtccgccgtcgccgaagaacgactccggtaccgtccagaaatccggcaagtccgaggcgccgccgtcgaagcaatcggcgaaagatgcggcggcggccgacctggacggcgagataagccactcgtgccctaagctggagaacttctacgagtttttctctctctcacacctcactgcaccaatccaatatgtgaagagaggttcgaggcggcacgtggaggagatatcggaggaggattatctgttctcgctggatgtgaaggtgtgtaacgggaaagtggtgcacgtcgaggcttgcagaaaggggttttacagcgttgggaagcagcggatactgtgccataatctggttgatctgttgagacagcttagcagagcttttgataatgctttcgatgatctcttgaaggcattttcagaacgtaacaagtttgggaatctcccatatggcttcagagccaacacgtggcttgttcctcctgttgctgcacaatcaccctcatcttttcctcctcttcctgtggaggatgaaacgtggggaggaaatgggggtggtcttggaagagacggaaagtatgatttggttccttgggctaatgagttttcatttattgcatccatgccttgcaatacagcagaagaaagacaagttcgtgatagaaaagcatttcttctgcacagcctgtttgttgatgttgccattttcagagcaataaaggccatcaaatatgttatggaagagcccaagtttagctgctcaattgtagaaaataatattatttacactgagagagtaggtgacttgaatatcaacgtcttgaaagatgtttctgttgcaagctataagattgatactaaaattgacagagttgaagctactggagtaaatcaaaaggatctactagagcgaaatatactgaaaggaatcactgctgatgaaaatactgctgcccatgatattaccactttaggtgtaattaatgtaagatattgtggttatgtggtcacagtgaaagttgagcgaggagttaatgaaaatgttgactctccatctcaacaaaatattgaattgtttgatcagccagagggtggtgccaacgcgctcaatattaacagtctgagattacttcttcacaatacaactccaccagaaaacaataaaccaatgtctcagatacaaacatttgagagtgaagagtttggtgcttcccatgcttttctggagaagctgattaaagaaagtcttgctaagcttgaggaagaagaaccaggtattgactattttgtaagatgggaacttggagcttgctggatacaacatttgcaagaccaaaataatacagaaaaagataagaaactatctttggagaaggctaagaatgaaatgaaggttgagggtcttgggaaaccccttaaagccctaaagaattataaaaagaaatctgattctagcaatactaattctgcaactgaatattcaaagtttaatcgggaggctgaaagccctccatttccctcaattgaatcccaacttgaaactacagaagctgagaatgagcttgttctgaaaaggatattatctgaggaagcttttacccgattaaaagaatcgggaactggacttcactgcaagtctatgcatgatttgattaacttatctcgaaaatattacacagacgttgctctcccaaaattggtagccgatttcggctcattggaactctcaccagttgatggacgcactctaactgattttatgcatactcggggtctacgaatgcgttctcttggacatgttgtcaagctttcagaaaagctttcacatgtccaatcactttgtattcatgagatgatagttcgagcttttaagcacatcctgcgggcagtaatttctgctgttgacaaggagaaaatggcttcatcaattgctggtgcattgaatttgctgcttggtgttcctgaaaatagagaattagataaatcacgtgaagttcacccattggtgtggaaatggctagagttgtttttgaagaagcgatttgattgggatcctaacaagttgaattacaaggatgtgaggaaatttgcaattttacgtggcttgtgtcacaaggtgggaattgagcttgttccaagggattttgatatggattccccaattccctttcaaaaatctgatattgtcagcttggtccctgttcacaagcaagcagcatgctcatctgcagatggaaggcagctcctagagtcatccaaaactgctttagacaagggaaagcttgaggatgcagttacctatggcacaaaggctcttgctaagctggtagcagtttgtggtccctatcatcggatgacagcgggagcctacagcctccttgctgtagttttatatcatactggagatttcaatcaggctacaatttatcaacaaaaagctttggatatcaacgagagagagttaggtctggatcatcctgataccatgaagagctatggggatcttgctgttttctattacagacttcaacacaccgagctggctctgaagtatgtgaagcgtgctttatatcttctgcatctaacatgtggcccatctcatccaaacactgctgctacttacattaatgtggctatgatggaagaaggtctgggaaatgtacatgttgctctccgatatcttcacaaagctttaaagtgcaaccaaagattacttggtgcagatcatattcagacagctgcaagttatcatgcaatagcaatagcactttcattgatggaagcatatccattgagtgtccagcatgagcaaacaactttgcaaattctgcgggcaaaacttggccctgatgacttgcgcacacaggatgctgcggcttggcttgagtattttgagtccaaggcttttgaacagcaagaagctgctcgaaatggtactcgaaaacctgatgcatcaatagctagcaaaggccatcttagtgtgtcagatttgcttgactacattaatcctaatactaaagggagagatgcagcagcaaagagaagaagccagataacaaaggtgagagcaacgtcttacccaaacgttgggatgtcaagttctgatgaatcttcaaaagaaattccaaaagaggcttcagatgaagaggtacaaatacccatactagtaggtagtgcagattctgagcaggaaaacaactctggacctgatttggaacaagctattttgaaacaaatatcggacgaaaagccacaaatttatgatgaaatcttgtctgaagcacatgctgaaggagaggatggatggcaaccagttcaaagaccaagatcagctggctcatatggccggagactgaagcagagacgggcaacacttggcaaagtttatagttatcaaaagaatgtggaagttggctcagaatctccttttgtaaggagtcctaatccgagtagtaggtattatttcttgaagaagcggacaatttcacatgggagttatacagatgatcataccgtaaacatcacccaaggtactaaatttggaaggaaagtagtcaaagctgttacatacagggtcaagtctgtgccctcaacttccaagccttgtgtaaatgagaaattagaaaatggggataagctgctcagttctcttccagaacctgatccaactgatgctaatccagttaagaagtctattgttagtcttggaaagtctccttcatacaaggaagtggccttagctcctccagggacaatctctaagtttcaggtctataatcctcaaagtgtgatttctgttagcagtgagcatgatggtggaaaacatgaagaggaagatattgaagctgatagaaatgttaatgttgatccaaccccgacagaggtaaatgatatggttaaagagaagaatgatgattctttatcagattctgtagatgactcacaggatgatactggagttgctattgaggggaaagaagaaactcagttgattgttgctgtgcaagataattgtatgagtgctgaggggcaatcaggagatgttgaagctcaaggagcagttgataacagcatattgattcatgcagtagatgatcatgtggattcttccaagcaagaacttgatgcaagtaattcatctgccagtttagaacctagtgataatacaaatcccacttctcagggtggtgaggatttaaaggtcaatgtatcaccatcaagtcagagtcatactgggggcatcccatataagaaattgtctgcatctgcagctccattcaacccatcacctgccattgcacgtgctgcaccaattgccatgaatatgactcttccttctggtcctagtgcagttcctgcaattggcccctggccagtaaacatgaatgttcatcctggacctactactgtgctacccacagttgccccaatgtgctcctctccgcaccatgcatatccatcacctccagcgacaccaaacatgatgcaaccgctgccatttgtgtatcctccttttactcagcctcaatcagtagcacctagcaactatcctgtcactagcagtgcctttcatgccaatcattttacatatttgaacccaacaatatctaagtttggtcccagtgctgtttggcctggttgtcatcctgtagaatttcctcttccagtacctattgttgaaccaatccgtgatcccatttcagagtcacaagttctgtgtcatggctctgaaagtccaagttcagcttcagttcttcctgaggacattgacagtattggggattccaatcaaggggtaaaaactttatcatcagagataagtgaagatgaagcagtgagagctggttcagaaaatataaaagaaaatggtaatatgaattttcacgggtctgaaaatgctgggaacaagcaaaatcaaaactttggttcaaatggcagctctagcagtagtgaaactaacatggatggtgagaaaacctttagcattttgattcggggaagaagaaatcgaaagcagactctgagaatgccaataagtttgcttactcgacctaatggctcacagtcatttaaggttatttataaccgtgtggttagaggaagtcatgctaccaagtctatgaatttgtcttctagtaaagattgtacagctactgcatagtccacagttctttgttgttactaatgaaatgttgcagaataattgtgggtaaagaagttctcataattttgcacaacagagacctggtatttccatcatttctggaattgaattacaaagtgccctgttgtatcagctcaagtttcatagctgcactatcttttgggaggtttccgatatctgtgtctatttaagatggaggattgtaggcttttcttcattaatataagtctacaggttcatcgcagtcagtttcggggtttctgaggtgccttcaaggtgaaaattttggttcccaatgtagttagacaattttgatataatgaattacgggactgatggatcgttctaattattatttttttgtaacaacattatcaatgactttgataataattttgttcaattgcataaactttcttaatttcttaatatgttgttatgtggtagtagtagttcttttttgttgattgagttaatatttagttgttacaattgaaatgatgtgaaggaacgtcatattaatgaaaatcattatttgtttaaatacataaagc

SEQ ID NO: 8927 - DNA, 6270 bp, Medicago truncatula
ctcagcccttccttccttatcataccacactttcctctatattatctttctgcttccttctcctatttttcttcctctatcatttttcctcattcttgcacacttcattatcttcattctcaacctacctcatttatcactctttttcattttgtactttatattcttatcaataacacattaaagaaccccccctctctttctctttctgtcatcttcaacctcaaagttcatttaaagcacttgcttggaattgaaaatggccccaagatacagtcgtggaaaggccaagggagagaagaagaagaaggaagagaaggttcttcctgttgtcatggatatcacagtgaaccttccagatgaaactagtgttgttctcaaggggatatcaacggatagaataatagatgttcgtcggcttttatcggtgaatactgagacgtgttacatcaccaacttttcactatcacatgagataagaggtgtacgtttaaaggatacggtagatgtgtccgcattgaagccatgtctcctcactttagttgaagaggattacgattcagatggagcggtggcacacgtgcgaagacttctggacatcgttgcatgcaccaccagcttcggtccgtcgtctccgccgaagaatgcggcgaagtcgaccaaatctcaaccgcctccggcaaagcaattgcagaaagaagctgccgctgcggcggacgctgacggagatataagccactcatgtcctaagctcgagagtttctacgagtttttctctctttcgcatctcactgctcctcttcaatatgtgaagaaagcttccaagcgaaatgtggaggagatattggaggaggatcatctcttctcgctcgatgtgaaggtttgcaacgggaaagtggtgcacgttgaggcttgcagaaaggggttttacagtgttgggaagcagaggattctgtgtcataatcttgttgatttgctgagacagattagcagagcttttgacaatgcgtacgatgatctcttgaaggcattttcagaacgtaacaagtttggaaatctcccatatggcttcagatcgaacacttggctcgttcctcctattgcagctcaatcaccatcattttttcctcctcttcccgtggaggatgaaaattggggaggaaatggtggtggtctaggaagagacggagagtatgatttgattccttgggccaataagttttcttttattgcatctatgccctgcaagacagcagaagaaaggcaaggccgtgatagaaaagcatttcttctgcacagcctgtttgttgacgttgccattttcagagcaattagggctgttaaacatgttttggaagatcccagttttaactgctcagcagtagaaaatgatatttacagtgagagagtaggtgacttgagcgttagagtcttgaaagacggttctgttgcaagctgtaagattgattccaaaattgatggagttgaagctacaggagtaaatcaaaaggatctagtcgagcggaatttactgaaagggatcactgcagatgaaaatactgccgcccatgatattaccactttaggtgttgtttatgtaagatattgtggttatgtggttgttgtgaaagttgaaggtggagctaatgacaatgccaattcttcatttcatcaaaataatgaagtgtttgatcagccagagggtggtgccaacgcactaaatattaacagtttaagatttcgtcttcacagcacagccctgccagagaacaataaacagatgaacgagatacaaatgtttgagagtgaagagcttggtggtacagatgcttttgtggaaaagctgattaaaaaaagccttgctaagcttgaggaagaggaactaagttcggactattttgtaagatgggaactaggagcgtgctgggtacagcatttgcaagaccaaaacagtacagaaaaagataagaaaccatctttggagaaggctaacaatgaaatgaaggttgagggtcttgggaaacccctcaaagctctcaagaataataaaaagaaatctgattcaaccaatactaattgtgcatctgaacattcaaaatctaacctcgagggtgaaaatgatgcattgtcctcaagtgaatcccaacatgaaactgcagcagttgacaatgagcttgtgctgaaacggatgttatctgaggcagcttttacccgattgaaagaatcaggaactggacttcactgcaagtctatgcaagatttgatcgacttgtctcagaaatattacatggatgttgctatcccaaaactggtagcagattttggctcattggaactctctccagttgatggccgcacgctaactgattttatgcatactaggggtctacgaatgcgatctcttggacatgttgtcaagctttctgaaaaactttcacatgtgcaatcactttgcattcatgagatgatagttcgagctttcaagcacatcctgagggcagtgatttcttctgttgttgacaaggaaaacatggcttcatcaatagctggtgcattgaacttgctgcttggtgttcctgaaaataaagaatcagataaatcatgtgatgtccaccctcttgtgtggaaatggctagagttgtttttgaagaaacgatttgactgggatcttagcaggttgaactataaagatgtgcggaaatttgcaattctacgcggcttgtgtcacaaggtgggaattgagctcgttccaagggactttgacatggattctccatttcccttccaaaaatctgatattgtcagcttggttgcagttcacaagcaagcagcatgctcatctgcagatggaaggcagcttctggagtcctccaaaacagctttagacaagggaaagcttgaagatgctgttacctatgggacaaaggctcttgcaaagctcgtagcagtttgtggtccctaccatcggatgacagcaggagcatacagcctccttgctgtagttttatatcataccggagactttaatcaggctacgatctatcaacaaaaagctttggatatcaatgagagagagttaggtctggatcatcctgataccatgaagagctatggggatcttgctgttttctattacagacttcaacacacagaactggctcttaaatatgtgaagcgtgctttataccttttgcatctgacatgtggcccatctcatccaaatactgccgcaacttacattaatgttgctatgatggaggaaggtctgggaaatgtacacattgctctcagatatcttcacaaagcattaaagtgcaaccaaaaattacttggtgcagatcatattcagacagctgcaagttaccatgcaatagcaatagcactctcgttgatggaagcatatccgttgagtgtgcagcatgagcaaacaactttgcaaattctgagggcaaagcttggccctgatgacttgcgaacacaggacgctgcagcttggctcgagtattttgagtccaaggcttttgaacagcaagaagctgctcgaaatggtacgagaaaacctgatgcatcaatagctagcaaaggtcatctaagtgtgtcggatcttcttgactacattaatcctaatcacgatgccaaagggagagatgcagcagcaaagagaagaaaccaggtgagggcaatatcctaccagaacaatgtgtcagtaagttctgatgagtcttcaaaagaaattcagaaagaggcttcagatgaagagctacatatacctgaaccagcaagtagtgcagattctgagaatgagagcaactcagcacctgatccggaacagccaattttagaaaagatcttggatgaaaagccacaaccttctaatgaattattgtccgaagcacatcccgatggagatgatggatggcaatcagtacaaagaccaagatcagctggttcatatggtcggagactgaaacaaagacgggcaacacatggcaaagtttatagttaccagaagaatgtggaagttggcactgaacattcttcggtaaagagtgctaatcagaatagcaagtattatttcttgaagaagcggacaatacaccatgggggtgctgataaccgtgctgtaaacatcagccaaggcgctaaattcggaaggaaagcagtcaaggctgttgcgtacagggtcaagtctacaccatctgcttctaagactgttgcaaatgagacattagaaattgttggtgataaagaagttgattcaattgaggttaatcctgttaagacttctatagttagtcttggtaaaagtccttcatacaaggaagtagccttggctcctcctgggacaatctccaagttgcaggtctataatcctcaaaatgagatttctgttagtcaggaacatgatgttggaaaacatgaagaggaagatattgaagctcatagaaacatcgatccaaccccaaaagaggcgaataacgtgtttaaagagaagtctgacgattctttgtccgattctatagaagattcacaagatgatactgtagtttctactgagaagaaagaagaaactcagttgaataaagttgtgcaagatagttgtgcaactgccgaggggcttgaatctggggatgttgaagcacaaggagctgttgataacagcatagtgattgatgcagttgaagatgctatggaatcttacaaacaagaacttgttgcaagtgatttgccttgcagttttgaaccttctgataatacaagttctagtccacatggtggtgaggatttaggggtcaatttattatcacctagtcaaagccaagctgggggcatctcgtataagaaattgtctgcatcagcagctccattcaacccatcacctgccattgcacgtgttgcccctattgccatgaatatgtctcatccttctggtcccggtcctgttccagctattggcccctggccagtaaacatgaatgttcaccctggacctgctactgtgctacctgctggtaacccaatgtgttcctctcctcaccatgcatatccgtcacctccaacaacaccaaacatgctacaaccattgccattcatgtatcctccttatactcaacctcaatcagtacaaaccagcagtggctttcatgccaatcattttacatggcaatgtaatttgaatcctgtcatatctaagtttggtcctggtgctgtttggactggttgtcatcctgttgaatatcctcgtccagtacctattgttgaaccaatccctgatatcattttagagcctcaagtgcagtttcatgcagttgaaagtccaagtccagcttcagttctgcctgatgacattgataaggtcggggatttgaataaagaggtaaaaacttcagcatcagagatgagtgaagatgaaacggtgagagttggttcagaaagtataaaagaaaatggcaatccaaattttcctgggaccgacaatgctgggaacgatccaaatcaaattgtcggttccaacattagcaccagcagtagcgaaatgaacatggatgatgagaaaacgttcagcattttgattcggggaagaagaaaccgaaagcaaacactaagaatgccaataagtttgcttactcgacctcatggctctcagtcgtttaaggttatctataaccgtgtcgttagaggaaatgattctcccaggtccatgaatttctcttctagtaaacattgtacagctactgcttaacccacagtactttgttgttgctaatgaattgtagcaattattgtggatatagaagaactctacctcaaaagttctcgtgaagcatcgcggtatttcatcatttgtggattcattacaaattgctctgcctcgtgagctcagttttatagctgcagtatgccactatcttttttggatgttttcgatgtcactattcgtgcttaaatattgttgaaactgcctgaggaacagcattcatgctaatcatcttgctcagtctgcgggttcattgtagtcagttttgaggtttcagaggcaccttcaaggtgaatttggttttactatgtagttagacaattttgatatgatgaataacgcgaccaagagacagttaataattattattattttgtcaagccatttcaataattttgataactaatttgtttcaattgtatatacattcgtaatattttgttaggtgatagtggcactactttgtcagttgatttgttattgaatttgtgcaactgaaataatgtgatgga

SEQ ID NO: 8928 - DNA, 1683 bp, Sorghum bicolor
gtctccggtgagcaggagaagggggagggaggaggccaaggacgcagccgcgaagccaagcccacccgatccagtccctgccgccctgccccagctcgtctctcaggtcgccgtgccactgccagtcccgcgagcagctcagattcacgagctcgtctcctagatcttgcgccgtttggctgaattctgttctttgggagcaaagaggtgctggttggcggcgttgtttggtgctttgggggcggcgagtttttgcgttctcccgctgtgcttgtgttgctgctgcggcggggtggagatgggggtggcgggggagaagttccagttggggacggtgggggcgctcagcctctcggtggtgtcctccgtctccatcgtcatctgcaacaaggctctcatgagctccctcggcttcaacttcgccactactttgacaagctggcatctcctggtcacgttttgttctctccatgtggcattatgtatgaagctctttgagcacaaacctttcgatgcaaggaccgtcatgggatttggagtgctcaatggcatatcgattggacttcttaacttgagtctgggtttcaattctgttggtttctatcagatgacaaagctggctattattccctgtactgttatattggagacccttttcttcaggaagaaatttagtcggaatatcaaactctcccttagcgtgctccttgttggtgttggtgttgcaactgtaactgatctgcaactcaacactgtgggatctgtactgtcactgctggcaatcatcacaacctgtattgctcagattatgacaaatacaatacagaagaagttcaaggtatcttcaacgcagcttctgtaccaatcttgcccataccaagcattgactttgttccttatcggtccattccttgatggatttttgactaaccaaaatgtctttgctttcgattacacaactcaagttctgtttttcatcgtgttgtcatgcctgatttcagtctcagtaaacttcagtacttttctcgtgattgggaagacatctcctgtaacttaccaagttcttggccatctgaaaacatgcttggttctcacctttggctatgttctgcttcacgatccgtttagctggagaaacatacttggaatcctaattgcggtaattgggatggttttgtattcatacttctgcactagagagactcagcaaaaaccagcagaagtctccccacaagtaattcaggcgaaagagggtgaatcaaaccctctgatctcagactccctgagcgctgctgaaaacgggggcagtgccaccgacgacgaacctctgaaggtaccaatgtggagctcaaagtactcgaaggcgtgaaggctgttctgttactagtgtacggtgctatacagaattcagcttggttaggcagatactagggttggaaggcaaccctgttcctgttccatttttggccttctattttttttcttcctttctggcatatactataaatatatgtgctgtcagtaaatggatctcactcttgagaggataatacctcagctcgagacgagtggtctgcctgaaagctattttcttatgctccactccacatgtgtaacttggtagatggacatgatgtcaacagtagtagtttgcattcttttgtactagtagtatatgtatat

SEQ ID NO: 8929 - DNA, 1689 bp, Setaria italica
acaatatcttcggtataaaactcccctgtctccgtctccggtgagcgagcaagagcggaggggagggaggagaggaggccgagaaccgcagcagctcaagcagccgcggagccaaagcccggccgatccggtcgctgcttgcctctcaggtccccgcaccattgccagttctgctctcagattcacgagcttgtctcccagatccagcttcgcccgcccgaattctgtttattgggagcaaagaggtgctggtcggcggcgtggttaggttggttgcgccggggagtttctggttctcctccgcttgttttcctggtgcggcggtggagatgggggtggcgggggagaagttccagctggggacggtgggggcgctgagcctgtcggtggtgtcctcggtctccatcgtcatctgcaacaaggccctcatgagctccctcggcttcaactttgccactactttgacgagctggcatctcctggttacgttctgctctctccatgtggcgttatgtatgaagctctttgagcacaaacctttcgatgcaagaactgtcatgggatttggagtgctcaatggcatctcaattggacttctcaacttaagtctaggtttcaattctgttggtttctatcagatgacaaagctggctattattccctgtactgttatattggagacccttttcttcaggaagaaatttagccggaatatcaaactctcacttagcgtgctccttcttggtgttggtgtcgcaactgtgactgatttgcaactcaacactgtgggatctgtactgtccctgctggcaatcatcacaacctgtattgctcaaattatgacaaatacaatacagaagaagttcaaggtgtcttcaacccagcttctgtatcaatcatgcccgtaccaagcattgaccttgttccttgttggtccattccttgatggatttttgactaaccaaaatgtctttgctttcgattacactactcaagttctgtttttcattgtgctgtcatgcctgatttcagtctcagtaaacttcagcaccttccttgtgattgggaagacatctcctgtaacttaccaagtccttgggcatttgaaaacatgcttggttctcacctttggctatgtactgcttcatgatccatttagctggagaaatatactgggaatcctaattgctgtgattgggatggttttatattcatacttctgcactagagagacccagcaaaaacctgcagaagtctctccgcaagtcattcaggggaaggagagtgagtcaaacccgttgatctcagactctttaaatgctgctgaaaacgggggcagtaccccagatgatgaacccctgaaggtaccaatgtggagctcgaagtactcaagggcgtgaagattgctctgtcgttagtgtatggtattatacagaattcagtttagtaggcagataccagggttggaaggcaaccctgttcctgttgcatttttggcattttttgtctgggttatattatatgtactgttggtaaatggatctcactagtgagaggatactattgcttcctctattccagacgattgatctgaatgaatgcgctacatgctgtaacttggcagctggacatgatacagaaagtagtttacattcttttgtgctaccaaagagttgggggtccgcagag

SEQ ID NO: 8930 - DNA, 1702 bp, Oryza sativa
agctgcaggagaggcgaggaggcgaagcagcagcagctgaagcgagccgagccgatccctcctgcccctgctcgcctcccagatctccccgccattgccagttccccgccaagattcgcgcgcccttctcccagatccagcttcgcctattccgaattccgcgcaaggctctgtaggtggtctgattcggcgggttttggttggggaattttggtgttcctgctcggttttgtgcttgctgctggttgtggtggttcttgggagcggtggagatgggggtgacaggggagaagttccagctggggacggtgggggcgctcagcctctcggtggtgtcctcggtctccattgtcatctgcaacaaggccctcatgagctccctcggcttcaacttcgccactactttgacaagctggcatctcctcgttacattttgctctcttcacgtggcattatgtatgaagctctttgagcacaaaccttttgatgcaaggactgtcatgggatttggtgtgctcaatggcatttcaattggtcttctcaacttgagtctaggtttcaattctgttggtttctaccagatgacaaagctggcaattatcccctgcactgttatacttgagactcttttcttcaggaagaagtttagtcggaatatccagctctcccttagtgttctcctttttggtgttggagttgcaactgtgactgacctgcagcttaatgctgtgggatctgtcctgtctttgctcgcaatcattacaacctgcattgctcaaatcatgacaaacacaattcagaagaaattcaaggtatcttcaacacagctgctgtaccaatcatgcccataccaagcattgaccttgttcatcgtcggccctttccttgatgggtttttgactaaccaaaatgtctttgcttttgattacacatctcaagttgtgtttttcattgtgctgtcatgcttgatatcagtctcagtgaacttcagcacttttcttgtgattgggaaaacctctcctgtaacttaccaagtgcttggccatctcaagacatgcttggttcttgcctttggttatgttttgcttcacgatccatttagctggagaaatatacttggaatcctcattgctgtgattgggatggtatcgtactcatacttctgcacaaaagaggctccaccaaaacccactgaagcctccccacaactcaaccaggtaaaagaaagcgaatcggaccccttgatctcggactctttgagcactgctgaaaatgggggcaacgcaggcgacgacgaggctctgaaggtacctatgtggagctccaagtactcaaaggcatgaagaaactgctctgatgatactagtgtatggttctatacagagttcagcttagtaggcagatagtactagggttggaaggaagccaaccctgagtgtaatgaacgatgtctgttccatttttggtcttttttttttctttttgcttaccatgtggtgctgtcagtacatgaaatctcactttgaagaggaaattatttacctctacactccagatggcagattggccttaaagctagacacaaaagggctagatctctttgtaatatttttcatgtgttcaacttcagcatctgcttcagcattgtaacaacttgccagcaggacataatatcaacacgtagtttacattcttttttgta

SEQ ID NO: 8931 - DNA, 1723 bp, Brachypodium distachyon
gagggaggaagccaaggaaggaaggaaggacgcagcacgactgcaccgactgcgagccgagctgtcgagtcccccgatcagatcccctctcgccttctcagatctcgctgccgaggtttgctcctcccagatccagctcgcgggtgggtgagctcttgcggcgctccggagcaaagaggtcctgccgtcagcgtgattcggtcggttttcgttggccgggaagctgtttctttcggttctgcttgcttctttttgttgagcgacgagcggcggcggagatgggggtgggcggggagaagttccagctggggacggtgggggcgctcagcctctccgtggtgtcctcggtctccattgtcatctgcaacaaggccctcatgagctccctcggcttcatctttgccaccacgttgacaagttggcatcttctggtcacattttgttcactccatgtggcattatgtatgaagctgtttgagcacaaaccttttgatgcaaggactgttatgggatttggagtgctcaatggcatctcaattgggcttctgaatctgagtctcggtttcaattccgttggtttctatcagatgacaaagctggccattattccctgtactgttatattggagactcttttcttcaggaaaaagtttagtcgctacatccagctctcccttagcgtgctcctttttggtgttggagttgcaaccgtgactgacctgcaactcaatgctatgggatcaatactgtctttgctggcaatcgtcacaacctgcattgctcaaattatgactaatacaattcaaaagaagttcaaggtatcctcaacccagctactgtaccaatcatgcccataccaagcattgaccctcttcgttaccggtccattccttgatggttttttaaccaacaaaaatgtctttgcttttgagtacacgcctcaagttctgtttttcatcgtgctgtcgtgcctaatatcagtctcagtaaacttcagcactttccttgttattgggaagacatctcctgtaacttaccaagtcctgggccatcttaagacatgcttggttctcgcctttggttatgtcttgcttcatgatccatttagctggagaaacatacttggaatcctaattgcagtgattgggatggggctatattcgtacttctgcacccgggaaactcagcaaaaacccactgatgcctctccacaagtcactcaggtgaaagaaggcgaatcggaccctttgatctcggactccttgaacagcgctgagaacgggggtgctgcagccgacgacgagcctctgaaggtacccatgtggagctccaagtactcgcgggcatgaaaggctgctacagtcaatgttagtatatggtaatatacataattattcagcttagtaggcagatagtagggctggaaggaagtcagccctgagtgtaacaaacgttcctgtgcaatttttgggcctttttttcttgtttttttgtttaccatatctgtggtgttgttgttaagacttaagatggatctcactcttcagacagaaatggcactgttgttacatctactccaaaatgtggcggatctaccttggagctaagaaacacaggagttcacttgtattattatttcttttttgcatgttcagcgtctgattcgccgttgtaacttggcagcaaagacatgatatcaacatgcagtttacattctttcttt

SEQ ID NO: 8932 - DNA, 1729 bp, Festuca arundinacea
gggtggagtctccccaggaacgcagctagcacgactacacagcacgagctgccgaccgaccgcgagcggagagctgacccggatcccgatccctcccgctcctgcacctgcccacctcccagatctccctcccgagctcctcccccagatccagctcgaggcacttggattctcttctccccggagcaaagaggtcccgccggcggcggttctggtggagaagctagctcttcggtcccgcttgctgccgtttcttgctgctttctgtcggtaggccgcggcggagatgggggtggcgggggagaagttccagctggggacggtgggggcgctgagcctctccgtggtctcctcggtctccattgtcatctgcaacaaggccctcatgagcgccctcggcttcatcttcgccaccacgttgacaagctggcatcttctggtcacgttttgttcacttcatgtggcattatgtctgaaattctttgagcacaagcctttcgatgcaaggaccgttatggggtttggcgtgctcaacggcatctcaattgggctcctcaatctcagtctaggtttcaattctgttggtttctatcagatgacaaagctggccattattccctgcactgttatcctggagacacttttcttcaggaagaagtttagtcggtacatccagctctccctaagtgtgctcctttttggtgttggagttgcaactgtgactgatctgcaactcaatgctatggggtctgtgctgtctttgttggcaatcgtcacgacctgcattgctcaaattatgaccaacacaattcagaagaagttcaaggtatcttcaacccagctgctgtaccaatcatgcccataccaagcattgaccctgttcgttgttggtccattcctcgatggatttctgactaacaaaaatgtctttgcttttgactacacgccccaagttctgtttttcatcgtgctgtcgtgcctgatatcagtgtcggtaaacttcagcactttccttgtgattgggaagacatctcctgtaacttaccaagtccttggtcatcttaagacatgcttggttcttgccttcggctatgtcttgcttcatgatccatttagctggagaaacatccttggaatcctgattgcagtgattgggatgggactatattcatacttctgtacccgcgaaactaaacccactgaagcctctccgcaagtcactcaggtgaaagaaggtgaatcagaccctttgatctcggactccttaagcagcgccgagaacggggccgctgcagccgatgatgagcctctgaaggtacccatgtggagctccaagtacgcacgggcatgaacgccgctccgatgttggttcatggtactatacataattattcagcttagtaggcagatagtagggctggaaggaagccagccagccctgagtgtaatgaacgttccttgttccatttttgggcctttttttctttcttgcttttgttttggcttaccatgtccatggtggtgttgttaaaatggatctcactccgaatgactccaaatggcagatctaccttgaagctaagacacacacaattgctgggcacgagacctcttgtattatttttcacatgttcagcttcgaattcgcccttgtaaacttgtaacttggtagcaagacataaataccaacacgtagtttacattcttttaaaaaaaaaaaaaaaaaaaa

SEQ ID NO: 8933 - DNA, 1762 bp, Lolium multiflorum
caccgacgaggccaccaccgatataaaatacctcgtctccctccccgccgctgattcgcaaggccacgccaagccagacggagcgccaccgcgagccccatcctcgcaccgcccaccgatcccctccgcagatctccccgccattgctcgctccccgcccagattcgcgccctccttgcgcagatccaccgacgccgagcgcggtgctgccggcggcgtggtcaggctggtctgatcaggtgtgctattattgtttggagggtggcagcggagatgggtgtcggaggggagaagttccagctggggacggtgggggcgctgagcctctccgtcgtctcctcggtctccattgtcatctgtaacaaggccctcatgagcgccctcggcttcatcttcgccaccacgttgacaagctggcatcttctggtcacgttctgttcacttcatgtggcattatgtctgaaattctttgagcacaagcctttcgatgcaaggaccgttatggggtttggcgtgctcaacggcatctcaattgggctcctcaatctcagtctaggtttcaattctgttggtttctatcagatgacaaagctggccattattccctgcactgttatcctggagacgcttttcttcaggaagaagtttagtcggtacatccagctctccctaagtgtgctcctttttggtgttggagttgcaactgtgactgatctgcaactcaatgctatggggtctgtgctgtctttgttggcaattgtcacgacctgcattgctcaaattatgaccaacacaattcagaagaagttcaaggtatcttcaacccagctgctgtaccaatcatgcccataccaagcattgaccctgttcgttgttggtccattcctcgatggatttctgactaacaaaaatgtctttgcttttgactacacgccccaagttctgtttttcatcgtgctgtcatgcctgatatcagtgtcggtaaacttcagcactttccttgtgatcgggaagacatctcctgtaacttaccaagtccttggtcatcttaagacatgcttggttcttgcctttggctatgtcttgcttcatgatccatttagctggagaaacatccttggaatcctgattgcagtgattgggatgggactatattcatacttctgtacccgcgaaactaaacccactgaagcctctccgcaagtcactcaggtgaaagaaggcgaatcagaccctttgatctcagactccttaagcagcgccgagaacggggccgctgcagccgatgatgagcctctgaaggtacccatgtggagctccaagtacgcacgggcatgaacgccgctccgacgttggttcatggtactatacataattattcagcttagtaggcagatagtagggctggaaggaagccagccagccctgagtgtaatgaacgttccttgttccatttttgggccttttttctttcttgcttttgttttggcttaccatgtccatggtggtgttgttaaaatggatctcactccgaatgactccaaatggcagatctaccttgaagctaagacacacacaattgctgggcaggagacctcttgtactatttttcacatgttcagcttcaaattcgcccttgtaaacttgtaacttggtagcaagacataaataccaacacgtagtttacattctttttgtgccgagttcagtgtatgattggtaacgatctttgagctttcagtttgtggtatatgaatgggtt

SEQ ID NO: 8934 - DNA, 1875 bp, Oryza sativa
atccatctcatcaccgacgacgcgagaagagggacgaccttcccccgtataaaaactccacctttgtctcctcccctccccccttccctcccatcccccgattcgccaccgcgaatcccaccaccacccgcagatctccgcctcggcgccattgcccaccctccacgcccccgccagattcgcccagatccacagccgggtgcatccggcggcgtggctggggcgccctcgatcgggaagctttgatcttcgtaccctttttgcggtgggcgggcggcgggcggcggaggaggaggagatgggtgtcggcggggagaagttccagctggggacggtgggggcgctgagcctctccgtggtgtcatccgtctccattgtcatctgcaacaaggcgctcatgagctccctcggcttcaactttgccactaccttgacgagttggcatcttcttgtcacattttgctccctccatgtagcattatggatgaagttcttcgagcacaagcctttcgactcgagaactgtcatgggatttggagtgctcaatggcatctccattggcctcctcaacttgagtcttggttttaattctgttggattttaccagatgacaaagctggctatcatcccatgcactgttattttggagactcttttcttcaggaagaagttcagccggagtatccaactgtccctttcagtgctcctctttggtgtcggtgttgcaacagtgactgatctgcaactcaatgctgtgggatccgtattgtccttgctggcaattattacaacctgcatcgcgcaaattatgacaaacactatccagaagaagttcaaggtttcttcaacccaattattataccaatcttgcccctatcaatcactgaccctcttccttattggtccattccttgatggatttttgactaaccaaaatgtatttgcattcgactacacatcccaagttgtgtttttcattgtattatcgtgcttgatatctgtctcagtgaacttcagcactttccttgtgatcggaaagacttctcctgtcacttaccaagtcctgggccatcttaaaacatgcctagtactgacctttggttatgttttgcttcatgacccatttagctggagaaacatactcggcatcctaattgcagtagttggaatggtcttatactcatacttctgcacattggagggccagcaaaaaaacgccgaagtctccccacaacaggcgaaagaaggcgattcggctcctttgatctcagactctctgagcaaagttgagaacggaggtggagtggttgatgatgagcctctcaaggtaccgatgtggagctcaaagtactcaagggcgtgaaaataccttccttttagaaggcggcattatacaggattcaatttggtaggcggatagtagggttggaagccaacccagattgtaatgaacattccagttacatttttgggtttatttaacattactatctagtatctactagcagtaaaagggttcttgggaggattttaccttcaagatagcagatctgccttgaaacttagacaacagatattgtatgattgtatctggatatgctccacatctttctcactgtaacttcctatgggaacatagatccacagatagacttcattcttttgtaccaaagatccagagaactagagatctgcaaggttcaagtttgtgactgtaagtttatgtttactttggacccagtgatggagcttttgtatatttaggaccaagtgcaaagaggggttcttttccaacaagttttcaatgcaataacatggaacaattgttctcttcaatcatgtaatttcccatgttcaaaacaatatttttggctg

SEQ ID NO: 8935 - DNA, 1617 bp, Sorghum bicolor
acgagcgccaccgccttgatcccgcccgctcctcccccagatctcctcgccattgccgccgcgctacccagattcgcgccccctcctcgcccagatccgaccgcgggctctgcttggtttcccaagccgacggaggagcggtgcacccggccgcgtgattccggcggctcgattggaaattcgtgatctttcggcgggggcattcctcgggttggtctgtcggtgccggtggtgtggtggtgctgctgctgcgtttcgagggccgcggagatgggtgtcggcggggagaagttccagctggggacggtgggggcgctgagcctctccgtggtgtcctccgtctccattgtcatctgcaacaaggctctcatgagctccctcggctttaacttcgccactaccttgacaagctggcatctgctggttacattctgctcccttcatgtagcattgtggatgaagttctttgagcataagcctttcgattcaagaactgtcatgggatttggagtacttaatggaatctccattggactcctcaacttgagtcttggcttcaactctgttgggttttaccagatgactaagctggcaatcatcccgtgcactgtcattttagagacacttttcttcaggaagaagttcagtcggagtatccagatgtccctttctgtgctccttctcggtgttggtgttgcaactgtcactgatctgcaactcaatgctgtcggatccatactgtccttgctggcaattatcacgacttgcattgctcaaattatgactaacaccatccagaagaagttcaaggtctcgtcaacccaactgctttaccagtcttgcccttaccaatcactgaccctgtttctcattggcccctttcttgatggctttttgactaaccaaaatgtctttgcttttaattatacatctcaagttgtgtttttcatcgtgttgtcgtgcttgatatcggtctcagtgaacttcagcacttttcttgtgatcggaaagacatctcctgttacttaccaagtcctgggccatcttaaaacctgccttgttcttacctttggttatgttttgcttcacgatccatttagctggagaaacatacttggaatcctaattgcagtagttggaatggtcttgtattcatacttctgcacagtggagacccagcaaaaaaacaccgaagtctccccacagcaggtgaaagaaagcgaggcagcccctttgatctcagattctttgagcaaagctgaaaacgggggcggtggtgttgatgacgagcctttgaaggtacccatgtggagctcaaagtattcacgggagtgaaaatttctacctcttgacgatggcatcatacaggattcaatttagtaggcagatagtagggttggaagccaacccagagtgtaatgaacacatttcagttacatttttgggcttctttagcgtcacaatctactagcggtaaaaggatctgtttcttgggaggatgttaccttcagggttctcagatataccttgaaactagacagcagatattgtatgattgtatctggatatgctccacatcctcttactgtaacttccaactgggacatggcatgctta

SEQ ID NO: 8936 - DNA, 1855 bp, Setaria italica
gcgaagcgaaccgcccctctcgtctccctcctccccgtccctgattcgcgagaccagaggggcacgagcgccaccgccctgatcccgcccgctcctacccagatctcaccgccattgctgccgccctgcccagattcgcgccctcctcgcccagatccgaacgtggttctgatttccctagccgacacaggagcggtgctccgggcggcgtgattccagcggtttgattggaaagttttgatctttggggggcgttcgttggtttgcttgtcggtggtggtgcgtttggagagcggcggagatgggcgtcggcggggagaagttccagctggggacggtgggggcgctgagcctctcggtggtgtcctccgtctccattgtcatctgcaacaaagcgctcatgagctccctaggcttcaacttcgccactaccttgacgagctggcatctgctggttacattctgctccctacatgtagcattatggatgaaattcttcgagcataagcctttcgattcaagaactgtcatgggttttggagtacttaacggaatctccattgggctcctcaacttgagtcttggcttcaactctgttgggttctaccagatgactaagctggcgatcattccgtgcactgtcattttagagacacttttcttcaggaagaagttcagccggagtatccagatgtccctttctgtgctccttcttggtgttggtgttgcaacagtcaccgatctgcaactaaatgctgtgggatccacactgtccctgctggcaattatcacaacttgcattgctcaaattatgacaaacactattcagaagaagttcaaggtttcatcaacccaactgctctaccagtcttgcccttaccaatcactgaccctgtttctcattggccccttccttgatggctttttgactaaccaaaatgtctttgcttttaattacacatctcaagttgtgtttttcattgtgttgtcatgcttgatatctgtctcagtgaacttcagcacttttctcgtgatcggaaagacatctcctgttacttaccaagtcctgggccatctgaaaacatgccttgttcttacctttggttatgttttgcttcacgatccatttagctggagaaacatacttggaatcctaattgcagtagttggaatggttttatattcatacttctgcacagtggagacacagcaaaaaaacactgaagtctccccgcaacaggtgaaagaaagcgaggcagcccctttgatctcagactctttgagcaaagttgaaaacgggggtggtgttgctgatgacgagcctcttaaggtacccatgtggagctcaaagtattcgcgggagtgaaaatttcatcctcttgacgatggcatcatacaggattcaatttagtaggcagatagtagggttggaagccaacccagagtgtaatgaatgtttcagttacatttttgggcttctttagcgtcgcttattactagcggtgaatggatctgtttctctggaggacctttaccttcggagccgcaggtctaccttgaaactagacagcagatattgtatgattgtatctggatatgctccaaatcttcttactgtaacttccctggacatgcctatatccaaagatagactccattctttttgtaccaaagatccagataaccagagttgtgcataggttctagtttgtgctgttagttaatattcaccttggaccctgttatgcaagtgttgtatatttaaagtcatttaagaaaacatccattttcctttagttttccatttaagacttccgttgttgagctgcacgttaactgattatcatttcttgat

SEQ ID NO: 8937 - DNA, 1722 bp, Zea mays
atataataaagaagcgaagctaagcgagaccggaggggcacgagcgccaccgccttgatcccgcccgctcctccccagatctcctcgccattgccgccgccctgccaggattcgcgccctactcgcccagatccgaccgcggctctgattttccaactgacgcaggagcggtgggtctgaccgggcgcgacccgtcttctcatgggcgagacagcgtgatccctgcggctcgattgtaaattcgtgatctttcggggcattccttggtttgtctgtcggtgccggtggtgctgcgtttggagggccgcggagatgggcgtcggcggggagaagttccagctggggacggtgggggcgctgagcctctccgtggtgtcctctgtctccattgtcatctgtaacaaggcgctcatgagctccctcggctttaacttcgccactaccttgacgagctggcatctgctggttacattctgctcccttcatgtagcattatggatgaagttctttgagcataagccttttgattcaagaactgtcatgggatttggagtacttaacggaatctccattgggctcctcaacttgagtcttggcttcaactctgttgggttttaccagatgactaagctggcaatcatcccgtgcactgtcattttagagacacttttcttcaggaagaagttcagtcggagtatccagatgtccctttctgtgcttcttcttggtgttggtgttgcaactgtcactgatctgcaactcaatgctgtgggatccatactgtccttgctggcaattatcacgacttgcattgctcaaattatgacaaacactatccagaagaagttcaaggtctcatcaacccaactgctttaccagtcttgcccttaccaatcactgaccctgtttctcattggccccttccttgatggctttttgactaaccaaaatgtctttgcttttaattatacatctcaagttgtgtttttcatcgtcctgtcatgcttgatatctgtttcagtgaacttcagcactttccttgtgatcggaaagacatctcctgttacttaccaagtcctgggccatcttaaaacatgccttgttcttgcttttggttatgttttgcttcacgatccgtttagctggagaaacatacttggaatcctaattgctgtagttggaatggtcttgtattcatacttctgcacagtggagacccagcaaaaaaatgttgaagtctccccacaacaggtgaaagaaagcgaggcaggccctttgatcgcagactctatgagcaaagttgaaaacgggggtggtggtgttgatgacgagcctttgaaggtacccatgtggagctcaaagtactcgcgggagtgaaaaggtcacgatggcatggcaccatacaggattcaatttagtaggcagatagtagggttggaagccaacccagagtgtaatgaacatttcagttacatttttgggcttctttagtgtcgcagtctactagcagttaaaggatctgtttcttggaaggatcctaccttcagggctctcagacctaccttgaaactagacagcaggtattgtatgattgtatctcgatatgctccacatcctcttactgtaacttccaactggtacatggcgtgcctatatccaaagatagacctcattctttttgtatcaagaagatccggataagaagacttgtgcaagatttgt

SEQ ID NO: 8938 - DNA, 1697 bp, Brachypodium distachyon
ccagcccccaccgccgatcccgcccgcccctctgcagatctccccgccattgcccgctcctcgccctgattcgcgctctcctcgcccagatccatcgagacactgcgcggtgcttccgcgggcgcggtccgggcgctgtgatcaggaattttgatattttttcgtggtgctggtgttgggcggcggcggagatgggcgtcggaggggagaagttccagctggggacggtgggggcgctgagtctctccgtggtgtcctccgtctccattgtcatctgcaacaaggccctcatgagctccctcggcttcaccttcgccacaaccttgacgagttggcatctcctggttactttctgctccctccatgtagcattatggatgaagttctttgagcataaggcttttgattcaagaactgtcatgggatttggagtacttaatggcatctccattggactcctcaacttgagtcttggtttcaattctgttggtttttaccagatgacaaagctcgccatcatcccctgcactgttattttggagactcttttcttcaggaagaagttcagccgcactatccaaatatccctttccgtgctccttttgggtgttggagttgcaactgtcactgatctgcaactcaatgctgtgggatccatactgtccttgctggcaattatcacgacctgcatcgctcaaattatgacaaacactattcagaagaaattcaaggtttcttcaacccagctgctataccagtcttgcccttaccaatcactgacactgtttcttattggtccattccttgatggatttctgactaaccaaaacgtttttgctttcaattacacatctcaagttgtgtttttcatcgtgttgtcgtgcttgatatcggtctcagtaaacttcagcacctttcttgtgatcggaaagacatctcctgttacttaccaagtcctgggccatcttaaaacatgcctagttctaacctttggttatgttttgcttcatgatccatttagctggagaaatatactgggcatcctaattgcggtggttgggatggtcctatattcatacttctgctcagtagaggcccagccaaaaagtgccgaagtttccactcagcaggcgaaagaaagcgactcggcccctttgatctcagactctctgagcaaagttgaaaatggaggtgatgatgatgagcctctgaaggtaccgatgtggagctcaaagtactcgagggcgtgaaaatttctttagacaatggatggcattatacaggattcaatttagtaggcagatagtagggttggaagccaacccagagtaatgaagcaatgaacattccagttacatttttgggttcctttagggtcactatctactagcagtaaaaggatctgattcttcagagggatttaccttcaagagtgcagatctgctttgaagctagacatcggatattgtatgattgtatctggaaccatagtcaaaagttctcactgtaacttcatgttgggtattgatccacaggtagactccattcttttgtatcaaagatcctgggaaccaaatgtgcaacatttgaagtatttataggttcaagtctgtaactgtaagtttagatttagcttggacccagtgatgctagtgtacatttcagttcaaggaaaaaaataaaaacaagaagccctt

SEQ ID NO: 8939 - DNA, 1428 bp, Cenchrus ciliaris
cggtggtgtcctcggtctccatcgtcatctgcaacaaggccctcatgagctccctcggcttcaacttcgccactactttgacgagctggcatctcctggttacgttctgctctctccatgtggcattatgcatgaaactctttgagcacaaacctttcgatgcaagaactgtcatgggatttggagtgctcaatggcatctcaattggacttctcaacttaagtctaggtttcaattctgttggtttctatcagatgacaaagctggctattattccctgtactgttatattggagacccttttcttcaggaagaaatttaggtttgtaacatgccatgtgctttatgcagctcgataaataagcttctaatcgtttcactgactttattatgcagccggaatatcaaactctcacttagcgtgctccttcttggtgttggtgtcgcaactgtgactgatttgcaactcaacgctgtgggatctgtactgtccctgctagcaatcatcacaacctgtattgctcaaattatgacaaatacaatacaaaagaagttcaaggtatcttcaacccagcttctgtatcaatcatgcccgtaccaagcgttgaccttgttccttgttggtccattccttgatggatttttgactaaccaaaatgtctttgctttcgattacactactcaagttctgtttttcattgtgctgtcatgcctgatttcagtctcagtaaacttcagcaccttccttgtgattggcaagacatctcctgtaacttaccaagtccttgggcatttgaaaacatgcttggttctcacctttggctatgtactgcttcatgatccatttagctggagaaatatactgggaatctaattgctgtgattgggatggttttgtattcatacttctgcactagagaaactcagcaaaaacccgcagaagtctctcctcaagtcattcaggggaaggagagcgagtcaaacccgttgatctcagactctttaaatgctgctgaaaacgggggaaaaaacccagacgatgaacccctgaaggtaccaatgtggagctcgaagtactcaagggcgtgaatattgctctgtcgttagtgtatggtattatacagaattaggcagatatcagggttggaaggcaaccctgttcctgttccatttttggcattttttgtcttgcttatagaatatgtactgttggtaaatggatctcactcgtgagaggatactattgcttcctcttctccagacatctgcctgaatgaaagctggacatgagagctagctgcacagggtatttctgttacatttccgtgtgttctgaatgtgcagcatgctttaactttgtagccgaacatattacaaaacattctttgtactgctgcttccatcttaattgctggtcgttttcgtatt

SEQ ID NO: 8940 - DNA, 2474 bp, Theobroma cacao
gctgagtcaacatctcctctcttccttctttcccatctcctttccttgccttgccttgtttcgcccttctcccgtctcccgtctccctctgtcattttcatttatattacttttgtacatttctgttttgaaatacagctcattccttataacaccgacggatttatatgtaactgtctctgtttcccagatttccttcttttcggactcgcttactcttaagcttcgatttgcgcgaaatttgaagcgccagtgaggtaggaggagttcttgttcgtgatttctatacgtatagtgtacttatatgtgatccagaaccgtgggagattacgtagatccggatcacgagtaaaacaaaacaaaaatgagtgagaaccgcaagtttcagctcgggacagtaggtgctttgagtttatcggtggtctcctcggtgtccattgttatatgcaacaaggctcttatcagcactctcggtttcacctttgccacaactttgacaagctggcatctcctggtcacattttgttctcttcatgtggccttatggatgaaattgtttgagcacaagccttttgatgcaagagctgtcatgggatttggtatattaaatgggatatccattgggcttttgaatcttagtttgggtttcaattctgttggtttttaccagatgacaaaactggcaattattccctgcactgttcttttggagacccttttcttcaggaagagattcagtaggaatatccagctttcactggccattcttcttttgggtgttggaattgcgactgtgactgatcttcagctcaatctcctgggttctgtcctttctcttctggctgttattactacgtgcgtagctcaaattatgactaataccattcagaagaagttcaaagtatcttccacccaacttctctaccagtcttgcccttatcaggcgataactttgtttatcattggcccatttctggatgggcttttgactaaccagaatgtttttgctttcaagtatactcctcaagtgctgttcttcattgttctgtcctgcctgatatctgtctctgtcaacttcagtacatttctggtaattggaaagacatccccggtcacctatcaggtcctaggacatctgaaaacatgccttgttttggcgtttggttatgttctgcttcgtgatccatttagttggcgtaacattttggggatcttgattgctgtactcggaatggtcctttattcatattattgtactagtgagacccagcagcagaaggctagtgaagcatcagcacaattgccacaggtaaaggaaagtgaatctgatcctctgattagcgtggagaatggaagtgggatcttgagtgatggtgttggtccaaaagctcctgtatggagttcaaacaaagacctgcatgcataaaatgatggtaatgttaaagtcattggtcctagatggaaaacgtagtaatgaaaactgttccggcgatgaagatgttgctggtaagggtgggctaagtgttgtgcagcaacagatggggtaatttggagatgaaaacttatatagaatattagcttggaaagtggaaggaaatgcctaatgatataccagttttggttattggtagtggaatcaggaatttaggattcaggcgtggggaatggaattgcataccagaatttgatttgttacatgtataatggtcctagacaccgaacaatttttcctagcagttgtttctggttaaaaatattctatatttttgaagcaattaaggcgtattttattgatattcagaatgtaccttcctttcattaaggcgtccctgcttttgaagtatccgaaggggaaatgagttactatttttatttgtgggctcagtgaattaggcaactactagtaataaattcagggcaagtacccatattacgaatatgacgtctggattgcatttcggtactttagaataacaaaaacagaagacaacggtgcattcggtctcggtgatcggtgcatcctaatctatccagcgagccagccgagtcctttggaaggactctatttatatatggactgaaaacaagcgcaaaatagtattttgagattgaagatattattacatcgtcatagatggctgtaagagttgcgacccaagtactgaccagaaatattcaaaggccaggagcaggagttgtaaagttaaaccatatgcatttgcacgtccgccaacttgagacgttaacgctctgacctcccctatgactatcacgaactggagccagtcttcagcacagagataatggagcttcatcaccaaaagcaccaccagacgtacatcaccaacttcaacagagctcaggagcagctccgccatgccatgtccaaggccgactctaccaccattgttaagctccaaagttccatcaaattcaatggcggaggtgcctttttctcttctatccctttttct

SEQ ID NO: 8941 - DNA, 1591 bp, Vitis vinifera
attcatttctcacattttcccctcattcctttcacactacttcagtttcgttgagctgcttccctggttcgcgggtttgctcatttgcgtctcaattttctctggaatgagatccagatcgaggagagagtaattcggtgaagatgggtgagagccagcggttccagctgggaaccgtaggagcgttgagtttgtcggtggtttcgtcggtgtcgattgtgatttgcaataaggcgcttattagctcgcttggcttctctttcgccacaactttaactagctggcatcttctggtcacattttgttctcttcatgtggcactatggatgaaattatttgagcacaagccttttgatgctagagctgtgatgggatttggcatactaaatggaacatccattgggcttttgaatcttagcttgggtttcaattctgttggtttctaccagatgacaaaactggcaatcatcccctgtactgttcttctggaaacccttttctttaggaagagattcagccggagtatccaactttctctttctatccttcttttgggtgttgggattgcaacggtgactgatttgcagctcaatgccctgggttctgtcttatctttgcttgcagttattacaacctgtatcgctcagattatgaccaataacatccagaagaagttcaaggtttcttctacccaactcctgtatcagtcatgtccttatcaagccatgacattgttcattgctggcccatttctggattggcttctgactaagcaaaatgtttttgctttcaaatatacatctgaagtgctggtcttcattgttctgtcttgcctgatatctgtttctgtaaacttcagtacatttctagttattgggaagacatctcctgtaacataccaggtcctgggacatctaaaaacatgcctaattttggcctttggctatgttttactccacgacccgtttagctggcgcaacattctgggaatcctgattgctttaattggaatggtgctatattcttattattgctctcgtgagggccagcagaagcctagtgaagtatcagcacaaatggcccaggcaaaggaaagtgaaaccgatcctctaataggcgtggaaaatggagctgggatcttaacggatgctgttgttgcaaaagtccctgcttggaattcaaacaaagacctgcaggcataatatgcttcctcgctttcctacccattaattcctccatcctagatcaagattagcagacaaactctgtttcagccaagaagaagatgcttttggcagtgggtcatggaaccaagaatacgactttctgtcatagaagtagtctccagagctaagaggagatcacttttctattttttccatttgattttttttttttagctttgtatgagtttagggggttgaatgggattcatgcccccatttgattttttcaattggggttactttcccatcctaaaacacccataagtctccataactgttcctttttgtatgctcccttgaatattcttcttcctggtaagatgtattttttttaacggaagaaaatataatcctttcccttaata

SEQ ID NO: 8942 - DNA, 1561 bp, Panax ginseng
agtggtatcaacgcagagtacatggggaccttcatcatcaatttcagtgatccccaggtgatctctctctctccctcactcactccatagtctacccacacatgtttcatttatctttgagctggttgttggcttaattgttgtgaattttggataaatcattggaatgagattttgagatcaattgactgaaagctacagccagagaggagagtgtgtgcgcgcgatcaaaatgggtgatagccagctaggaacaattggcgctttgagtttatctgttgtttcttcggtctctattgtgatttgcaacaaggcccttatcagcacacttggtttcacttttgctactactttgacaagctggcatcttctggtcactttttgttcacttcacgtggcattatggatgaagctgttcgagcacaagccttttgacccaagagctgtcatgggttttgggatattgaatggaacatccattggacttctgaatcttagcctgggtttcaattcggttggtttttaccagatgacaaaactggcaatcatcccctgtacggttcttttggaaactcttttcttcaggaagaaattcagtaggaacgttcagctttcgcttactgtccttctcttgggcgtcggaattgcaactgttaccgacttgcagctcaatgtcgttggtagtgtcttatctctgcttgccgtgattacgacctgtgttgcccaaattatgaccaataccatccagaagaagttcaaggtttcttcaacccagctcctatatcaatcctgcccctatcaggcaatcacgctgtttcttgtaggcccgtttgttgatgggtttttgacaaataagaatgtatttgctttcaattataccccttatgtgctggcattcattgtgctttcctgcttaatatcagtttctgtaaacttcagcacctttctggtaattggaaagacatctccagtaacttatcaggtcctaggacacctaaaaacatgcctagttttggcctttggctatattctactccgagacccatttagttggcggaacattctaggcatcctggttgctgttgttgggatggtactctattcttattattgcactcgtgagacccaacagcagaaggccagtgaagcatcagcacagttgtcccaggcaaaggaaagtgaaagtgatccattgattaatgtagaaaacggaggtgatattcagaaagcccctgcatggaattcaaacaaggacttgcatgcatgaagtttccttaaaatgtaattacttaaatcaacctagttcagagatttcctatacgaggaaggatcaattacagtgatgaagatgtcacttaaagcaattaagggctcgtgggaattttgagaaaaagaaaataatactctttgttactagaggagctataaaggagacgttttgttgattactagaatttatggtactggctttgtacgagttaactattccactacataattatttggaaacatacggctatctcccatatgattctattaattttagtagactgcatatggc

SEQ ID NO: 8943 - DNA, 1983 bp, Vitis vinifera
caccgcctaacattttccccctaatcactgctctgtacctccttcacactgccttttcttttccttatataattaatccccacctttaatgtttcctaccttttctctcttgtaaggatccgatctgattgcccttttaatttctttgtttggtccccctgaaaatttgtgggttgttttgattccattcccggttttcccttgttttcctggtctcttgataaaacaaactgagggttgagttaatttgatttctccttttgtgggttttcttccttgccaattgggttgttcttgatttttgtttccttggaaactgccttgctgtcctctcgtttgcagttgagttgagctcttgctattgatcttcattttgtctgcttctgctagttcctccctggctttttctcagcaaccaaacagggcttggagttaccttgatttcgcctctggttccgctgagctgctgttgtttgattttgtcttctttgaagagtactttaaatgagatccaaatgaaggaggtgtgatcagagtggagacaagatgagtgagaacaaggggtttgagcttggaaccattggggcgttgagtttatctgtggtttcgtctgtgtcgattgtgatttgcaataaagctctcattagctcattgggtttcacttttgctactacattgacaagctggcatcttctggtcactttctgttctcttcatgtggctctatggatgaaattgtttgaacacaaaccatttgatgcaaaagctgttatgggttttggcattctaaatggaatctcgattggactcctgaatctgagccttggtttcaattctgttggtttctatcagatgacaaagctggcaatcattccctgtactgtactcttggagacccttttcttcaggaagaaattcagtaggagtatccagcttgctctttctatccttcttatgggtgtcggaattgcaaccgttactgatctgcagctcaatgccctgggctctattttatctgtcctcgcagttattacaacatgcattgctcagattatgacgaataccatccagaagaagttcaaggtttcttcaacgcaactgctgtatcaatcttgtccctatcaagcactgacgctgttcatctctggcccatttctggactggtttctgactagtcaaaacgtatttgctttcaaatatacaccgcaagttctggttttcattgttctatcctgcttgatctctgtctcagtcaattttagcacctttcttgtgattggcaagacatcgcccgtcacctatcaggtcctggggcacttgaaaacatgcctagtactagcatttggttatgttctacttcatgacccatttagctggaggaacattttagggattctgattgcattagtagggatggtcctgtattcatactactgcacccgtgagggtcagcaaaaaacttcagaagcatcagcacaatcttcttcacaggcaaaggaaggtgaagctgatcctctaatcaatatagagaatgaaactgggatattaaccgatgctgctgtcccaaaggccccagtatggagctcaaacaaagatttgcatgcatgaaggcatctttattacagttcatacatccaagagctgcagatggaaccattgcaataaggtgttggcaatggaggttccccaaggttgtcaatggcttgcacacccaaattacagagtaatggcaatttctcataccgatcaaggcatttatctgcgttgagaaacatacccttctttttcttgtgttggttcaagcagtaggcacctgagctccctagacttttgtgaggaatgcatataagtggtgtttttgtttctgggtagagaaaatatggggtccatttgaaacttttgataggttttaggctttgtttgaatcttggggaatgtaagaaaaaggaagctcaaaagggaaaataaataaataaataaatt

SEQ ID NO: 8944 - DNA, 1944 bp, Panax ginseng
actcgaccattcataagcagtggtatcaacgcagagtacatgggaccttcatcatcaatttcagtgatccccaggtgatctctctctctccctcactcactccatagtctacccacacatgtttcatttatctttgagctggttgttggcttaattgttgtgaattttggataaatcattggaatgagattttgagatcaattgactgaaagctacagccagagaggagagtgtgtgcgcgcgatcaaaatgggtgatagccagctaggaacaattggcgctttgagtttatctgttgtttcttcggtctctattgtgatttgcaacaaggcccttatcagcacacttggtttcacttttgctactactttgacaagctggcatcttctggtcactttttgttcacttcacgtggcattatggatgaagctgttcgagcacaagccttttgacccaagagctgtcatgggttttgggatattgaatggaacatccattggacttctaaatcttagcctgggtttcaattcggttggtttttaccaggtgacaaaactggcaatcatcccctgtacggttcttttggaaactcttttcttcaggaagaaattcagtaggaacgttcagctttcgcttactgtccttctcttgggcgttggaattgcaactgttactgacttgcagctcaatgtcgttggtagtgtcttatctctgcttgccgtggttacgacctgtgttgcccaaattatgaccaataccatccagaagaagttcaaggtttcttcaacccagctcctatatcaatcctgcccctatcaggcaatcacgctgtttcttgtaggcccgtttgttgatgggtttttgacaaataagaatgtatttgctttcaattataccccttatgtgctggcattcattgtgctatcctgcttaatatcagtttctgtaaacttcagcacctttctggtaattggaaagacatctccagtaacttatcaggtcctaggacacctaaaaacatgcctagttttggcctttggctatattctgctccgagacccatttagctggcggaacattctaggcatcctggttgctgttgttgggatggtactctattcttattattgcactcgtgagacccaacagcagaaggccagtgaagcatcagcacagttgtcccaggcaaaggaaagtgaaagtgatccattgattaatgtagaaaacggaggtgatattcagaaagccccagcatggaattcaaacaaggacttgcatgcatgaagtttccttaaaatgtaattacttaaatcaacctagttcagagatttcctatacgaggaaggatcaattacagtgatgaagatgtcacttaaagcaattaagggctcgtgggaattttgaggaaaaagaaaataatactctttggtacttagaggagctataaaggagacgttttgttgattactagaatttatggtaatggctttgtacgagttaactattccactacataattatttggaaacatacggcaatcccccatatgattctattaattttagtagactgcatatggctgaaaatagtataaaatgttataaaattttagcgaagtgtataaaatatactcttataattgctgcacaaatttagagagaataagcaagagaagagagaaattcttcagagaattcttcttcagagaagtttttctacttttttttttctttcacgttattctaatacctttactttaataggtacggccaacggacgtcgtaggtaaggttccattaggggaggaaggaaaggggaaccggaaagaaggatggggtaagggtcaccggtaagggaaaaaaggaaaagtagaggaaaaaagaaaggtcggttgggagggacgaagaccgcacgagggaggtagccccccccccccccccccca

SEQ ID NO: 8945 - DNA, 1497 bp, Panax ginseng
tatcaacgcagagtacatggggaccttcatcatcaatttcagtgatccccaggtgatctctctctctccctcactcactccatagtctacccacacatgtttcatttatctttgagctggttgttggcttaattgttgtgaattttggataaatcatcggaatgagattttgagatcaaattgatcaattgactgagagctacagccagagagggagagtgtgtgtgcgcgcgatcaaaatgggtgatagccagctaggaacaattggcgctttgagtttatctgttgtttcttcggtctcgattgtgatttgcaacaaggcccttatcagcacacttggtttcacttttgctactactttgacaagctggcatcttctggtcactttttgttcacttcacgtggcattatggatgaagctgttcgagcacaacccttttgacccaagagctgtcatgggttttgggatattgaatggaacatccattggacttctgaatcttagcctgggtttcaattcggttggtttttaccagatgacaaaactggcaatcatcccctgtacggttcttttggaaactcttttcttcaggaagaaattcagtaggaacgttcagctttcgcttactgtccttctcttgggcgttggaattgcaactgttactgacttgcagctcaatgtcgttggtagtgtcttatctctgcttgccgtggttacaacctgtgttgcccaaattatgaccaataccatccagaagaagttcaaggtttcttcaacccagctcctatatcaatcctgcccctatcaggcaatcacgctgtttcttgtaggcccgtttgttgatgggtttttgacaaataagaatgtatttgctttcaattataccccttatgtgctggcattcattgtgctatcctgcttaatatcagtttctgtaaacttcagcacctttctggtaattggaaagacatctccagtaacttatcaggtcctaggacacctaaaaacatgcctagttttggcctttggctatattctactccgagacccatttagttggcggaacattctaggcatcctggttgctgttgttgggatggtactctattcttattattgcactcgtgagacccaacagcagaaggccagtgaagcatcagcacagttgtcccaggcaaaggaaagtgaaagtgatccattgattaatgtagaaaacggaggtgatattcagaaagcccctgcatggaattcaaacaaggacttgcatgcatgaagtttccttaaaatgtaattacttaaatcaacctagtttagagatttcctatacgaggaaggatcaattacagtgatgaagatgtcacttaaagcaattaagggctcgtgggaattttgagaaaaagaaaataatactctttgttactagaggagctataaaggagacgttttgttgattactagaatttatggtactggctttgtacgagttaactattcca

SEQ ID NO: 8946 - DNA, 1742 bp, Gossypium raimondii
ttccttttttgtcggactctcaagtgatccttctaccttttaatggagcagatctagggttctttgattcttttttcatttttcttatctccttctcattcctgctgttgaagcagctgctcccacccacttctaattttcaaccaatctcgggaattttaagcgccattgaggtaggaatcgacgaggattcactacgtgcctctatacatacatattatcgacgtgtatgtgatcgaaaacccttggagattacgtagatccggatcactattgaagaaacataattcataagggaaaaatgagtgagaaccgcgagttccagcttgggacaataggtgctttgagtttatcggtggtctcctcggtgtccattgttatatgcaacaaggctcttatcagtactctcggcttcacctttgccacaactttgacaagctggcatctactagtcactttttgttctcttcatgtagccttatggatgaaattgtttgagcacaaaccttttgatgccagagctgtcatgggatttggtatattaaatgggatatccattgggcttttgaatcttagtttggggttcaattctgttggtttctaccagatgacaaaactggcaattatcccctgcactgttcttttggagacccttttcttcagaaagaaattcagtaggaatatccagctttcattggccattctacttttgggtgttggaattgcaactgtgactgatctgcagctcaatatcctgggttctatcctttctctgctggcagttgttacaacttgcatagctcaaattatgactaatacaattcagaagaagttcaaagtatcttcaacccaacttctctaccagtcttgcccttaccaggcattaactctgttcatcattggcccattcctggatgggcttttgactaacaagaatgtttttgctttcaagtatacccctcaagtgctgttcttcattgttctttcctgtctgatatcggtctctgtcaactttagtacatttctggtaattggaaagacatcccctgtgacatatcaggtcctaggacatctaaaaacatgccttgttttggcctttggttatgttctacttcatgatccgtttagctggcgcaacattttgggcatcttgattgccgtagttggaatggtcatttattcatattattgcactgttgagagccagcagcagaaggctagtgaagtatcaccacagttgccacaggttaaggaaagtgaatccgatcctctgattagcgtggataatggaagtgggatgttgagtgatggtgtaggtcctaaagcccctgtatggaatacgaacaaggacctgcatgcataaaatcttcaagatgttatattcattcgtcggagatgaaaaattagtaatgaaaagtgttccagcaatggaaaatggtggtggtaaaggtgacttatatgttgcacaggcggcacagcaacagtagtcatgttatgttggatgtttcataactgttgtaggttcaaagagtggagggaaatgcgttatgatattattagcagttttgattggtattatttgtgtatcagtggcgataatggaatggaatgctgcattccagaattggatttgtgaaatgtatgatgttcgaactccagatacccatcagttttatttgcaattatttctgttccatataatattgaagaaatgaatttaaattgtattcctatcctcatta

SEQ ID NO: 8947 - DNA, 1576 bp, Panax ginseng
atcatcaatttcagtgatccccaggtgatctctctctctccctgactcactccatagtctacccacacatgtttcatttatctttgagctggttgttggcttaattgttgtgaattttggataaatcatcggaatgagattttgagatcaaattgatcaattgactgagagctacagccagagagggagagtgtgtgtgcgcgcgatcaaaatgggtgatagccagctaggaacaattggcgctttgagtttatctgttgtttcttcggtctcgattgtgatttgcaacaaggcccttatcagcacacttggtttcacttttgctactactttgacaagctggcatcttctggtcactttttgttcacttcacgtggcattatggatgaagctgttcgagcacaagccttttgacccaagagctgtcatgggttttgggatattgaatggaacatccattggacttctaaatcttagcctgggtttcaattcggttggtttttaccaggtgacaaaactggcaatcatcccctgtacggttcttttggaaactcttttcttcaggaagaaattcagtaggaacgttcagctttcgcttactgtccttctcttgggcgttggaattgcaactgttactgacttgcagctcaatgtcgttggtagtgtcttatctctgcttgccgtggttacgacctgtgttgcccaaattatgaccaataccatccagaagaagttcaaggtttcttcaacccagctcctatatcaatcctgcccctatcaggcaatcacgctgtttcttgtaggcccgtttgttgatgggtttttgacaaataagaatgtatttgctttcaattataccccttatgtgctggcattcattgtgctatcctgcttaatatcagtttctgtaaacttcagcacctttctggtaattggaaagacatctccagtaacttatcaggtcctaggacacctaaaacatgcctagttttggcctttggctatattctgctccgagacccatttagctggcggaacattctaggcatcctggttgctgttgttgggatggtactctattcttattattgcactcgtgagacccaacagcagaaggccagtgaagcatcagcacagttgtcccaggcaaaggaaagtgaaagtgatccattgattaatgtagaaaacggaggtgatattcagaaagccccagcatggaattcaaacaaggacttgcatgcatgaagtttccttaaaatgtaattacttaaatcaacctagttcagagatttcctatacgaggaaggatcaattacagtgatgaagatgtcacttaaagcaattaagggctcgtgggaattttgaggaaaaagaaaataatactctttggtacttagaggagctataaaggagacgttttgttgattactagaatttatggtaatggctttgtacgagttaactattccactacataattatttggaaacatacggcaatcccccatatgattctattaattttagtagactgcatatggctgaaaatagtataaaatgttataaaaattttaaaa

SEQ ID NO: 8948 - DNA, 2837 bp, Brassica rapa
cattttgtaaacactaaacgtggtaagatcacgtgatggcacgtgagtaggtttcttcgtcttcttcgttgctccgatcagagaatcgaatcgccgacgacggagaaaaaaaaatggcctcctccgtgatttctctctctctgacaacgccattgaaagcgaactcctttagcaagtacaatctcactccgctgccttctctacgtcgcatctcttgctgctcaactcgcgagattactctcaaaccgcgtttggctcttcctgatacgtgtaagcagcggcgaagcgttgagcttttgactcgctgcggcgtttcgtcgaacgacttccccgctgagaaagagaaaaagaggagctttggggagtgggtcgagtttctgggagaggcggtgtcgacggcgtttccggtgtgggtatctcttgggtgcttgctggggctggtgaagccgagtgctttcaattgggtcactcctgatttgaccattataggtcttaccatcacgatgcttgggatggggatgactttgactctcgatgatcttcgcggcgcgttgaagatgcccaaagagctcttcgccggctttgtgttgcagtactcggtcatgccattatcagcatttctagtgagcaaactcttgaacttgccatcacattatgcagccggtctcatattggttggttgctgtccaggcggtacggcaagtaacattgtcacttacattgcacgtgggaatgttgcactatcggtgttgatgacagcagctagtactctttcagctgtgatcatgacgccgcttcttacggccaagctagccaaacaatacgtcgcagtcgatgctcttggactagtaaagtcaacactacaggtggttcttctcccagtgttggctggtgcatttatgaaccagtacttccaaagagtggtgaagtttgttactcctcttatggctccaatcgcggttggaacggtcgcgattctctgcgggactgcgattggtcagaacgcatctgccatactcgcttcagggaaacaagtggtcatggcttgtgtccttcttcacctctctggatttctctttggctatctgttctcgaggttactcagaatcgatgtggcctcgtcaagaactgtctctatcgaagttggcatgcagaactcggtgcttggacttgttctagcggcagagcattttgggaacccgctcactgcagtaccgtgtgctgtttctagcgtctgtcactccatcatcggtagcgtcttggctggtgtctggagacgcagtgctccaaaacagcttgaagactgagtcaggaccggtttagttaagtttgttgaacaaaaaaggtttggtcttgttgtagacttgtgagtgatgagcttttttgaaaaggctattatgtaataacaacacatgttaagggtaattttggaagtttaaagtcatcttctccaaatcaattttcttttcccttcctctctgacttgacttcagtttctttgtttggtttcttgctgataatttggttgttgggtggatcaaaagttccaagctttgtatctttgtttctttgtttttgctgttttgtgtggtagaaactctatggaagcagaaggagaaacacagtggagctctctcctagtaccttctgttctagagatcgccaaagagaacactgttcctccgaggtatcttcggtctgaacaagacaaaacagagactttggctgattcttgtctgagctcaaagctcccagttatcgacatgcagcgcttgtgttctgtttccgccatggataccgagctagagaagctcgatctcgcttgccaagattggggatttttccaactagtcaaccatggaatagattcttcttttcttgaaaagttagagacagaggctaaagacctcttcaacctccccatggaagagaagatgaaactctggcagagaagcggcgagttcgaaggattcggacaggtcaacatcgtctccgaggatcagaaacttgactggggagatatgttcatcctcaccaccgaacctattcgatcacgcaaacctcacttgttctccaagttacctccttctttcagagaaactgtggagacttactcctctcaagtgaagagcttagccaagactctctttgagaaaatggcgtgtgttcttgaggtcaaacgagaagagatggaagatttgtttggagatgtttggcaatctataaagatcaactactatcctccatgtccacagccggatcgagtcatcggtttgactccacattcagacgctgcaggtctcacgattctattgcaggtgaatcaagtggaagggcttcagatcaagaaagataacaaatgggttgtggtgaaaccgcttcaagatgctttagttgttaatgttggcgagatcctagagattataacgaatgggagatataaaagcatcgagcatagagtgatggtgaatgcagagaaagagaggttatctgttgctatgtttcacagtccgggaaaggagacggtgattggtccggcgaaaagccttgtggataagcacaagcaggaacgtttgtttaaaagtatgagtacacaagagttctttgatgccttctttgctcggaagctcaatgggaagtcacaccttgatcttatgactttggacccctcatcataaaagccatgtttccaactaaaaccatatagatctttcttacaagtctatctcatatatgtaataaagagaatcttcttgttcttcctcttgtcattgaagtcataataataaaaactaaggttctaagaatcaggtaaatggtttataaccgaaacgatt

SEQ ID NO: 8949 - DNA, 1233 bp, Brassica napus
tcctccgtggtttctctctctctgacaacgccattgaaagcgaactcctttcgcaagtacaatctcactccgctgccttctctacgtcgtatctcttgctgctcaactcgcgagatttctctcaaatcgcgtttggctcttcctgctacgtgtaagcagagacgaagtgttgagcttttcactcgctgcggggtttcgtcgaacgacttccccgctgagaaagagaaagagaaagagaaagagaaagagaggagctttggggagtgggtcgagtttctgggagaggcggtgtcgacggcgtttccggtgtgggtttctctcgggtgcttgctggggctggtgaagccgagtgctttcaattgggtcactcctgatttgactatcataggtctcacggtcacgatgcttgggatggggatgactttgactctcgatgatcttcgtggcgcgttgaagatgcccaaagagctcttcgctggctttttgttgcagtactcggtcatgccattatcagcatatctagtgagtaaactcttgaacttgccatcacattatgcagccggtctcatattggttggttgctgtccaggcggtaccgcaagtaacattgtaacctacattgcacgtgggaatgtcgcactgtcagtgttgatgacagcagctagtactctctcagctgtgatcatgacgccgcttcttacagctaagctagccaaacaatacgtcgcagtagatgctctcggactagtaaagtcaacactacaggtggttcttctcccagtgttggctggtgcatttatgaaccagtacttccaaagagtggtgaagtttgttactcctctcatggctccaatcgcggttggaacggtcgcgattctctgcgggactgcgattggtcagaacgcctctgccatactcgcgtcagggaaacaagtggtcatggcttgtgtccttcttcacgcctctggatttctctttggctatctgttctcgagattgctcagaattgacgtggcttcgtcaagaaccgtctccatcgaagttggcatgcagaactcggtgcttggacttgttctggcggcagagcattttgggaatccgctcactgcagtaccgtgcgctgtttctagcgtctgtcactccatcatcggtagcgtcttggctggggtctggagacgcagttccccaaaacagcttgaagactgagtcaggaccgtttagttaagtttgttg

SEQ ID NO: 8950 - DNA, 1528 bp, Raphanus sativus
  misc_feature (474)..(474): n is a, c, g, or t
  misc_feature (480)..(480): n is a, c, g, or t
  misc_feature (510)..(510): n is a, c, g, or t
  misc_feature (532)..(532): n is a, c, g, or t
  misc_feature (1350)..(1350): n is a, c, g, or t
  misc_feature (1502)..(1502): n is a, c, g, or t
gggctccgattagaaaatcgccggcgaagaaaaatggcctcctccgtggtttctctctccctctcaaacggaacaacgacgccgcaattgaaagcgaactcttttcgcaagtttaacctcactccagtacatctccggcgaatctcttgttcgacgagtcgcgagatatctctcgaatcgcgtcgccgagtggtggctcctcttcctattctgcataggcggcgacgaagcgtcgagctttttactcggtgcggagtttcttcgagcgacttccctgctgagaaagagaggaggaggaggagctttggggagtgggtggagtatctgggagaggcggtgtcgacggcgtttccggtgtgggtttcgctggggtgtttgctggggctggtgaagccgggggctttcaattgggtcactcccgatttgaccattataggtctcaccatcaccatgctcgggatggggatgacgttnactctngatgatctccgcggcgcgttgaagatgccnaaagagctcttcgctggctttntcttgcagtactcggtcatgccattatcagcatttctagtgagtaagctcttgaatttgccatcacattatgctgccggtctcatattggttggttgctgtccaggcggtacggcaagtaatatagtcacttacattgcacgtgggaatgttgcactatcagtgttgatgacagcagctagtactctttcagctgtgatcatgacgccgcttcttacggctaagcttgccaaacaatacgtcgcagttgatgctcttggattagtaaagtcaacactacaggtggttcttctcccagtgctggctggtgcatttatgaatcagtactttcaaagagtggtgaagtttgtctctcctctcatggctccgattgcggttggaacggtcgcgattctctgcgggactgctatcggtcagaacgcgtctgcgatactcacgtccgggaaacaagtggtcatggcttgtgtccttcttcacctctctggattcctctttggctatctgttttcgagattgctcagaattgatgttgcttcgtcaagaactgtctctatcgaagttggcatgcagaactcggtgcttggactagttctggcggcagagcattttgggaacccgctgactgcagtaccgtgcgctgtttctagcgtctgtcactccatcatcggtagcgtcttggctggagtctggagacgcagtgcccctaaacagcttgaagactgaaaaagaaatgaaaaagttgggattttttcactcagccaggaccgtttagttatgtcttttgaccaaaaggtttgtctttttggagagctaagaacngttttgtctttctttggtcagtcatgttttgtctttctttggtaattaaaaaaaaaactgtttatgtcggtcttgtttacggtgacatttacctttgaatcttccactctttcaaagacttcatgatctctaaacattaaacattttgttgnagacttgtaaatggtatgaggtttga

SEQ ID NO: 8951 - DNA, 1121 bp, Brassica napus
gtcttcgtcttcttcgttgctccgatcagagaatcgaatcgccgacgacggagaaaaaaaaatggcctcctccgtgatttctctcgctctgacaacgccattgaaagcgaactcctttcgcaagtacaatctcactcggctgccttctctacgtcgcatctcttgctgctcaactcgcgagtttactctcaaatcgcgtttggctcttcctgctacgtgtaagcagcggcgaagcgttgagcttttgactcgctgcggcgtttcgtcgaacgacttccccgctgagaaagagaaaaagaggagctttggggagtgggtcgagtttctgggagaggcggtgtcgacggcgtttccggtgtgggtttctctcgggtgcttgctggggctggtgaagccgagtgctttcaattgggtcactcctgatttgaccattataggtcttaccatcacgatgctggggatggggatgactttgactctcgatgatcttcgcggcgcgttgaagatgcccaaagagctcttcgccggctttgtgttgcagtactcggtcatgccattatcagcatttctagtgagcaaactcttgaacttgccatcacattatgcagccggtctcatattggttggttgctgtccaggcggtacggcaagtaacattgtcacttacattgcacgtgggaatgtcgcactgtcagtgttgatgacagcagctagtactctctcagctgtggtggttcttctcccagtgttggctggtgcgtttatgaaccagtacttccaaagagtggtgaagtttgttactcctcttatggctccaatcgcggttggaacggtcgcgattctctgcgggactgcgattggtcagaacgcctctgccatactcgcttcagggaaacaagtggtcatggcttgtgtccttcttcacctctctggatttctctttggctatctgttctcgaggttactcagaatcgatgtggcttcgtcaagaaccgtctctatcgagttggcatgcagaactcggtgcttggacttgttctggcggcagagcattttgggaatccgctaactgcagtaccgtgcgctgtttctagcgtctgtcactccatcatcggtagcgt

SEQ ID NO: 8952 - DNA, 5581 bp, Glycine max
aaataaatatttatataaaataaattacaagtgatccgggcgtacgcacgggttataccctcctcaacactaaaccctctctgtgtccctctccgttaaacccttgacggcgttcggacctgcttcgacggtggcggcaccatggttctcactaccgagggcgcgacgaactccgtcgaggcggtggcgttcagcttcctaaccgacgacgagatacggcggagcagccgcgtgaagataacgagtcccattctcgtcgattttttgctgcaccccgtgcctgatggactatacgacgccgctttgggccctttcgatgacaagtctctttgtaagtcgtgtggtcaaacttctaaacattgcccaggtcattttggtcatattgagctcgtttcccctgtctacaaccctctgatgttcaatattcttagcaatattctgcaaagaacttgtttcacttgccatcattttcgggcccccagcaaagaggttgatattcgtacatcccaattggagctcataatgaaaggggatattatcagggcaaaacgtttggaatctattatccctggaaaaagtgtggattcttttaatccagatgaatccatacatccaggtgatggagatgagagccagtgttatagtgctgagcaactgggagaaaattggacctcccttcaatttagtgaggcaatgtctgttctaaggaaattgctgacgaaaaaacataagaaatgtcaaaaatgtggagctaagaatcctaaaatcagcaaaccgacctttggatggtttcatatgaatgttctctcagctgatgaaactagagcagataccattagatctgtggaaagtgaaacaaccaatgatgatatatctttaggtggtggggatactacagacgtagaagatattacctctgcagggactgcaaaaagagataaaagaaaaaaagagaaattgtcttacaagcttgctgaacaaaataaactttctgggtctttgttaccttcacaggttaaaggtattttagagcttttgtgggaaaatgaagccaggctctgttcttatattaatgatattcaagatcagggttttggaaagaaagccggtcactcaatgttctttctagagaatatttttgtaccaccaatcaaatttcgtcccccaactaaaggaggtgataatgtgatggaacatcctcaaactgttttgttgactaaggttttacagtgcaacatatccttgggagatgcccatctaaataagtcagatccctcaaaggttctaagccggtggatggatcttcagcaatctgtaaacatgctattcgacaataaaactgcttctggcaagagagatgtcgctactggaatttgtcaattgctggagaagaaggaaggcatctttcgccagaaaatgatgggaaagagggttaattttgcatgtcgctctgtcatatcaccagatccttatttagcagtcaatgaaattgggattcccccttattttgctttaagattatcctatcctgagagagtgactccttggaatgtagtcaagttaaggaatgctatccttaatggtcctgaatcccatcctggtgctacacattatgctgataaagtatcaatagtcaagcttccaccaaaagggaagttgctttctttgacctcaaggaaattaccaacctcaagaggagttattttgcatcaagggaagatatctgaccatgaatttgaagggaaagttgtgtatcgccacttgaaggatggcgatgttgtgcttgtcaatcgacagccaacactccataaacctagtataatggcacatatagttcgtgttctaaagggggagaaaactgtacgcatgcactacgcaaactgtagtacatataatgctgatttcgatggtgacgagattaacgttcattttccacaagatgaaatttctcgggctgaagcttacaatattgtaaatgctaacaatcaatatgtgaaacctacaagtggggatccaattagagctttgattcaggatcatattgtaagtgctgctcttcttacaaaaaaggatacttttctaagttatgaagagttcaatcaactactgtacagttctggtgtatccatggctgggctaggctcattttatggcaaacatgggcagaaagttttcatctcaaattccgagagtgaaatgtttctgtttcctccagcaatatggaagcctgagcccctgtggacaggaaaacaggttatcagtgcattgctatactatatcaccagaggttcaccaccatttactgctgagaagaatgcaaaaatcccgtctaactttttcaagactcagatcaggaagggaaaaagatacaccgaagatacatcaaaaaagaaggataagcctgatgaggataaattattgatatataaaaatgatttggtgcgtggtgtagttgataaggctcaatttggtgactatggtatgatacatacagtacaagaactttatggatcaaatgttgctggcaacctactttcagcattaagtcggttattcactacctttttacagatgcatgggttcacatgtggagtagatgatcttatgttaacagaaggaaaggatgttgaaagaatgaatcaactcaaaagttgtgagataattggtgacagtgttcatcgtgaattcattggagtgaagaatagtgacaatatagatccagtcacattgcaattgaatattgagaaaaaaatacgcagtaatggagaagcagccttaacattggataggaagatgacaagcaatcttaactcaagaacaagctcagggatattaaagaagctactatctgaaggaatattgaaaccttcaggaaaaaattgtatttctcttatgactacatctggagctaagggtagtatggtgaatttccagcagatatcttctcatctaggccagcaagagttggaaggaaaacgagtcccacgcatggtttctggaaagaccttaccctgctttcctccttgggattgttcccctagagcaggagggttcattattgatcggtttcttacagcccttcatcctcaggaatactactttcattgcatggctggtcgtgaagggctagttgatactgcagtcaaaacatctcggagtggttacctgcaaagatgcctaatgaaaaaccttgagtgccttaaagtttgttatgatcatactgtccgtgatgcggatggttcaattattcagtttcactatggagaagatggtgttgatgtccatcaaactagctttatcaccgaattcggtgcattgtcaactaataaagaattggtttttagcaactattgccgtcaactagacagatccagtccatatattaacaaattgcctgaggctcttgaaggaaaagcagaaaaattctcgaaacagagaaatcttggttctatggagcaagcggatttcttaagattgatggagcataagtatgtctcatgtcttgctcaaccaggtgaaccagttggtgtattagcttctcaatctgttggagaaccggcaacgcagatgaccttgaatactttccaccttgctggtcgaggtgaaatgaatgtgacacttggaattccacgcttgcaagaaatcctgatggctgctgcacgtgatatcaaaactccatttatgacatgccccttgagacatgataaatctatgaaagatgctatttgtctcgctgataagttgaagaagattactgtagctgacataattaagagtatgaaagtttctgttgtaccagtaacggttcttggtggtcaagtttgcagtatatataaacttgtgatgaagctatataaatctaaacagtatccagaatacactgatattacccttgacgactgggaggaaactctaagggttaactttgttagagagttggaggatgccattcaaaatcacatgacattgctttctaaaattagtggcataaaaaaattcaagactgatccacaatcaaattattcaaacagctctgaagatgctcacagcaatggatcagaatctgagaaaaaaggtcaaaataatgatgacgacgatgaagatggtggtggtgttgaagacactgaagggtatgaagatcttggatcagatgcacaaaagagaaaactacaaggtactgatgaggttgattatgaggatggtcctgaagaggaaacacatgatggtgagctgtcagaggaaattgaaggtgatgaggatggcagtgatgttgatgccaatgagaattataacaatgtgacagatgctaataattctgaaggacttgaaaaaccctccaagtccaagactattgatgaaaaacaaaatttgaaacgagaaaagaaaaaatctgaaccaacaacaaaaaaatatgacagggcaatttttgtggaagccaaagggaagcattttgagatccactttagatttactggtgaacctcacattttgttaactcagattgctcagaggacagccaagaaggtttgcatccaaaattttggaaaggttggtgaatgtaaagctattacatgcaaagaaagtggagtaatctactatggtaaagatggcagaaaaaggattgagatttcagcctcagagaaagaacaaataccagcacttcagacatcaggggtacattttaaaacattttgggagttggaagatgatctggatgttaggtacatttattcaaacaacgtgcatgctatgctaaatgcttatggggtggaagcagccagggaaaccatcatcagggaagtgcagaatgttttcaagtcttatggtatatcagtaaatatccgacacttgacactcattgctgactttatgacgcacactggtagctatcgcccgatgaacagaacggggagcatagcagactctacatcccctttcatcaaaatgtgttttgagacggctggcaattttattgttgaagcagcttatcatgggcaagtggacaacttggagacaccatctgctagaatttgtcttggtttgccagtgaagatgggaactgggtgccatgacttgatacagaagctggagatatgatctggctggcttgttccttcagctttagacttttggccctcacatgcctggaggtcatgccaaattttgataccataattattgtgttgtgcgactaaatgccaaaatttcatggccatttttatctggcttcaaagtaattttgtttggatgtagtagtagcatagtttgaaatgccattcctcgtcccatatctatacataggtggttttcatggggccttgattttcccatttggtctgaagtgtatgttttcacctaatttaaatatttttgctccaaaataatggctcctatcccatcaagtgtggttggttatatcaatcacatgatgctattgggttttctttaaatatttttactgttttgcatatttattgacgatcaatccatgtgggatctcgacaatttgttcacaaagtattttgaaaagcaaaccatacggttaacttcgaggattgagtaagattgacacatttataaa

SEQ ID NO: 8953 - DNA, 5526 bp, Glycine max
taccctcctcaacactaaaccctctctgtgtccctctccgttaaacccttgacggcgttcggacctgcttcgacggtggcggcaccatggttctcactaccgagggcgcgacgaactccgtcgaggcggtggcgttcagcttcctaaccgacgacgagatacggcggagcagccgcgtgaagataacgagtcccattctcgtcgattttttgctgcaccccgtgcctgatggactatacgacgccgctttgggccctttcgatgacaagtctctttgtaagtcgtgtggtcaaacttctaaacattgcccaggtcattttggtcatattgagctcgtttcccctgtctacaaccctctgatgttcaatattcttagcaatattctgcaaagaacttgtttcacttgccatcattttcgggcccccagcaaagaggttgatattcgtacatcccaattggagctcataatgaaaggggatattatcagggcaaaacgtttggaatctattatccctggaaaaagtgtggattcttttaatccagatgaatccatacatccaggtgatggagatgagagccagtgttatagtgctgagcaactgggagaaaattggacctcccttcaatttagtgaggcaatgtctgttctaaggaaattgctgacgaaaaaacataagaaatgtcaaaaatgtggagctaagaatcctaaaatcagcaaaccgacctttggatggtttcatatgaatgttctctcagctgatgaaactagagcagataccattagatctgtggaaagtgaaacaaccaatgatgatatatctttaggtggtggggatactacagacgtagaagatattacctctgcagggactgcaaaaagagataaaagaaaaaaagagaaattgtcttacaagcttgctgaacaaaataaactttctgggtctttgttaccttcacaggttaaaggtattttagagcttttgtgggaaaatgaagccaggctctgttcttatattaatgatattcaagatcagggttttggaaagaaagccggtcactcaatgttctttctagagaatatttttgtaccaccaatcaaatttcgtcccccaactaaaggaggtgataatgtgatggaacatcctcaaactgttttgttgactaaggttttacagtgcaacatatccttgggagatgcccatctaaataagtcagatccctcaaaggttctaagccggtggatggatcttcagcaatctgtaaacatgctattcgacaataaaactgcttctggcaagagagatgtcgctactggaatttgtcaattgctggagaagaaggaaggcatctttcgccagaaaatgatgggaaagagggttaattttgcatgtcgctctgtcatatcaccagatccttatttagcagtcaatgaaattgggattcccccttattttgctttaagattatcctatcctgagagagtgactccttggaatgtagtcaagttaaggaatgctatccttaatggtcctgaatcccatcctggtgctacacattatgctgataaagtatcaatagtcaagcttccaccaaaagggaagttgctttctttgacctcaaggaaattaccaacctcaagaggagttattttgcatcaagggaagatatctgaccatgaatttgaagggaaagttgtgtatcgccacttgaaggatggcgatgttgtgcttgtcaatcgacagccaacactccataaacctagtataatggcacatatagttcgtgttctaaagggggagaaaactgtacgcatgcactacgcaaactgtagtacatataatgctgatttcgatggtgacgagattaacgttcattttccacaagatgaaatttctcgggctgaagcttacaatattgtaaatgctaacaatcaatatgtgaaacctacaagtggggatccaattagagctttgattcaggatcatattgtaagtgctgctcttcttacaaaaaaggatacttttctaagttatgaagagttcaatcaactactgtacagttctggtgtatccatggctgggctaggctcattttatggcaaacatgggcagaaagttttcatctcaaattccgagagtgaaatgtttctgtttcctccagcaatatggaagcctgagcccctgtggacaggaaaacaggttatcagtgcattgctatactatatcaccagaggttcaccaccatttactgctgagaagaatgcaaaaatcccgtctaactttttcaagactcagatcaggaagggaaaaagatacaccgaagatacatcaaaaaagaaggataagcctgatgaggataaattattgatatataaaaatgatttggtgcgtggtgtagttgataaggctcaatttggtgactatggtatgatacatacagtacaagaactttatggatcaaatgttgctggcaacctactttcagcattaagtcggttattcactacctttttacagatgcatgggttcacatgtggagtagatgatcttatgttaacagaaggaaaggatgttgaaagaatgaatcaactcaaaagttgtgagataattggtgacagtgttcatcgtgaattcattggagtgaagaatagtgacaatatagatccagtcacattgcaattgaatattgagaaaaaaatacgcagtaatggagaagcagccttaacattggataggaagatgacaagcaatcttaactcaagaacaagctcagggatattaaagaagctactatctgaaggaatattgaaaccttcaggaaaaaattgtatttctcttatgactacatctggagctaagggtagtatggtgaatttccagcagatatcttctcatctaggccagcaagagttggaaggaaaacgagtcccacgcatggtttctggaaagaccttaccctgctttcctccttgggattgttcccctagagcaggagggttcattattgatcggtttcttacagcccttcatcctcaggaatactactttcattgcatggctggtcgtgaagggctagttgatactgcagtcaaaacatctcggagtggttacctgcaaagatgcctaatgaaaaaccttgagtgccttaaagtttgttatgatcatactgtccgtgatgcggatggttcaattattcagtttcactatggagaagatggtgttgatgtccatcaaactagctttatcaccgaattcggtgcattgtcaactaataaagaattggtttttagcaactattgccgtcaactagacagatccagtccatatattaacaaattgcctgaggctcttgaaggaaaagcagaaaaattctcgaaacagagaaatcttggttctatggagcaagcggatttcttaagattgatggagcataagtatgtctcatgtcttgctcaaccaggtgaaccagttggtgtattagcttctcaatctgttggagaaccggcaacgcagatgaccttgaatactttccaccttgctggtcgaggtgaaatgaatgtgacacttggaattccacgcttgcaagaaatcctgatggctgctgcacgtgatatcaaaactccatttatgacatgccccttgagacatgataaatctatgaaagatgctatttgtctcgctgataagttgaagaagattactgtagctgacataattaagagtatgaaagtttctgttgtaccagtaacggttcttggtggtcaagtttgcagtatatataaacttgtgatgaagctatataaatctaaacagtatccagaatacactgatattacccttgacgactgggaggaaactctaagggttaactttgttagagagttggaggatgccattcaaaatcacatgacattgctttctaaaattagtggcataaaaaaattcaagactgatccacaatcaaattattcaaacagctctgaagatgctcacagcaatggatcagaatctgagaaaaaaggtcaaaataatgatgacgacgatgaagatggtggtggtgttgaagacactgaagggtatgaagatcttggatcagatgcacaaaagagaaaactacaaggtactgatgaggttgattatgaggatggtcctgaagaggaaacacatgatggtgagctgtcagaggaaattgaaggtgatgaggatggcagtgatgttgatgccaatgagaattataacaatgtgacagatgctaataattctgaaggacttgaaaaaccctccaagtccaagactattgatgaaaaacaaaatttgaaacgagaaaagaaaaaatctgaaccaacaacaaaaaaatatgacagggcaatttttgtggaagccaaagggaagcattttgagatccactttagatttactggtgaacctcacattttgttaactcagattgctcagaggacagccaagaaggtttgcatccaaaattttggaaaggttggtgaatgtaaagctattacatgcaaagaaagtggagtaatctactatggtaaagatggcagaaaaaggattgagatttcagcctcagagaaagaacaaataccagcacttcagacatcaggggtacattttaaaacattttgggagttggaagatgatctggatgttaggtacatttattcaaacaacgtgcatgctatgctaaatgcttatggggtggaagcagccagggaaaccatcatcagggaagtgcagaatgttttcaagtcttatggtatatcagtaaatatccgacacttgacactcattgctgactttatgacgcacactggtagctatcgcccgatgaacagaacggggagcatagcagactctacatcccctttcatcaaaatgtgttttgagacggctggcaattttattgttgaagcagcttatcatgggcaagtggacaacttggagacaccatctgctagaatttgtcttggtttgccagtgaagatgggaactgggtgccatgacttgatacagaagctggagatatgatctggctggcttgttccttcagctttagacttttggccctcacatgcctggaggtcatgccaaattttgataccataattattgtgttgtgcgactaaatgccaaaatttcatggccatttttatctggcttcaaagtaattttgtttggatgtagtagtagcatagtttgaaatgccattcctcgtcccatatctatacataggtggttttcatggggccttgattttcccatttggtctgaagtgtatgttttcacctaatttaaatatttttgctccaaaataatggctcctatcccatcaagtgtggttggttatatcaatcacatgatgctattgggttttctttaaatatttttactgttttgcatatttattgacgatcaatccatgtgggatctcgacaatttgttcacaaagtattttgaaaagcaaaccatacggttaacttcgaggattgagtaagattgacacatttataaa

SEQ ID NO: 8954 - DNA, 1368 bp, Cajanus cajan
gcactacaccctactaatagatcgtcaatattttgaacccgtttttcctaatcgggtcgaaacaggagctccgacaccgacgggtcacacagctgaagagtgaaggaaaaaggagaagaatttgagcggccatggcatggaaccatcttcgaaacctgaatcgcatctccatacaccgcattcttcatcatcgttttcagcctctcgtcaacgctaggttcttctccgacgctgctgcttcattgcctcaaccgcaacccaaacagccttcgcctccctcatccttgaaggacaatgaactcgccaagttcgctgccatctccgatacctggtgggattctgaaggcccctttaagccattgcatgcgatgaatcctacaaggcttgctttcatccgctctgcactatgtcgacattttaagaaagatccttatagtgctaaacctctcgagggacttaaaattgttgatgtaggttgtggaggtggaattctttctgagccattagctcgattgggagctactgtgacgggtgttgatgctgtagagaagaatatcaagattgctcaacttcatgctggtttggatccagaaacttcaactattgagttttgttgcacaacagctgagaagcttgttgaagaaggaagaaaattcgatgccgttatggccttggaggtgattgagcacgtggcagatcctgcagagttctgcaaatctctggcagcattaacaattgcagacggagccactgtgatatcgacaatcaatcgttctatgagagcctacgcaactgcaattgttgctgcggaatacattctccactggcttcccagaggcacacatcaatggtccagttttctcactccagaagagctcgtcctcatcctgcaacgcgccggtatcaatgtggaggagatggcaggattcgtgtacaacccggtgacaggacggtggtctttgtcagatgatatcagcgtaaatttcatcgccttcggtaccaaatcgagtaacaacgaataagatacacgataaaatacgcactactacgatttatagtttttagtattgaaatttgtaatgaatggtggagggaggagtgaattgcatgatgcaagacttgatgtagaggattgcgatgctgtcgtcaaagtgcaagaggccaacaagttaggtattgtaagaggaatgccggcaataacacattttctaacatacattatcgatagtcaattttttaaaactacaagatcatcattgataggagttaaataagatgaatcactgaaaaagtgtaattttcaataaatttgaatcaattaacaggtgtgttcagttggattttattaaatcaatcattaaattagaa

SEQ ID NO: 8955 - DNA, 1012 bp, Trigonella foenum-graecum
catcaaaagccaaatcaaaacggcggtgaaaccactgtgaaatagaagaaacagtggccactgcgcgcgccgtttaacccctaaccatgaaactcttgaatcatctccgaaacctaaacgcaatcaaaatccaccaccgcattctccataatcgattccaccctctcttcttcaacaacccaaagttcttctccgattcttcattacctcagcctcaacaacccaccactccacatgttcaacaaccttctcctcattcttccttgaaccgcaatgaactcgccaagttcgctgccattgctgaaacctggtgggattctgaaggcccttttaaaccattgcatgtgatgaatcctacaagacttgctttcattcggactgcattgtgtcgacatttcaagaaggatccttacagtgctaaaccccttgaaggacttaaaattgtcgatgtgggctgtggaggtggaattctttccgagccattagctcggatgggagctactgtgacaggtgttgatgctgtggaaaagaatatcaacattgctcgacttcatgctgaatcggatccaactacttcaactattgagttttgttgcacaacagctgagaagctagttgaagaaggagaaaaattgatgcagtcatggccttggaggtgatcgagcacgttgcggaacctgcagagttctgcaaatctctagcagcgttaaccattccagatggagctaccgtcatatcgacgattaatcgttcaatgagagcctatgcaactgccattgttgctgcagaatacatcctacgctggcttccaatgggcacacatgagtggtccaaatttcttactccagaggaattagttttgatcctgcaacgtgccggtatcaatgtggaggagatggcaggattcacgtatgacccagtgacaggaagatggtctttatcagacgatataagcgtcaatttcattgccatgggcactaaaacaaacaacactgaatagaataggatagat

SEQ ID NO: 8956 - DNA, 1529 bp, Medicago truncatula
ccaatttaattttttcagcggcagaaccaaacactcccttaagaaacgatttattaacactttggcaccgttgggacttcgccgctacacgcgccgttaaccgccgttttgccgccaccgccgtttcgcaaccgtcttcttacctaccctgtacctcaatctcatttcgtgtcgttgtgcgcacatctcactgaaagagaagaagcagtgcattttttcttcggagccatgaaactcatgaatcatctccgaaacctaaacaacggtatcacaatccaccaccacattctccgtaatcgatttcaccctctcttcttcaactaccccaaattcttctccgattcttcattgcctcaacaacccaccactcctcacgttcaacaacctccgcctccttcttccttgaaccgcaatgaactcgccaagttcgctgccattgctgaaacctggtgggattctgaaggcccttttaaaccattgcatgtgatgaatccaacaagacttgctttcgttcggtctgcattgtgtagacatttcaagaaggacccttacagtgctaaaccccttgaaggacttaaaattgttgatgtgggctgtggaggtggaattctttccgagccattagctcggatgggagctactgtgacaggtgttgatgctgtggaaaagaatatcaacattgcccgacttcatgctgaatcggatccaactacttcaactattgagttttgttgcacaacagctgagaagctagttgaagaaggaagaaaatttgatgcagtcatggccttggaggtgatcgagcacgttgcagaacctgcagagttctgcaaatctctagcagcattaacgattccagatggagctaccatcatatcgaccattaatcgttcaatgagagcctatgcaaccgccattgttgctgcagaatacatcctacgctggcttccaactggcactcatgagtggtccaaatttcttactccagaggaactagttctgatcctgcaacgtgccggtatcaatgtggaggagatggcgggattcgcgtataacccagtgacaggaagatggtcgttatcagacgatataagcgtcaatttcattgccatgggcactaaagcaaacaacactgaatagaataggatagataaaaaaaattacacttagaactttcactttatttatttatttgtaagatgattttaaatttgtcctgaatgctgaataaatactgaaactgtttattgagactaaacacatcagaacaaaatactgaagggaacttggacatggattgctagtttctctagatacattgggaaatcagatgtcgtgaaaggctgaattgcccgctattctgcaaggtctttatctagccaggagcaagggttcacccacgttgtgtgttacactgattttgtgttgtctgttttgtgtcaatcttgttaaaaatgcaacttcagagtttaacaagtatgctaccattattcaagttatgaaggatatgctgctagctaattcacact

SEQ ID NO: 8957 - DNA, 1729 bp, Medicago truncatula
aaacactctgacgtgctcactaatcaaccccaatttaattttttcagcggcagaaccaaacactcccttaagaaacgatttattaacactttggcaccgttgggacttcgccgctacacgcgccgttaaccgccgttttgccgccaccgccgtttcgcaaccgtcttcttacctaccctgtacctcaatctcatttcgtgtcgttgtgcgcacatctcactgaaagagaagaagcagtgcattttttcttcggagccatgaaactcatgaatcatctccgaaacctaaacaacggtatcacaatccaccaccacattctccgtaatcgatttcaccctctcttcttcaactaccccaaattcttctccgattcttcattgcctcaacaacccaccactcctcacgttcaacaacctccgcctccttcttccttgaaccgcaatgaactcgccaagttcgctgccattgctgaaacctggtgggattctgaaggcccttttaaaccattgcatgtgatgaatccaacaagacttgctttcgttcggtctgcattgtgtagacatttcaagaaggacccttacagtgctaaaccccttgaaggacttaaaattgttgatgtgggctgtggaggtggaattctttccgagccattagctcggatgggagctactgtgacaggtgttgatgctgtggaaaagaatatcaacattgcccgacttcatgctgaatcggatccaactacttcaactattgagttttgttgcacaacagctgagaagctagttgaagaaggaagaaaatttgatgcagtcatggccttggaggtgatcgagcacgttgcagaacctgcagagttctgcaaatctctagcagcattaacgattccagatggagctaccatcatatcgaccattaatcgttcaatgagagcctatgcaaccgccattgttgctgcagaatacatcctacgctggcttccaactggcactcatgagtggtccaaatttcttactccagaggaactagttctgatcctgcaacgtgccggtatcaatgtggaggagatggcgggattcgcgtataacccagtgacaggaagatggtcgttatcagacgatataagcgtcaatttcattgccatgggcactaaagcaaacaacactgaatagaataggatagataaaaaaaattacacttagaactttcactttatttatttatttgtaagatgattttaaatttgtcctgaatgctgaataaatactgaaactgtttattgagactaaacacatcagaacaaaatactgaagggaacttggacatggattgctagtttctctagatacattgggaaatcagatgtcgtgaaaggctgaattgcccgctattctgcaaggtctttatctagccaggagcaagggttcacccacgttgtgtgttacactgattttgtgttgtctgttttgtgtcaatcttgttaaaaatgcaacttcagagtttaacaagtatgctaccattattcaagttatgaaggatatgctgctagctaattcacacttaattagggaaggcaactgctatgccaatttcatgaccaagtttggtactaccaatgacgacaattctcctcaagttattagcattttaattcttgctcattgcttctcgtttgtgagaagctgatattctgttcttgtctttttcctttctctgccaaactctaccaaag

SEQ ID NO: 8958 - DNA, 1359 bp, Glycine max
ggaaacactatttaagttgaaaccatattggacttagaaacgattaagtgagcaacacaacacaaccacacccatcattatctccttctccatctccatggcttccttacccagttttgctccttttgtatttctattgcttgtaattgggagcaatgcaaggactttgtatccacttcccagcaaaggtggtaatgggagtaggaagcccctacaaacttttcgcccttataacattgctcatcgcggttcaaacggagagcttcctgaagaaacgcgtcctgcatacttgagagctattgaggagggtgcagacttcattgaaactgatgtcttatcttccaaagatggtgttcttatatgtttccatgatgttacccttgatgatactactgacattgcaaatcacacagggtttgctaaccgtaaaagaacatatgaagtccaagggataaacatgactggcttttttcctgttgatttcacattaaaggaactaaagtcattgagggtgaagcagaggtatagcttcagggaccaacaatttaatggaaaatttcaaatcatcacttttgaagagttcattaccatagcacaggatgcacccagagttgttggaatatatccagagataaaaaatccagtatttatcaatcaacaagttaaatggtcacatggcaaaagatttgaggacaagtttgtggagacacttcagaaatatgggtacaagggttcctacctgtcaaaagattggttgagacaacctgtatttattcagtcatttgctccaacttcactcgtgtatatatcaaacaaaacggacttgcccaagattttcttaattgatgatgttattgttccaacgcaagacactaatcagtcattttgggagattacatctgatgaatacctagactacataaagcaatatgttgtgggaattggaccttggaaggacacagtggtacctgtggtagaaaattatatgacaaatcctactaatcttgttgccagggcacatgctcataacctgcaggtgcatccatatacttaccgaaatgagttcccatttttgcacttcaacttcagtcaagatccgtatatggagtatgattactggatcaacaagataggcgttgatggtctctttacagacttcactggtagtcttcatcgttatcaggaatggacctctaaccataaagatgatgatgacaagaatctattgcataaaattgctttgttagtctcctcttatgaatgatcatcttgagaatacatatggcaataagtgtttggattaatttattgtgctcaaaaaatgcttataataatatttaccggagagcttttgagttt

SEQ ID NO: 8959 - DNA, 1595 bp, Glycine max
gaaagaatcttccaatgcggagaacattcgtagagtccagcataagcatttcggcgccaatcataaagcctctgtctgagtctgaccaataattttaacatttttcattcgttcttaggataaaattaaaatcgttcacaccaacaggaaacactatttaagttgaaaccatattggacttagaaacgattaagtgagcaacacaacacaaccacacccatcattatctccttctccatctccatggcttccttacccagttttgctccttttgtatttctattgcttgtaattgggagcaatgcaaggactttgtatccacttcccagcaaaggtggtaatgggagtaggaagcccctacaaacttttcgcccttataacattgctcatcgcggttcaaacggagagcttcctgaagaaacgcgtcctgcatacttgagagctattgaggagggtgcagacttcattgaaactgatgtcttatcttccaaagatggtgttcttatatgtttccatgatgttacccttgatgatactactgacattgcaaatcacacagggtttgctaaccgtaaaagaacatatgaagtccaagggataaacatgactggcttttttcctgttgatttcacattaaaggaactaaagtcattgagggtgaagcagaggtatagcttcagggaccaacaatttaatggaaaatttcaaatcatcacttttgaagagttcattaccatagcacaggatgcacccagagttgttggaatatatccagagataaaaaatccagtatttatcaatcaacaagttaaatggtcacatggcaaaagatttgaggacaagtttgtggagacacttcagaaatatgggtacaagggttcctacctgtcaaaagattggttgagacaacctgtatttattcagtcatttgctccaacttcactcgtgtatatatcaaacaaaacggacttgcccaagattttcttaattgatgatgttattgttccaacgcaagacactaatcagtcattttgggagattacatctgatgaatacctagactacataaagcaatatgttgtgggaattggaccttggaaggacacagtggtacctgtggtagaaaattatatgacaaatcctactaatcttgttgccagggcacatgctcataacctgcaggtgcatccatatacttaccgaaatgagttcccatttttgcacttcaacttcagtcaagatccgtatatggagtatgattactggatcaacaagataggcgttgatggtctctttacagacttcactggtagtcttcatcgttatcaggaatggacctctaaccataaagatgatgatgacaagaatctattgcataaaattgctttgttagtctcctcttatgaatgatcatcttgagaatacatatggcaataagtgtttggattaatttattgtgctcaaaaaatgcttataataatatttaccggagagcttttgagttttgaccgaggacatgtttgagtaaatttttttagaaatacttctaggagaagaaaataagaagaaaaaaataaaatgagttttttcctaag

SEQ ID NO: 8960 - DNA, 1366 bp, Trigonella foenum-graecum
aagaagacttggaaacaatgacctgagtgaggaacacaaaacacatctcaatgccttcattatccgtttttgtttttcttttgctggtgattgggggcacggcaaggcctttgtatccacttcctggcaaaggtggcgatggaagtaggcaacctcttcaaacttttcgcccatacaacgttgcacaccgaggttcaaacggagaacttcctgaagaaactcgtgaggcatacttgagagctattgaggaaggtgcagacttcattgaaacagatatattatcttccaaagatggtgttcttatttgtttccatgatgttatccttgatgatactactgacatagcaaaatacaaagagtttgctaatcgtaaaagaacatatgatgtccaaggggtcaataccactggattttttgtcgttgatttcacgttgaaggaattaaagtcattgagggtgaatcagaggtatagctttagggatcaacagtttaacggaaaatttcaaataatcacttttgaagagtttattaccatagcattggaagcacccagagttgttggaatatatcctgagataaaaaatcccgtacttatcaatcagcatgtgaaatggtcggacggcaaaagatttgaggacaggtttgttgaaacacttcagaaatatggatacaagggttcatacctgtcaaaacattggttgaaacagcctgcatttattcagtcatttgctccaacttcacttgtgtatatatcaaaacaaacggacttgcccaagatttttttaatcgatgatgttgatattcctacacaggacactaatcagtcatattgggaaattacatctgatacgtacctagattacataaagcaatatgttgtaggaattggaccttggaaggatactatagtacctgtggttaaaaactatgtgacaactccttcggatcttgttgccagggcacatgctcataatctgcaggtgcatccgtacacttacagaaatgagaaccagtttctgcatttcaactttagtcaagatccgtacaaggagtatgattactggatcaacaaaatgggaattgatggtctgtttacagatttcactggtagtcttcataattttcaggaatggaccacccctaaccgtcaagaggacaagactgcatccaagctattacataaaattgctttgttagcatccgcttatgaatgattttgaggtgtcagatggtttgtaaaatgcatgtgcttggattgatttattttgttcagaagcttattatcaacatgttcaagagagtgttagactgaaaatttgttgttgagcatgaaaaaaaataaaagtgcatcttgcaaagtttatgt

SEQ ID NO: 8961 - DNA, 1434 bp, Vigna unguiculata
ggctctctccttgtctcgtaaaccctgaacccaaagggttcgttgcagcatcttcctccctaaacctactgagttcgccacacggaaccggcaactaggtcgtgactcagttgtttcacattgagctatgcaagtcgtctccagcgcccgccgagtctctcggttcttcctttcgcctcatcttcgaacctctgaagctcctcactcctccgcgctttctcctttctcagggctcgtgcaacacgattaccggcgagtgacaactgatccgatacactgcttcttgtcgaaggcatttttctcttcaggagtggataccgttgaaggagctccatcaggggatgtgaaggaattatacgataaaatgcttgactctgtaaaagttaaacgatcaatgcctccaaatgcttggttgtggtcaatgattgcaaattgcaaacaccagcacgatattagacttctgttcgacattctgcagaacctccgcatatttaggttgtcgaatcttcgaattcatgacaattttaattgcaacctctgtcgtgaagttaccaaggcgtgtgttcttgcaggagctcttgattttggaaagaaggctctgtggaagcataatgtctatggattgaccccgaatattgcatctgctcactctttactgctgtatgccaaggaccacaatgatactaaactgttggtggaagtaatgaaacttgtgaagaagaacgatttaccattgcaaccagggacagcagatatagttttcagcatttgttacaatacagatgactgggtgttgattagtaagtatgcacaaaggtttgtcaaggctggtgtaaaactaagacaaacctcatttgagacatggatgcaatttgctgccaaaagaggggacaccaagtcattgtggacaatagaaaagttgagatctgaaacaatgaagcagcacactttggcgactgggttttcttgtgccaagggtcttctgttggaacgtaaacccagtgatgcagttgctgtcattcaagttctaaatcagaccttgtctgataaaaaaaagtcaggcatcaaggatgaacttcagaagcttgtatccgagtggcctttagaagttattaagcaccaaaaagacgaggacagaaaggcattagcagcttctttgaagtctgatatccctatcatggttagtgagttgctgagcatgggtcttgaggcaaatgtaagtttggaagacctagacaggaaggaaggtattccacaataacatttagttcagaatttgatgacattgtatttcagaatgtgcttatttccggagtatcttcttccgaggatgcttcctatcccgggatatagataaggagtctgcaatcatagcaaatgttgattactaaattaaaattattactttgcttccattgataccattttttattt

SEQ ID NO: 8962 - DNA, 1627 bp, Cajanus cajan
ccaccaaatcgctctctctttcaccgttgtctcgtaaaccctgaacccaaagggttccattcgtagcatcttcctcccttaacctaccgagttcgcccacccggaactgccaactgagtcgtgactcgcttccttcacattgaaccatgcaagtcgtctccaacgctcgccgagtttctcggctcttcctttcgcctcatctccgaaactccgaagctctctcccttttctcagggtttacgcaacgtgattgccggcgagtgtcaactgatccaatacactgcttcttgtcgaaggctttttactctactggagtggataccgttcaaggagctcctacagaggatgtgaaggaattatatgataaaatgattgactctgtaaaggttaaacggtcgatgcctccgaatgcttggctgtggtcaatgattgcaaattgcaaacaccatcacgatattagccttctattcgacattttgcagaacctccgcagatttaggttgtccaatcttcgaattcatgacaattttaattgcaatctctgtcgagaagttgccaaggcttgtgttcatgcaggagctcttgattttggaaagaaggctttgtggaagcataatgtctttggtctgaccccaaatattgcatctgctcaccatttactgctgtatgctaaggaccacaatgatactaaactattggtggatgtaatgaaacttattagaaggaatgatttaccattgcaaccaggcacagcagatatagttttcagcatatgttataatacagatgactgggagttgatcaataagtatgcaaaaaggtttgttaaggctggtgtaaaattgcgacaaacctcatttgaaacatggatgaatttcgctgccaaaagaggagacaccgagtcattgtggaaaatagaaaaattgagatctgattcaatgaagccacacactttggcaactggattttcttgtgccaagggtcatctgttggaacgtaatcccagtggtgcagttgctgtcattcaagttctaaatcagaccctgtctgatgcaaaaaagtcaggcatcaagggtgaacttcagaagcttgtatctgagtggcctttggaagttattaagcaccaaaaagaagaggacagaaaggcattagcagcctctttgaaatctgatatccttgctatggttagtgagttactgagcttggggcttgaggcaaatgtaagtttggaagacctagacaagaaggaaggtgttccacaatagcatggagctcagaatttgatgacattatgttttagaatgtgcttgtttgcggagtaactccttagcaggatgctttctagccctggtttgataccgagcctgcgatcatagcaaatgttgattactaaattaaaattattattttgcttccattcttaccatttgttattttatgtccaacaagtgcttgaggctttggtagcatatcagttagatttagttagtgttttgagatctgaaatttgcaatttttgtgaaccggtcgagcaatgtccggtgtaacattaaattgttcgacttgtagtcttgaacgactaaatttttttttcttcttggattctaggtaatatgggttaatttga

SEQ ID NO: 8963 - DNA, 2027 bp, Glycine max
aaaaaatatttctgaaataacaaattaaaggggaaaaaaaagaaagaaagtttaatttgtatacgagttcatgttaacaaaggtgtagactgttccaccgaagcactctctgtctttctctgttgttgtctcgaaaaccctgaacccaaagggttcgtttgtagcttcttcctccctaaacataccgagttcgccacctggaacccacaactgagtcgtgactcggttctttcacactgaaccatgcaagttttctctaacgctcgccgagcctcttggcttctcctctttcctcatctccgaacctcggaagctcctcactccaccgcgctctctctcttctcagggctcgcgcaacgtgattcccggcaagtgaacaccgatccggtacactgtttgtcgaaggcttttttctcttccggaatggataccgttgaagcaactccatcagaggatgtgaaggaattatacgataaaatgcttgactctgtaaaagttaaacgatcaatgcctccaaatgcttggttatggtcaatgattgcaaattgcaaacagcagcacgatattagacttctgttcgacattttgcagaacctccgcagatttaggttgtcgaatcttcgaattcatgacaattttaattgcaatctttgccgagaagttgctaaggcatgtgttcatgcaggagctcttgattttggaatgaaggctttgtggaagcataatgtctatggactgactccaaatattgcatctgttcaccatttactgacgtatgctaagaaccacaatgatactaaactgttggtggaagtaatgaagcttctgaagaagaatgatttaccactgcaaccaggcacagcagatataatttttagcatttgttataatacagatgattgggagttgattaataagtatgcaaaaaggtttgtcatggctggcgtaaaactacgacaaacctcatttgaaacatggatggaatttgctgccaaaagaggacacactgagtcattatggaaaatagaaaagttgagatctgaatcaatgaagcagcacactttgataactgggttttcttgtgtcaagggtctactgttggaacgtaaacccagtgatgcagttgctgtcattcaagttctaaatcagaccttgtctgatacaaagaaatcaggcatcaagggtgaacttcagaagcttgtatccgagtggcctttggaagttattaagcaccaaaaagaagaggacagaaaggcattatcagcctctttgaaatctgatatccttgtcatggttagtgagttactgagcgtgggtcttgatgcaaatgtaagtttggaagacctggacagaaaggaatgtattccacgatagcatggagttcagaatttgatgacattgtgtttcagaatgtgcttgtttgcagagtatctccttaccaggatgcttcctagccctggttagatactgagtctgcgaacattgcaaacgttgattactaaattaaaaattattattttgcttcaattcttactatttcttattttctgtacaacaagtacttacggttttggtagcatagtagtgggatttagtacgtgttttgagaactgaaatttggatatcagtagattatgttgggacaaaaataatctagcacatgtcctctactctgaactgcaagaaattgctttgtttctcttcaagtgaaagatacaatcgtggctttttaacctctagttcaagtgggccctaccgcgaaggaatgctaaggcctaatagttgcaatttgtgtcaactggtcgagcagaaggtccggtgtaagtgtaacattcaattgttctacttgaagtcttgaaccaatgtttgttttttattcacgaattgtaggtaatatgggttaacttgtttatttaaatgctaaatgactgtgtgcatagtgacctactacatatgcactcttctgtcaaacccaagtttttttttgccaaagaacttggattgaaaagatcaaagggcaacccaac

SEQ ID NO: 8964 - DNA, 1874 bp, Glycine max
ccaccgaagcactctctgtctttctctgttgttgtctcgaaaaccctgaacccaaagggttcgtttgtagcttcttcctccctaaacataccgagttcgccacctggaacccacaactgagtcgtgactcggttctttcacactgaaccatgcaagttttctctaacgctcgccgagcctcttggcttctcctctttcctcatctccgaacctcggaagctcctcactccaccgcgctctctctcttctcagggctcgcgcaacgtgattcccggcaagtgaacaccgatccggtacactgtttgtcgaaggcttttttctcttccggaatggataccgttgaagcaactccatcagaggatgtgaaggaattatacgataaaatgcttgactctgtaaaagttaaacgatcaatgcctccaaatgcttggttatggtcaatgattgcaaattgcaaacagcagcacgatattagacttctgttcgacattttgcagaacctccgcagatttaggttgtcgaatcttcgaattcatgacaattttaattgcaatctttgccgagaagttgctaaggcatgtgttcatgcaggagctcttgattttggaatgaaggctttgtggaagcataatgtctatggactgactccaaatattgcatctgttcaccatttactgacgtatgctaagaaccacaatgatactaaactgttggtggaagtaatgaagcttctgaagaagaatgatttaccactgcaaccaggcacagcagatataatttttagcatttgttataatacagatgattgggagttgattaataagtatgcaaaaaggtttgtcatggctggcgtaaaactacgacaaacctcatttgaaacatggatggaatttgctgccaaaagaggacacactgagtcattatggaaaatagaaaagttgagatctgaatcaatgaagcagcacactttgataactgggttttcttgtgtcaagggtctactgttggaacgtaaacccagtgatgcagttgctgtcattcaagttctaaatcagaccttgtctgatacaaagaaatcaggcatcaagggtgaacttcagaagcttgtatccgagtggcctttggaagttattaagcaccaaaaagaagaggacagaaaggcattatcagcctctttgaaatctgatatccttgtcatggttagtgagttactgagcgtgggtcttgatgcaaatgtaagtttggaagacctggacagaaaggaatgtattccacgatagcatggagttcagaatttgatgacattgtgtttcagaatgtgcttgtttgcagagtatctccttaccaggatgcttcctagccctggttagatactgagtctgcgaacattgcaaacgttgattactaaattaaaaattattattttgcttcaattcttactatttcttattttctgtacaacaagtacttacggttttggtagcatagtagtgggatttagtacgtgttttgagaactgaaatttggatatcagtagattatgttgggacaaaaataatctagcacatgtcctctactctgaactgcaagaaattgctttgtttctcttcaagtgaaagatacaatcgtggctttttaacctctagttcaagtgggccctaccgcgaaggaatgctaaggcctaatagttgcaatttgtgtcaactggtcgagcagaaggtccggtgtaagtgtaacattcaattgttctacttgaagtcttgaaccaatgtttgttttttattcacgaattgtaggtaatatgggttaacttgtttatttaaatgctaaatgactgtgtgcatagtgacctactacatatgcactcttctgtc

SEQ ID NO: 8965 - DNA, 1966 bp, Cajanus cajan
gcttcttgttagaatattcaaattttaattatcatgattttaggataattttcacattttgtaaaatcaatttctcaaacattcacccaagcaacaagtgtgatcctgtgtttagtggaacgaagttgttgatatgtagtgagacggcattatcatgatttgctatccattcatgtcacgtgtaaactctcaatccattatttatgagactaatgacatacacgttactttttggcatagtcaaaaatacacctacttcacattacctatcagaaatccaaataatcaatactcttgagtcttgatgacccttaatgattcctccaccagcttttttcttgagtaacttttcaacaaccaaatttctacactaggccaaaccagtgaaaccaatgttattctgctttatcaagctaattttctacacagggaagtccacttttgatgacccttaacccaactccagaagaaatggtaaaaaaaactagtcactatcttttgattcttttccttcaccatgtgtttgatatggtgcctaggcaaaggaaaatggggcatcataaattgaaccactgtcctccttggatgatcagaattaaggcactcttcaatcctcatattatcatatcctttctagggacgagaaactgttacttcttcctagacataataaaggagccctcaaaaccacatttttctttgcatttataagtccttaaatgcagaaccagaggtcagagcagacctatttaatgaccatgtatgtatagattgaagtgcctcttttgtccacctaaacactttctctgtcctagcagcctcaagttttgaccacttggcacgctgtgctgcattgcagctaagcaccaccaccatcagtaatttacaaaggggaaaaacttgtgtctatataagtggttgagagtttagtgttcatccatagttctcatttctcgctagttttccctgtaggtggatatttgaggaatcctttgacatatttcctgtctttcttgtttctgagtgttgattttgtaggagaaatgagtagttatttgggtgtaggtattagccctgggactgtcccagttaatcacagcacaaatgtgaaagtgtttgataggaggataaggataactgagttggtgttaaggtgtgtgatacttggtttaggggttcttgcagctgttcttgtggggactgattcccaagtcaaagagtttttctcaattcagaagaaagctaaatttacagacatgaaggctttagtgttcttggtagctgcaaatgggttagctgctggctactccttaattcaagggttgcgctgtatcattagtatggtcagaggaagagtactctttagcaagaccctagcttgggccattttttctggtgatcaggtaatggcatatgtaacagtggcagcagcggtggctgcagcgcaatcgggtatttttgcaaaggtgggccagacagaactgcaatggatgaagatatgcaacatgtatgggaaattctgcaaccaagtgggagaagggatagctagtgcttttgtggttagcctaagtatggtggtcctgtcttgtatttctgctttcagtctcttccgtttgtatggtggtaacaaaatcaaaaatgtatattgataggttagaaactaccatagattaagttactagcctaccactcactcccactgtaactgttacttggccagcataatagttctgcaacttacaaggtttcttcctgtatatgtagtagtgaaatggttctggtaatatgatatgaaatatcagataatagttattggcaataaagttgaagttctaataggaagtagttattggcaataaagttgaagttctaataggaagtatatgtactatggttagcccaaaacaaagttgtgacagacgacttgagttggtggtttatgtatcaatatatttataaacttaaa

SEQ ID NO: 8966 - DNA, 1753 bp, Glycine max
gatgacccttaatgattcctccaccagcttttctctttgagtaacttttcaacaaccaaatttctacactaggccaaacaagtgaagctaactcttattctgctttatcaagcaaattttctaccgcagggaaggtcactttttttgttctctttagaaccccatccattccctaaacaccagaaaaaagatatggtaaaaactaggcaccatatcatcttctttcaccgtgtgtttggtatggtcttgaccaaaaagaaaaatggggcatcataaactgaaccacaacaatgtccttatatgatcagaattaaggcactcctcaattcgttttatcatatctcagatcctttctagggacgggaaactgttacattttcctagacacaataaaggagcgctcaaaaccacattttttttcctctttgcatttaccaatccttaaatgctgaaccagaggtcagagcagacccatttaatggccttgtattcctagattgaagtgccttttttttgtctacctattatacactttctctagtctgtcctagaaagtagaaaccttaagctttcaccacttggcacgctgtgcagcattgcattgcacctaagcaccaccatcactactttataaggaaaaaaaaaaaaataacacaacaacttgtgttgtgtctatataagtagtggggggttaaggttagtgttctcatccatagttctcactggttttctctataggtggatttgaggacttcttctatattaaactgtgttttcttgtttctgagtgctgattttggaggagaaatgagtagctatttgggtgtaggtgttagtcctgggaatgtcccagtttaccacagcacaaatgtgaacgtgttagataggaggatcaagataacagagttggtgttgaggtgtgtgatccttggtttaggggttcttgcagctgttcttgtggggactgattcccaagtcaaggagtttttctcatttcagaaggaagctaaatttacagacatgaagtctttggtgttcctggtggttgcaaatgggttagcttctggctactccttaatccaagggttgcgctgtatcattagtatgatcagaggaagagtactcttcagcaagcccctagcttgggccattttttctggtgatcaggtaatggcctatgtaacagtggcgacagtggtggcggcaggacaatcgggtgtgattgcaagggttggtcagccagaactgcaatggatgaagatatgcaacatgtatgggaaattctgcaaccaagtgggagaagggatagctagtgcttttgtggctagccttagcatggtggtcctgtcttgtatttctgctttcagtctcttccgtttatatggtggtaacaaaaccaaaaatgtgttggtaggttagaaactagcactgattcaaggctcttcgtgtatatgtagtagtgaatgattatggtaatatgagaatggcaactattgcaattatcacttaataattgatggcagtaaagtttagttaggttctttgatatatttagccacttttgcatgccatatgttcaatcctagcatcccgtatggctaaaggctatgtttgtgaatctgttagcacgagttccaattaatacattaacaagtccaaaacagagaagcaacaacttgcgtttgagtggttgtacttgtagatgtaaaaacaaacacggcgaataatataaacacgattcatgttttttgca

SEQ ID NO: 8967 - DNA, 1675 bp, Glycine max
aacaaccaaatttctacactaggccaaacaagtgaagctaactcttattctgctttatcaagcaaattttctaccgcagggaaggtcactttttttgttctctttagaaccccatccattccctaaacaccagaaaaaagatatggtaaaaactaggcaccatatcatcttctttcaccgtgtgtttggtatggtcttgaccaaaaagaaaaatggggcatcataaactgaaccacaacaatgtccttatatgatcagaattaaggcactcctcaattcgttttatcatatctcagatcctttctagggacgggaaactgttacattttcctagacacaataaaggagcgctcaaaaccacattttttttcctctttgcatttaccaatccttaaatgctgaaccagaggtcagagcagacccatttaatggccttgtattcctagattgaagtgccttttttttgtctacctattatacactttctctagtctgtcctagaaagtagaaaccttaagctttcaccacttggcacgctgtgcagcattgcattgcacctaagcaccaccatcactactttataaggaaaaaaaaaaaaataacacaacaacttgtgttgtgtctatataagtagtggggggttaaggttagtgttctcatccatagttctcactggttttctctataggtggatttgaggacttcttctatattaaactgtgttttcttgtttctgagtgctgattttggaggagaaatgagtagctatttgggtgtaggtgttagtcctgggaatgtcccagtttaccacagcacaaatgtgaacgtgttagataggaggatcaagataacagagttggtgttgaggtgtgtgatccttggtttaggggttcttgcagctgttcttgtggggactgattcccaagtcaaggagtttttctcatttcagaaggaagctaaatttacagacatgaagtctttggtgttcctggtggttgcaaatgggttagcttctggctactccttaatccaagggttgcgctgtatcattagtatgatcagaggaagagtactcttcagcaagcccctagcttgggccattttttctggtgatcaggtaatggcctatgtaacagtggcgacagtggtggcggcaggacaatcgggtgtgattgcaagggttggtcagccagaactgcaatggatgaagatatgcaacatgtatgggaaattctgcaaccaagtgggagaagggatagctagtgcttttgtggctagccttagcatggtggtcctgtcttgtatttctgctttcagtctcttccgtttatatggtggtaacaaaaccaaaaatgtgttggtaggttagaaactagcactgattcaaggctcttcgtgtatatgtagtagtgaatgattatggtaatatgagaatggcaactattgcaattatcacttaataattgatggcagtaaagtttagttaggttctttgatatatttagccacttttgcatgccatatgttcaatcctagcatcccgtatggctaaaggctatgtttgtgaatctgttagcacgagttccaattaatacattaacaagtccaaaacagagaagcaacaacttgcgtttgagtggttgtacttgtagatgtaaaaacaaacacggcgaat

SEQ ID NO: 8968 - DNA, 1471 bp, Vigna unguiculata
gcgacaatcgcgatctttccttccttcttcccttcactaacccaccggccgccacaccacaccacaccacgcagtcaaccttctacaatcatacccgacccgttttcgttaccacaataactgtaaaatctttcacaacaaacacgtgtcttcattcttcaatcatcacttctaactgctcacacctacgccacgccaccactccattccacaatgcttcgttaccttttgctgttgttcttattgggcctgggagcccgggtggagtcacacgaggaatcgggcccctggagctgcaactccgagtccgagatccgagtcgaggccaatttcaaacccggcgttattacactggatggccacgccgacgattggaaggacattgatgggtcctacttccccctcctccccgccctcgaccctgacgctgagaatgaattcaaaggtggaaagatgagcgttaagagtgtgcatgatggtcgcgatatcttctttctgttgcaagtcgacggtgattatgcgtactccaaaggtgaaagcaagaaatgtccatctgttgctctcatgtttcagatcggagatggtgcttcttatcataatatgggtggctgtgaggaacattcaacctcatgcactaacaagacctgcaaaggtcatgaagttgacattatgcacttttccataggaagtgctattccaggccggctttatggtggcaatcccttggacaatagggatggaaatggtggcgacaggtttggtcacttggttgatctgtatgcctggaatccacattgtagatacttggatggaactggtcctccaggttctgctaatgattctagtgcgcagaatgactggaagggtgcctggtggcatagtagtttcacggttcactcaggtttcgtagaggatgagagtccatatacagataatggaaaaaagggcacatacttttttgaattttccaggcctttgaggactatggatcatcttcaacaggacgtgcaatttaacatcggtggatccagtaagatgtctgttggtttctggtatccagtagatggtcagccatggcatggttctggacactactctgttaattgtgattgggttcccgttgacatatctgttggcggttctttgagtggcaactcagtagatgcagcatcaagtagctcgtggaatgtggctagtgccttttccgttatactctcagtagcagcactttgtgtgtctgtgtttgtgagctatcgggtgttcaatcccaagagtgttgtttcctttacaccgttagagagcaacaacctttaaatattgaaccaacagcttaagtttgagattgtactattcattacgtttgtactagataggtttgtactgtgtagtgctttctctttgctctatttttttattgtaactgaagcattactttagttattttaagcagtgtcagaaaagtattaattca

SEQ ID NO: 8969 - DNA, 1856 bp, Glycine max
gagtcttcactctatatttatttattaaagtaagagaacatcaggcacttaattctttggagaagatgctctggatagatgacaagggcaggtggggtgtttaacgtgtatatttcatttcacggttgggtaaaggcagaatgaaagtgcaggcgaaaagggggaaaacaaattggctagtgctgtgcgtcacgtctaatatcttagtttgtctgatctaatctaaattttctcgcaaacagaagaaaagtcaagcgcggcacgaatcgcgatctttccttctttctttctttcgttccttcacaatcctaccagccgccaagccgcagagtcaacttgtacaaatgcccaccgaatccattaaaactaaaaaatcttctaccacgaacacttgtcttcattcttcaaccttcgtttcgtttctaccactccattccagaatgcttcgttacctgttggtgttcttcttattgggcttgggaacccgggtggagtcacacgaggaatcgggtcattggagctgcgagtccgagtcggagatccgagtcgagactgagttcaaacccggtgtaatcacactggatggtcacgctgatgattggaaggacattgatgggtcctactttcccctccttcccgcccttgacccagatgctgaaaatgaattcaaagggggaaagatgagcgttaaaagtgtccatgatggccgcgatatcttctttctgctgcaagtagatggtgactatgcctactctaaaggtgaaagcaataaatgtccatctgttgctctcatgtttcaaattggagatagtgcctcttatcatgatatgggtggctgtaaagaacattcgacctcatgcactgacaagacctgcaaaggtcatgaagttgacattatgcacttttcgataggaagtgctattccaggacgactttacggtggcaatcccctagacaatagagatgggaatggtggcgataggtttggtcacttggttgatctatatgcttggaatccacattgtagatacttggatggaattggtcctccaggttctgctaatgattcaagtgcgcagaatgactggaaaggtgcttggtggcatagcagcttcacagttcactcaggattcgtagaggatgagagtccatatgcagataatggaaaaaagggcacatacttttttgaattctcgaggtctttgaggactatggatcatcttcaacaggacgtgcaatttaacattggtggatccagtaagatgtctgttgcattctggtatccagtagatggtcaaccttggcatggttctgggcactactctgtttactgtgattgggttcccattgacatatctgttggtaaatctttgaatggcaagtcagtagatgcagcatcaaatagctcgtggaatgttgctagtgccttttctgttatactatcagtagcagcactttgtgtgtctgtttttgtgagctatagggtgttcagccccaagagtgtctcttttacaccgatagagaacaacaacctttaaatattgaaccaagagcttgagtttgggattgtactattcatttcgcttgtactagataggtttgtactgtttagtgctttctctttgctctatttttttattataactaaagcattactttagttattttaagcagtgtcagaaaagtattaattcattatcaacattatggagttccatcctctttggcttagttattgcaattgcagtaccgtttgctttcattcatttcaaaatggaacttgagttgcaatccggcgaaagagaggaagattttgagtattaatataaataaattgagacaaattgatagcatgg

SEQ ID NO: 8970 - DNA, 1990 bp, Glycine max
gagtcttcactctatatttatttattaaagtaagagaacatcaggcacttaattctttggagaagatgctctggatagatgacaagggcaggtggggtgtttaacgtgtatatttcatttcacggttgggtaaaggcagaatgaaagtgcaggcgaaaagggggaaaacaaattggctagtgctgtgcgtcacgtctaatatcttagtttgtctgatctaatctaaattttctcgcaaacagaagaaaagtcaagcgcggcacgaatcgcgatctttccttctttctttctttcgttccttcacaatcctaccagccgccaagccgcagagtcaacttgtacaaatgcccaccgaatccattaaaactaaaaaatcttctaccacgaacacttgtcttcattcttcaaccttcgtttcgtttctaccactccattccagaatgcttcgttacctgttggtgttcttcttattgggcttgggaacccgggtggagtcacacgaggaatcgggtcattggagctgcgagtccgagtcggagatccgagtcgagactgagttcaaacccggtgtaatcacactggatggtcacgctgatgattggaaggacattgatgggtcctactttcccctccttcccgcccttgacccagatgctgaaaatgaattcaaagggggaaagatgagcgttaaaagtgtccatgatggccgcgatatcttctttctgctgcaagtagatggtgactatgcctactctaaaggtgaaagcaataaatgtccatctgttgctctcatgtttcaaattggagatagtgcctcttatcatgatatgggtggctgtaaagaacattcgacctcatgcactgacaagacctgcaaaggtcatgaagttgacattatgcacttttcgataggaagtgctattccaggacgactttacggtggcaatcccctagacaatagagatgggaatggtggcgataggtttggtcacttggttgatctatatgcttggaatccacattgtagatacttggatggaattggtcctccaggttctgctaatgattcaagtgcgcagaatgactggaaaggtgcttggtggcatagcagcttcacagttcactcaggattcgtagaggatgagagtccatatgcagataatggaaaaaagggcacatacttttttgaattctcgaggtctttgaggactatggatcatcttcaacaggacgtgcaatttaacattggtggatccagtaagatgtctgttgcattctggtatccagtagatggtcaaccttggcatggttctgggcactactctgtttactgtgattgggttcccattgacatatctgttggtaaatctttgaatggcaagtcagtagatgcagcatcaaatagctcgtggaatgttgctagtgccttttctgttatactatcagtagcagcactttgtgtgtctgtttttgtgagctatagggtgttcagccccaagagtgtctcttttacaccgatagagaacaacaacctttaaatattgaaccaagagcttgagtttgggattgtactattcatttcgcttgtactagataggtttgtactgtttagtgctttctctttgctctatttttttattataactaaagcattactttagttattttaagcagtgtcagaaaagtattaattcattatcaacattatggagttccatcctctttggcttagttattgcaattgcagtaccgtttgctttcattcatttcaaaatggaacttgagttgcaatccggcgaaagagaggaagattttgagtattaatataaataaattgagacaaattgatagcatggctccttccttttggttcacaatcagatatcttgataggcataacataactgtgagattgactcttgctgaaagtgacggttaggtaaaattttctttaggtaacagcgtaagagtttaatttctaacatttcag

SEQ ID NO: 8971 - DNA, 1592 bp, Glycine max
ggtaatggttgggtaaaaataaagtgtccactgtccactgtccactgtccactgtccagggaaggcagaatgaaagtgctgcttaaaagggagaaaagcaaacaaaagtctagtgctgtgcgtcacatctaatgtcttagtttctgtgatctaatctaaattttcaagcttctacaaatacccacccaatccattttcatatataatcttctaccacgagcacgtgctgcctccattccagaatgcttcgttaccttttgatgttcttcttattgggcttgggaacccgtgtggagtcacacgaggaatcgggtcattggagctgcgagtccgagtcggagatccgagtcgaggctgagttcaaatacggtgtaatcacactggatggtcacaccgatgattggaaggacattgatgggtcctactttcccctccttcccgcccttgacccagatgctgaaaatgaattcaaagggggaaagatcaccgttaaaagtgtccatgacggccgcgatatcttctttctgctgcaagtagatggtgactatgcctactctaaaggagaaagcaataaatgtccatctgttgctctcatgtttcaaattggagatggtgcctcttatcataatatgggtggctgtgaagaacatccgacctcgtgcactgacaagagctgcaaaggtcatgaagttgacattatgcacttttcaataggaagtgccattccaggacgactttacggtggcaatcccctagacaatagatatggaaatggcggcgataggtttggtcacttggttgatctatatgcttggaatccacattgcagatacttggatggaattggtcctccaggttctgctaatgattcaagtgcgcagaatgactggaagggtgcttggtggcatagcagcttcacagttcactcaggattcgtagaggatgagagtccatatgcagataatggaaaaaagggcacttacttttttgaattctcgaggcctttgaggactatggatcatcttcaacaggacgtgcaatttaacatcggtggatccagtaagatgtctgttgcattctggtatccagtagatggtcaaccgtggcatggttccgggcactactctatttactgtgattgggttcccattgacatatctgttggtaattctttgagtggcaagtcagttgatgcagcatcaagtagctcgtggaatgttgctagtgccttttctgttatactatcagtagcagcactttgcgtgtctgtttttgtgagctatagggtgttcagccccaagagtgtctcttttacaccaatagagaacaacaacctttaaatattgaaccaacagcttgagtttgggattgtactattcattaggcttgtactagataggtttgtactgtttagtgctttctctttgctctatttttttattataactgaagcattactttagttattttaagcagtgtcagaaaagtattaattcattatcagcattatggagttccatcctctttggcttagttgttgaaattgcagtaccgtttgctttcagttttcagcattcattcatttcaaaaat

SEQ ID NO: 8972 - DNA, 1798 bp, Glycine max
ataggtaaattgaacaagtatatacttattgtatctatttgtttattgattaaagtaagagaaaatcaggcaaattgttttgagaagatgctcccaatagatgacaaaggcaggtggggtgtgtaaggcgtatatgtcatggtaatggttgggtaaaaataaagtgtccactgtccactgtccactgtccactgtccagggaaggcagaatgaaagtgctgcttaaaagggagaaaagcaaacaaaagtctagtgctgtgcgtcacatctaatgtcttagtttctgtgatctaatctaaattttcaagcttctacaaatacccacccaatccattttcatatataatcttctaccacgagcacgtgctgcctccattccagaatgcttcgttaccttttgatgttcttcttattgggcttgggaacccgtgtggagtcacacgaggaatcgggtcattggagctgcgagtccgagtcggagatccgagtcgaggctgagttcaaatacggtgtaatcacactggatggtcacaccgatgattggaaggacattgatgggtcctactttcccctccttcccgcccttgacccagatgctgaaaatgaattcaaagggggaaagatcaccgttaaaagtgtccatgacggccgcgatatcttctttctgctgcaagtagatggtgactatgcctactctaaaggagaaagcaataaatgtccatctgttgctctcatgtttcaaattggagatggtgcctcttatcataatatgggtggctgtgaagaacatccgacctcgtgcactgacaagagctgcaaaggtcatgaagttgacattatgcacttttcaataggaagtgccattccaggacgactttacggtggcaatcccctagacaatagatatggaaatggcggcgataggtttggtcacttggttgatctatatgcttggaatccacattgcagatacttggatggaattggtcctccaggttctgctaatgattcaagtgcgcagaatgactggaagggtgcttggtggcatagcagcttcacagttcactcaggattcgtagaggatgagagtccatatgcagataatggaaaaaagggcacttacttttttgaattctcgaggcctttgaggactatggatcatcttcaacaggacgtgcaatttaacatcggtggatccagtaagatgtctgttgcattctggtatccagtagatggtcaaccgtggcatggttccgggcactactctatttactgtgattgggttcccattgacatatctgttggtaattctttgagtggcaagtcagttgatgcagcatcaagtagctcgtggaatgttgctagtgccttttctgttatactatcagtagcagcactttgcgtgtctgtttttgtgagctatagggtgttcagccccaagagtgtctcttttacaccaatagagaacaacaacctttaaatattgaaccaacagcttgagtttgggattgtactattcattaggcttgtactagataggtttgtactgtttagtgctttctctttgctctatttttttattataactgaagcattactttagttattttaagcagtgtcagaaaagtattaattcattatcagcattatggagttccatcctctttggcttagttgttgaaattgcagtaccgtttgcttttcaattttcagcattcattcatttcaaaaatgaaacctgagagttgcaatccggcgaaagagagaggaagattttgagtataaatataaataaatt

SEQ ID NO: 8973 - DNA, 1905 bp, Cicer arietinum
gatattttgacggtgtattttagctatattaagcacatacggtgtgtgttttttctttttttacaacaaaaaccgaatgatatttgaatgaaggcattattagtgttgaaaaacatctattatgtatttatttatggcaaggtaaatcacagatgggatgggatgaggaagaggatgaggatgtgaggttaaacaccttaactagtaataagacactaaaaagttaaagtgaatgtaaaaggaaaaaaaaaaaagcaacaaatgcggtgaaaaaaaggggcaagtaaaaagtaaaaaagcatgtgtttgttttgttggttggttgaacttgaagaaaagaaaagtcaagcgcaacacaaatcgcgatctttcgttccttccaaagtacctggcggccacgccactcactattccctgtttggttgaaacaaactaacagtatcaaaaacaaatccaatccatttagatttttacctgtattcattttccaatagtcttaaacaaacacgtactactttcctttgtaatccacaatgctccctaacctcttcttagtgttggtattgttattcgcgcgtgtttactcgcacgaggagtcgggtccgtggacctgcgaatccgggtcagagatccgagttgagtccgagtttgaacccggtgttattacacttgatggtcacgcagacgattggaaggacattgatgggtcccacttttctcttctccttgctctcgaccctgatgctgaaaatgaattcaacggcggaaaaatgaccgttaagagtgtgcatgatggccgtgatattttctttttgctacaagttgacggtgattatgcgtactctaatggtgaaggcaacaaatgtccctctgttgcactcatgtttcaaattggtgatgatgcttcttatcataatatgggtggctgtgaggaacatacaacctcatgcacaaataagacctgtaaaggtcatgaagttgacattatgcacttttcaattggaaatgccattccaggacggctttatggcgggaatcctgttgacaatagggatggaaatgggggcgacaggtttggccatttggttgatctttatgcctggaatccacactgcagatacttggatggaaatggtccttcagattctgttaatgattctagtgcacagaatgactggaagggtgcttggtggcatagcagctttacagttcactcaggttttgtagaggatgaaagtccttatgcagaaaatggaaaaaagggcacatatttttttgaattctctaggcctttgaggactatggatcatcttcaacaggatgtgcagtttaccattggcggatcgagcaagatgtctgttgcattttggtatccaatagacggtcaaccatggcacggctccggacactactcggttaactgtgattgggttccaattgatatatctcagggaagttcattgagtgtgaagtcagtagacccaacatcaagtagctcatggaatgttgcaagtgcattttcactaatactttcagtagcagcactttgtgtgtctgtgtttgcgagctatcgagtttttcatcccaacagtgttccctttaccccaatggagaacctttaaatattgtaaaaacaccttgggtttgggattgtactattcattacgattgtactagataggtttgtactgtttagtactttctcttgctttattttttaaattctatttgaagcattactttagttattttaagcagtgtcagaaagtgttagttcaattatcaagcatgatggagttccgtcttgtgcttagttgttgcaacttgcaaatttcattcaccctgggattttttttttaaataaaaaacttgcgtaaataatatactaatgagaggaactttttc

SEQ ID NO: 8974 - DNA, 1706 bp, Medicago truncatula
gattatgatacatgaagtggcaaggtagatcacaaatggaatttgtcgggtctattataaaccttagttggcaacaagacacagaagagtaaagagaatgtaaaaggaaaatgcaacaagtactggtgaaaaaaggtgaaattaaaaaaaaaaacatcatgtgtcatgtcacatgtgtgttttgttgattgatgtactctaaattttccaagctcagaaaagtcaagcacaccacaaatcgcgatctatcaaattcaaatccacttagatgaacataaactcgtttttatttatttttcaataatcttaaaaacatctacaagaaacacagtttccaacaaataaacacatacaatgtttcgttacatcttagttttgttattgttattgttagtatcatcctacgatgtttattcacatgaggagtcgggtccatggagctgtgaaaccgggtcagagattcacgttgagtccgaatttcaacccggtgttattacacttgatggtcatgccgatgattggaaggacattgatgggtcccacttttctcttcttcttgctctcgaccctgatgctgaaaatgaatttaatggcggaaaaatgaccgtgaagagtgtgcatgatggccgtgatattttctttttgttgcaagttgatggtgattatgcctactctaatggtgaaagcaagaaatgtccctctgttgcactcatgtttcaaattggggatggtgcctcttatcataatatgggtggctgtgaggaacattcaacctcgtgcacaaataagacctgcaaaggtcatgaagttgacattatgcacttttcaattggaaatgctattccgggacggctttatggcgggaatcccattgacaatagggatgggaatggcggtgacaggtttggccatttggttgatctttatgcctggaatccacactgcagatacttggatggaactggtccttcaggttctgttaatgattctagtgcacagaatgactggaaaggtgcttggtggcatagcagctttacagttcactcaggttttgtaaaggatgagaacccttatgcagaaaatggaaaaaagggcacatatttttttgaattctctaggcctttgaggactatggatcatctgcaacaggatgtgcaattcaccattggcggaacaagcaagatgtctgtcggattctggtatccagtagacggtaagccatggcgcggttccggacactactctgtcaactgtgattgggttccaattgatatatctcagagcagttcattgagtggcaagtcagtggagacagcatcaagtagctcatggaattttgcaagtgcattttcgcttatactttcagtagcagcactttgtgtgtctgtgtttgtgagctatcgggttttacaccccaagagtgtagcctttactcctatggagaacctttaaatagtgtatcaaacagcttgagtttgggattgtactattcatttacgattgtactatataggtttgtagtttgtactgtttagtgctttctcttgccctattttttaattctatttgaagtattactttagttattttagttagtgtcagaaaagtgttggttcaatagtccaagtataatggagttccatcttgtgcttagttgttgcaacgtgcaatttcctttcacagggggctatttttcttttctaaaa

SEQ ID NO: 8975 - DNA, 1557 bp, Medicago truncatula
acagaagagtaaagagaatgtaaaaggaaaatgcaacaagtactggtgaaaaaaggtgaaattaaaaaaaaaaacatcatgtgtcatgtcacatgtgtgttttgttgattgatgtactctaaattttccaagctcagaaaagtcaagcacaccacaaatcgcgatctatcaaattcaaatccacttagatgaacataaactcgtttttatttatttttcaataatcttaaaaacatctacaagaaacacagtttccaacaaataaacacatacaatgtttcgttacatcttagttttgttattgttattgttagtatcatcctacgatgtttattcacatgaggagtcgggtccatggagctgtgaaaccgggtcagagattcacgttgagtccgaatttcaacccggtgttattacacttgatggtcatgccgatgattggaaggacattgatgggtcccacttttctcttcttcttgctctcgaccctgatgctgaaaatgaatttaatggcggaaaaatgaccgtgaagagtgtgcatgatggccgtgatattttctttttgttgcaagttgatggtgattatgcctactctaatggtgaaagcaagaaatgtccctctgttgcactcatgtttcaaattggggatggtgcctcttatcataatatgggtggctgtgaggaacattcaacctcgtgcacaaataagacctgcaaaggtcatgaagttgacattatgcacttttcaattggaaatgctattccgggacggctttatggcgggaatcccattgacaatagggatgggaatggcggtgacaggtttggccatttggttgatctttatgcctggaatccacactgcagatacttggatggaactggtccttcaggttctgttaatgattctagtgcacagaatgactggaaaggtgcttggtggcatagcagctttacagttcactcaggttttgtaaaggatgagaacccttatgcagaaaatggaaaaaagggcacatatttttttgaattctctaggcctttgaggactatggatcatctgcaacaggatgtgcaattcaccattggcggaacaagcaagatgtctgtcggattctggtatccagtagacggtaagccatggcgcggttccggacactactctgtcaactgtgattgggttccaattgatatatctcagagcagttcattgagtggcaagtcagtggagacagcatcaagtagctcatggaattttgcaagtgcattttcgcttatactttcagtagcagcactttgtgtgtctgtgtttgtgagctatcgggttttacaccccaagagtgtagcctttactcctatggagaacctttaaatagtgtatcaaacagcttgagtttgggattgtactattcatttacgattgtactatataggtttgtagtttgtactgtttagtgctttctcttgccctattttttaattctatttgaagtattactttagttattttagttagtgtcagaaaagtgttggttcaatagtccaagtataatggag

SEQ ID NO: 8976 - DNA, 1707 bp, Lupinus angustifolius
atcgaggagatgacacagtacacaaccaaagaagtacatcaagttaaccatgaaacatctgacttaattaagtataagttattatgaggataaagcaaacaagataagtcaagcacacctgaaactggatccttccactttctccaactaccttatactacttactaccaaccaagctaggttgcggtttcgggtcaaataaaacctcaaaccaaaacattcagaacaatcacccaatcattttttagcttcacttatttagttatttttatctccaaaacaatatattgaaacccataatcataataataataataataatgtttcgtgacttatttgtattatcgttgttattgttggcttccattttgggagggttggattctcacgaagaatcaggtgagtggaggtgcgagtccgagtcagagatccgagttgaatcgggtttcaaacccggagtcattacacttgatggccacgctgatgattggaaggaaattgatgggtcccacttctctcttctccctgcacttgacccagattctgaaaatgaattcaaaggtggaaaattgattcttaagagtgtgcatgatggccacgatgttttctttcttctacaagtggatggtgattatgcatactctaaaggtgaaagcaacaaatgcccgtctattgctctcatgtttcaaattggggacagtgccacttatcataatatgggtggttgtgaggaacatccagcctcatgcacaagcaagacctgcaaaggccatgaagttgacattatgcacttttccattgggaatgctattccaggacgactttatggtgggagtcccctagacaatagggatgaaaatggaggggacaggtttggccacttggatgatatttatgcttggaatccacactgtagatactttgatggaactggtccttcaggttcagctaatgattctagtgcccagaacgactggaagggtgcttggtggcatagcagctttacagttcactcaggttttgtagaggatgaaagtccatatgcagaaaatggaaaaaaagggacatattattttgaattctccaggcctttgaggaccatggatcatcttcaacaggatgtacaattaacaattggtggatccagcaagatgtctgttgcattctggtatccacttgatggtcaaccatggcatggttcaggacactactctataaactgtgattgggtccccattgatatttctttgggtagttctttcagtgacaaatcagtgaacacagaatcaagtagctcatggaatattgccagtgccttttctcttatactatcagtaacagcactttgtgtttctgtgtttgtgagctatagggttttcaatcctaaaagtgtggcctatacaccaacggaggaactttaaatataatacaaactacttgattttgagggttgtactattcaatacgtttgtactagatagtttgcagtactgtttagtgctttctctttactctgatttttttatatattgtaattgaagcattacttcggttgttttaggtggtgtcagaaaatgtgttaattcattatctgcattatggagtgcaaccctcttgtgcttagttgttgcattagcaggacatgttgctttttatcagtcccaaatgaaaaaaatactttcttttatcgtttttatttctaatatg

SEQ ID NO: 8977 - DNA, 2276 bp, Lupinus angustifolius
gaaagagatgagtggatctataccacgaatcctcacctagctacctaaggaagactagatccaacttgtacttctatgttgtacttctagcgtgtactacttacaacagaagaatctaggtaatccaccaacgaagtcctaggttgctggtcaaacaaaacctcaaatagatacactcatacactattaattggattcattaccaagattttacctaatccattttttcgattcacttatttgtccctgacaaacaaaaacctcgtaagtcgtaacacataaaattatgatactaatgtttcactacccatttgtattatcgttattattggcttcgtttatattgggaggagttgagtctcaccaggaatcaggtgagtggagatgcgagtccgagtcagagatccgtgtttactccgatttcaaaccaggagttattacacttgatggccacgctgatgattggaaggacattgatgggtcccaattttctcttctacctgctcttgacccacatgctgaaaatgaattcaaaggtggaaaaatgatcatcaagagtgtgcatgatggccatgatgttttctttcttctgcaagtggatggtgattatgcttactctaaaggtgaaggcaacaaatgtccatctgttgctctcatgtttcaaattggggatagtgccacctatcataacatgggtggctgtgaggaacattcaacctcatgcacagacaagacctgcaaaggccatgaagttgacattatgcacttttctattgggaatgctattccaggacggctttatggtgggaatctcctagataatagggatggaaatggcggcgacaggtttggccacttggttgatgtttatgcttggaatccacactgtagataccttgatggaattggtccttcaggttcagctaatgattctagtgcccagaatgactggaagggtgcttggtggcatagcagctttacagttcagtcaggttttgtagcggatgagagtccatatgcagaaaatggaaaacagggcacatatttttttgaattctccaggcctttgaggaccatggatcatcttcagcaggatgtacaattcacaattggtggatcaaccaagatggctattgcattctggtatccagttgatggtcaaccatggcatggttctgggcactactctgttaactgtgattgggtccccatcgatgtatcttcggatgcttatttgagtgacaagtcagtgaacacaggatcaagcagctcatggaatattgctagtgctttttctcttatattatcagtagcagcactttgtgtttctgtgtttgtgagctatagggttttcaatcccaagaatgtgggctatacaccaacggggaacctttaagtctagttctaacttcttgaaatgagtttaaggaatgtactattcaatacatttattctgaatagtttgtaggactgtttagtgcctactccttactctatttttttattttgtaattgaagcattatgcagtggtgtcagaaaaggtgcaaattcattgcctgcattatggagtaccatcctttggtgcttagttgttgcaattgcaggcctgctagcttttcatcggtttgaaatggaacaatcacttttaagtttaagttgtgacttgtaatatgtcattagtgttgtaacaacatattgaagttggattactggtcagggtatctgattcttgaatgccacatgaatacacacaaaagggtagccaatttgagataacattgagataagatttgatataattgagttgggctactcttatctatgcatactgcacttgcataatatcagaagttatgcagtaactacttaatgtaattaataattagtatgaagagtttcaaatagtttaccatccctcaaaaatagtttacaccttcaagccttgtacttcaaagagcattcctctggcaaatgtgcaatgcagataccagacatatatggcctatcggttttatcacaacacattgtgtctaggcaaggttgtgaaatctatctttttggactctgattttttgtctgagcataaaatatgttgaagatcatatatttgcctttttattgtaaagaatcttgttgaatgcatatatgtctttgcagcattactagctcatttaagatagtaacagtggaaagatatgcctgtgaagcaaaggaggagagaaatatatgtaattgtcagaaatttaagatctgtagtatatagactttttatcac

SEQ ID NO: 8978 - DNA, 2008 bp, Glycine max
ttattatgaatattaatttctaatcattggaaaaaaaaaatacaacaagaaacaaacatgccctcccttcatcctcttctcatcttctttcctttgcaacaactagttagggttttgagtttgtgttgttgcttttatccctgaaaatcaaatcagactcagaaagagaaagagaaagaaaatggcgctgaagtttctgaacaagaagggatggcacacggggagtttgaggaacatagagaacgtgtggaaggcggagcagaagcacgaagcggagcagaagaagttggaagagcttcgcaagcagatccaggaggagcgagagcgcaccgaatttcgtcttcttcaggagaaagctggcctcgttccgcaccaggagaggttggagtttctgtacgattcggggttgtcggttgggaaatctgcgaattctgaaggattcaaggccctcgaacagttaccgaaatccgatgcaacggatgcagcaggcgcaggctcctctgcttctgcttctaaggagggggcgagtgtgctcggggcgctgttcgaggagaagcctcagtctgccaatgatgcttggaggaagctccattctgaccccttgctcatgatccgccagcgcgagcaggaagcgcttgccaagataaaaaacaaccctgtccagatggctattatcaagaaatcgattgaaggaactgaaaataaggagaaagtttataaaaaggaaaagcggaagaagcactggtctagtaaatcaaagcataaaaaacagtctgattcagaagatgacactactgagaggagaaaacgaaagactggtaatgaagtttctgacaagaagcatcataaggctcaatcagattcagagtatcagtcaagtgaaggagaaatgagaagaaggaaggatcgctatgaggacaaaaaatacagggaaagatcacccagtcaccaacagagacaaagaaatggcaaagactacaaagaagatgctggtgacagaaattataacaggtccaggtcagaaaggagtgtccaaaagggtcaattggattcagggtatgaatcaagtgaaggagaaaagagaaggaagaattactatgaaggcaaaaaatgcagggaaagatcacccaatcaccaacagagacaaagaaatggcagagactacaaagaagacactggtgacagaaattataacacttctaagtcagaaagatatgcttcagaaggttggtccaatatagatgcccctaaaagcgggggtggacgaatttctgaagcaagctccaatagatattctgcttcttcacctgaacatggatcacactataagtgcaggaacgtggctcctaagctttcagaagaagagcgggctgttaaacttaagcagatgcaattagctgctgagttgcatgaagagcagagatggaaacgtataaagaaggctgaggagtcggatacaaaggaagcaattcagaatgataatgtttgtggcaagaattttttggatactgttcagaaaagtgtatatggtgcagctgaaggagggagcacatcaatagctgagagtgtccgtcgtcggacatattattctcaaggcaggtctggcggtgaaggcaatgcatttcggcgatgaacactcggtggttttatcgctaattgtagctctcttagttgtcgccagacccctcttgcacgtgctttcttccttggaccaaaaaatgattccttccatgtataatatgcgaaaagttgtttaatttcaagtagataatatattaagaattcatagttcatccttcatgattcgaaatttctatgttcctttgtgattttaaggtattcatgtcctgatgtaaaatatttaaaggcgtttggaatacagcatcaatatagtattttgaaattgacccaactgggcaatttggtccatataattaaaaaatggtatatttagtcgttgacttagttgttaattaatttagtttttaaaactgattctgagtttgat

SEQ ID NO: 8979 - DNA, 1927 bp, Glycine max
aaaaaaaatacaacaagaaacaaacatgccctcccttcatcctcttctcatcttctttcctttgcaacaactagttagggttttgagtttgtgttgttgcttttatccctgaaaatcaaatcagactcagaaagagaaagagaaagaaaatggcgctgaagtttctgaacaagaagggatggcacacggggagtttgaggaacatagagaacgtgtggaaggcggagcagaagcacgaagcggagcagaagaagttggaagagcttcgcaagcagatccaggaggagcgagagcgcaccgaatttcgtcttcttcaggagaaagctggcctcgttccgcaccaggagaggttggagtttctgtacgattcggggttgtcggttgggaaatctgcgaattctgaaggattcaaggccctcgaacagttaccgaaatccgatgcaacggatgcagcaggcgcaggctcctctgcttctgcttctaaggagggggcgagtgtgctcggggcgctgttcgaggagaagcctcagtctgccaatgatgcttggaggaagctccattctgaccccttgctcatgatccgccagcgcgagcaggaagcgcttgccaagataaaaaacaaccctgtccagatggctattatcaagaaatcgattgaaggaactgaaaataaggagaaagtttataaaaaggaaaagcggaagaagcactggtctagtaaatcaaagcataaaaaacagtctgattcagaagatgacactactgagaggagaaaacgaaagactggtaatgaagtttctgacaagaagcatcataaggctcaatcagattcagagtatcagtcaagtgaaggagaaatgagaagaaggaaggatcgctatgaggacaaaaaatacagggaaagatcacccagtcaccaacagagacaaagaaatggcaaagactacaaagaagatgctggtgacagaaattataacaggtccaggtcagaaaggagtgtccaaaagggtcaattggattcagggtatgaatcaagtgaaggagaaaagagaaggaagaattactatgaaggcaaaaaatgcagggaaagatcacccaatcaccaacagagacaaagaaatggcagagactacaaagaagacactggtgacagaaattataacacttctaagtcagaaagatatgcttcagaaggttggtccaatatagatgcccctaaaagcgggggtggacgaatttctgaagcaagctccaatagatattctgcttcttcacctgaacatggatcacactataagtgcaggaacgtggctcctaagctttcagaagaagagcgggctgttaaacttaagcagatgcaattagctgctgagttgcatgaagagcagagatggaaacgtataaagaaggctgaggagtcggatacaaaggaagcaattcagaatgataatgtttgtggcaagaattttttggatactgttcagaaaagtgtatatggtgcagctgaaggagggagcacatcaatagctgagagtgtccgtcgtcggacatattattctcaaggcaggtctggcggtgaaggcaatgcatttcggcgatgaacactcggtggttttatcgctaattgtagctctcttagttgtcgccagacccctcttgcacgtgctttcttccttggaccaaaaaatgattccttccatgtataatatgcgaaaagttgtttaatttcaagtagataatatattaagaattcatagttcatccttcatgattcgaaatttctatgttcctttgtgattttaaggtattcatgtcctgatgtaaaatatttaaaggcgtttggaatacagcatcaatatagtattttgaaattgacccaactgggcaatttggtccatataattaaaaaatggtatatttagtcgtt

SEQ ID NO: 8980 - DNA, 835 bp, Vigna unguiculata
aaccagtgagtattcaagagaacgatggcaacgtcaactatggatgttcttcatttccagcacacccctttttactgtgaggagaatgtatacttgctttgcaagaagctgtgcagtgatggagtagcagaagctgagggatctgatctttttgttgtcttcatttccaatgaaaagaaacagatcccactatggaatcaaaaggctagcaaaagagctgatggggtgattctatgggattatcatgtaatttgcattcagataaaacaaggaaatgtccctccactagtatgggacttagattcaacccttccttttccttcacctctacccttatacgtgtctgaaactatacgaccgtcttttcaacttttttctgattataacagattattcagagttgtgcacgctccactatttcttcgtagttttgcatctgatagaagacatatgaaagattctggtggaaagtggattgaagaacctcctccacatgagcctataattgcagaagatggaacagtgcacaacctgaatgaatacattaacatatctgttgctgatgctattaccgatgtttctatcagttcagtgaaagatgtaatttttacccagaaaaatggtgtggtgataaaggataatcagcttgaggaattcatttgtcagttatcttctttagaatagccccattcatatggctccctggtttgtatatgttcagctgctatccaagatactgtcaaatgttgtctcccttttaatgggtgttgtaaaaatgcttcttttgaaggtgtctttttgagagtgctgtgcaagaaatgcaagtttaagctac

SEQ ID NO: 8981 - DNA, 1182 bp, Glycine max
taatgcatggaccggtttgggttttggtctctgcccttttgggttttctttgcagacatatcttggatcccatttccatcaggtcagtgcctatgtacttttttcagaaaggttggtggtgactggtgattgttgaagagaataatggcaacttcaactatggatattcttcatttccaccacactcctttttattgtgaggagaatgtatacttgctttgcaaaaagttgtgcaatgatggaatagcaaatgctgatggatctgatctttttgttgctttcatttccaacgaaaagaaacagatcccactttggaatcaaaaggctagcaaaagagctgatggggtgattctatgggattatcatgtaatttgcattcagataaaacaaggagctgtccctccactagtgtgggacttagattcgactcttccttttccttcacctctaccatcatatgtgtctgaaacaattcgtccgtcttttcagcttttttctgattataatagattattcagagttgtgcatgccccgctatttcttcgttgttttgcatctgatagaagacacatgaaagattctggtggaaactggattgaagaacctcctcaacatgaacccatagttgccgaagatcgaacagtgcacaacctgaatgagtacattaacatatctgctgctgatgctattaccgatgttacaatcagttcagtcaaagatgcaatttctacccagacacatggtgtggtgataaaggaaaaccagcttgaggaattcatttgtcagttatcttctttgcaatagccacattcatattgtttggcatccacatatcaatacttccctggtttgcatatgttcagctgccatctttccatcaaagatgccggtcaaatagtgtttctcttcaaatggggtattgtaaaaatgtctcttctgaaagtgtctttttgagagtagtgtgcaaggaatgcaaatctaagccccattttgtttttcaggagcagaacacaatgttttgctttaattcttcagttgtgcccttggtttatagcaactatatgggtgatgtgaattttagaactggaatggagaatggtttcttctgtgatgtgttactaagttaattcaggtgtgacaataccactgatcttactgattttttctgacaacaaatcttaa

SEQ ID NO: 8982 - DNA, 1154 bp, Glycine max
cggtttgggttttggtctctgcccttttgggttttctttgcagacatatcttggatcccatttccatcaggtcagtgcctatgtacttttttcagaaaggttggtggtgactggtgattgttgaagagaataatggcaacttcaactatggatattcttcatttccaccacactcctttttattgtgaggagaatgtatacttgctttgcaaaaagttgtgcaatgatggaatagcaaatgctgatggatctgatctttttgttgctttcatttccaacgaaaagaaacagatcccactttggaatcaaaaggctagcaaaagagctgatggggtgattctatgggattatcatgtaatttgcattcagataaaacaaggagctgtccctccactagtgtgggacttagattcgactcttccttttccttcacctctaccatcatatgtgtctgaaacaattcgtccgtcttttcagcttttttctgattataatagattattcagagttgtgcatgccccgctatttcttcgttgttttgcatctgatagaagacacatgaaagattctggtggaaactggattgaagaacctcctcaacatgaacccatagttgccgaagatcgaacagtgcacaacctgaatgagtacattaacatatctgctgctgatgctattaccgatgttacaatcagttcagtcaaagatgcaatttctacccagacacatggtgtggtgataaaggaaaaccagcttgaggaattcatttgtcagttatcttctttgcaatagccacattcatattgtttggcatccacatatcaatacttccctggtttgcatatgttcagctgccatctttccatcaaagatgccggtcaaatagtgtttctcttcaaatggggtattgtaaaaatgtctcttctgaaagtgtctttttgagagtagtgtgcaaggaatgcaaatctaagccccattttgtttttcaggagcagaacacaatgttttgctttaattcttcagttgtgcccttggtttatagcaactatatgggtgatgtgaattttagaactggaatggagaatggtttcttctgtgatgtgttactaagttaattcaggtgtgacaataccactgatcttactgattttttc

SEQ ID NO: 8983 - DNA, 1321 bp, Cicer arietinum
gataaacctagtgtggctggcaacctaattggtctcaaaacatgaaataaagataaaaagcgaaatggtaaaatagcgaaaaacagtacttttgagaaattgtgggatagaagtataaatatatgggctataatattcttcgggagcaacaatgggtttttgggttatatactcccatttattaaggaagtcagcactagcacctgtgcttgttgattaaaattgctgcttcgagttgaagaaaggatcgatggcaacttcttcaacaatggatgtttctcacttccaccacacccctttttattgtgaggagaatgtatatttgctttgcaagaagttgtgcaatgatggaataacaaattctgaaggatctgatctttttgttgcttttatttccaatgaaaagaaacagatcccactatggaatcaaaaagctagcaagagggcagatggggttattctctgggattatcatgtcatttgcattcagataaataaagaaggtgatgctccactagtttgggacttagattcaactcttccttttccatcacctctagcttcatatatgtctgaaacgattcgcccttcttttcaactttttgctgattataatagattattcagaattgtgcatgctccaatcttccttcgttgttttgcatctgatagaagacacatgaaagtttctgatggacattggattgaagaacctcctccacataaacctatagttgctgaagatggaacagtgcacaacctggatgaatactttaacatatctggttccgatgctattgctgatattaaatccagttcagtcaaagatacagtgtttgcccagaaacatggtgtggtgataaaggagaaccagcttgaggaattattttctcagatatctttataatagccatatggttgatggttctaattagatatcatatatttatctatacttattgagtttgtacatgttcagttaccatctttttattaaaagatgctgattaaatattgtgtcatattaacttggaaggtaaaatgttgtttttggtattggggtgcaagaaaagcaaatctaagctccattttatttttttcaggagcagaacaaaatgttttcagtaacttcacttttattatggcaaatatatgggtgatgtcatttttagaactggaatggtgaatattttttatgtgaattgtttactcatgtgcattcgggtgttaaaatgttcctgttcttatttattttatataaaaaactaacggataaaaagtttggttagtaggggttttgaagcaacaattacaaaaaatt

SEQ ID NO: 8984 - DNA, 1143 bp, Medicago truncatula
ctcccttctctccctcgtgtatctctcagccaccatcacccaacatcaccaattctactttaaaatccctttatgcaatagataattagagaagaagaagtttatagtaccaattcatgctagggtttgatcaaagaggaagaacacgaaattggggttttggagatttgtagaaattgaaagcaagagctaaggattggggaatcattagaagcatcatctttcatcatacagaatcaagttgttacaggtttgttgctgctgcgctgtagagtgttgatcaatggcggcaacgtcaactatggatgtttctctcttccaccacacccctttttattgtgaggagaatgtatatttgctttgcaagaaattgtgcagtgatggaatagcaaattcggaaggatctgatctttttgttgctttcatttccaatgataagaaacatatcccactttggaatcaaaaagctagccaaagggcagatggggttattctctgggattaccatgtcatttgcattcagacaaatcaaggaggtggcctcccactagtttgggacttagattcaactcttccttttccttcacctctaccttcatatgtgtctgaaaccattcgcccttcttttcaacttttttctgattataatagattattcagaattgttcatgctccgatcttccttcgttgttttgcatctgatagaagacacatgaaaggttctgatggacattggattgaacagcctcctccacatcaacccattgttgctcaagatggaacagtgcacaacctcaatgaatactttaacatatccagttcagacgctactgcggatgttagaaccggttctgtcaaagatgcattgtttacccagaaacatggtgtggtgataaaggaaaatcagcttgaggaattgttttctcagatatctttacagtagcctcatggttctaaatagatatcatatattgatctatctatatttactgtgtttgtgtttgtatttgagccacataatcatttgtactgtgtttggttgtacgtttgtcacctcaaacttacgtgtatattgctttttgatgttaaaacatgaagataatatttgtagcttatgtaaaaaatgcatgtttgacgcctatt

SEQ ID NO: 8985 - DNA, 1171 bp, Medicago truncatula
ggaaaaacagattttccaactttcctcccttctctccctcgtgtatctctcagccaccatcacccaacatcaccaattctactttaaaatccctttatgcaatagataattagagaagaagaagtttatagtaccaattcatgctagggtttgatcaaagaggaagaacacgaaattggggttttggagatttgtagaaattgaaagcaagagctaaggattggggaatcattagaagcatcatctttcatcatacagaatcaagttgttacaggtttgttgctgctgcgctgtagagtgttgatcaatggcggcaacgtcaactatggatgtttctctcttccaccacacccctttttattgtgaggagaatgtatatttgctttgcaagaaattgtgcagtgatggaatagcaaattcggaaggatctgatctttttgttgctttcatttccaatgataagaaacatatcccactttggaatcaaaaagctagccaaagggcagatggggttattctctgggattaccatgtcatttgcattcagacaaatcaaggaggtggcctcccactagtttgggacttagattcaactcttccttttccttcacctctaccttcatatgtgtctgaaaccattcgcccttcttttcaacttttttctgattataatagattattcagaattgttcatgctccgatcttccttcgttgttttgcatctgatagaagacacatgaaaggttctgatggacattggattgaacagcctcctccacatcaacccattgttgctcaagatggaacagtgcacaacctcaatgaatactttaacatatccagttcagacgctactgcggatgttagaaccggttctgtcaaagatgcattgtttacccagaaacatggtgtggtgataaaggaaaatcagcttgaggaattgttttctcagatatctttacagtagcctcatggttctaaatagatatcatatattgatctatctatatttactgtgtttgtgtttgtatttgagccacataatcatttgtactgtgtttggttgtacgtttgtcacctcaaacttacgtctatattgctttttgatgttaaaacatgaagctaatatttgtagcttatgtaaaaaatgcatgtttgacgcctattacat

SEQ ID NO: 8986 - DNA, 3980 bp, Lupinus angustifolius
attcacacttggagtaataagagagaaccaaaaaagttctcatctcaattcaaaaaaacccttctcccttttcccttcatcgccgccacaatggatcccgagtcaactcagcttcagcaatctcaactcgctgctatacttggtcccgatccaactcacttcgaaaccctaatctctcacctcatgtcctcttccaacgatcaacgttctcacgctgaaactctcttcaatctatgcaagcaaaatgaccctaataccctttcccttaaactcgctcaacttcttcactcttctcctcaccttgaggcacgcgccatgtccgctatactcctccgtaagcaactcacgcgccaccataacgaagccgatgaatcgaactacctgtggccacgtctcaacgctaacactcaatctactctcaaatcgattctattgtcttctctgcaatctgaacaaaccaaatcgatctcgaagaaactatgcgatactgtttccgaacttgcttctggtattttacctgataacggttggccggagttgcttccgtttatgtttcaatgtgtttctgcttctgattcacctaagcttcaggaatctgcgttcttgattttcgcacaattgtcgcagtacattggagattcgttggttccgcatattaagcatcttcacgcgatttttctccagtgcttgacatctccggctgttgattctgatgttcggatcgcggcactgaatgctgttatcaattttattcagtgtttgtcgggctctgctgatagggataggtttcaggatttgttgccagcgatgatgaggacactgactgaagcattgaatttggggcaggaggcaaccgcacaggaggcactggagcttatgatcgagctcgcggggaccgagccaaggtttctgaggaggcagcttgctgaggttgtaggggcaatgctgcagattgcggaggcagagtcattggaggaagggacacggcatttggcgattgaatttgtgattacattggctgaggcgagggagcgtgcgcccgggatgatgaggaaactgccacagtttataagtagattgtttgctatattgatgaagatgcttttggatattgaggatgatccagcttggcatagcgccgagactgaggatgaagatgctggggaaaccagcaattatagtgtggggcaagagtgtttggatagactggctatatctttgggcgggaataccattgttccggttgcatccgaacagttgccagcttatttggctgctcctgagtggcaaaaacgccacgctgcattgattgcacttgcccaaatagccgagggatgctccaaggtcatgataaaaaatttggagcaagttgtggctatggtgttgaacagctttccagatcaacatcctcgtgtaagatgggctgccattaatgcaattgggcagttatctactgacttaggtccagatttgcaaaatcaatatcacccgggtgtgttgccggcactagcggctgctatggatgattttcagaaccctcgtgtacaggcacatgctgcttcagcagtgctcaacttcagtgagaactgtacacctgatattttaacaccatacttggatggaatagttagcaaacttcttgtaattcttcagaatggtaagcaaatggtgcaagagggtgctttaactgctttggcatcagttgctgattcatctcaggaacatttcaagaaatattatgatgctgtcatgccttacctgaaggctatattgattaatgcaactgacaagtctaaccgtatgcttcgtgctaagtccatggagtgtataagtttggttggaatggctgttggtaaggagaagtttagggatgatgccaagcaggtcatggaagttcttatgtccttgcaaggatctcaaatggagacagatgatccaacaacaagttacatgctgcaggcatgggctagactttgtaagtgcctgggacaggattttcttccttatatggcgtttgtcatgccaccattgctttggtctgcttctcttaagcctgatgtaaccattacatcagcagattcagacaatgatatcgatgattctgatgatgaaagcatggagactatcactctcggcgacaaaagaattggaatcaagactagcgttctagaggaaaaagctacagcctgtaacatgctttgttgctatgctgatgagctgaaggaaggattcttcccatggattgatcaggtcacaggaattctagttccgctcctaaaattttatttccatgaggaggttagaaaagcagctgtttcagcaatgccggagctgttacgatctgcaaagttagctatagagaaggggcaatctcaaggtcgggatgcaagctatttgaagtttttgactgacagtatcgtcccagctctggtggaagcattgcataaagaaccagacacagagatttgtgcaagtatgttggattcaataaatgaaagcttacagatctcagggatgcttttggatgaaaatcaggtcagatccattgtcgatgagttaaaacaggttatcacagctagttcaagtagaaaaagtgagagacaggagagggccaatgctgaagattttgatgcggaagagggggaactaattaaagaggaaaatgaacaagaggaagaagtttttgaccaagttggtgagatattgggaactttgattaaaacctttaaagcgtccttcttgcctttcttcgatgaactatcatcatatctgacacctatgtggggaagggacaagacacctgaagagagaaggattgcgatctgcatttttgatgatgttgcagagcaatgtcgtgaagcagctctgaagtattatgatacatatctcccattcctgttggaggcttgtaatgatgagatccctgatgtcagacaggctgcggtgtacggccttggtgtttgtgcagagtttggtggatctgtgttcaaacctctagttggagagtctctttcgagattaaatgctgttatccaacatcctaatgctcttcatggggataatataatggcatatgataatgcagtttctgctctgggaaaaatttgccaatttcatcgtgacagtattgattcagcccaggtggttccggcatggttgaactgcttgccaataaaaggtgatttgattgaggccaaggttgttcatgatcaactttgttcaatggttgagaggtctgacagggacctgttgggcccaaacagtcaataccttccaaaaatagtttcagtttttgccgaggttttatgtgctggcaaagagcttgcaacagaacaaacagtcggccgtatgattaatttgctcagacagctccagcaaactttaccacccgccactcttgcttctacttggtcatctttgcagccgcagcagcagcttgcattacaatctatcctttcttcttagttctgggattacaattggtgtcacaatcttctttgaaaacatgctctttccagtttggtggtctttatttttgtcactcattctttaccataagatggttttcatcattcatgcatggtgtttttatagtagcatgggttcagttttgagaatgctgcagttatgagtcaattgtgattggaaagggaactttgtgtagaatttgtatattatgaagagtgttaatagagtgcaattgagtccaaaagaaaaggttcaacaattgtggcttggtagcttctcattctgttctatcatattgggtgagaagatagggttgtctgaggcagttcttgcagttttgtcctatcgtgtcgtttcatttttgtctgttgtactggtgtttgaaaacatggtatttattgctcatgaaattgattcattaaggttttggaatgttatttatccaacaataatttggagatgcttgtgcacaaatttctttcccatttattatattcatacattttcaccaa

SEQ ID NO: 8987 - DNA, 4104 bp, Lupinus angustifolius
aaccatataaaagggtatagcaaccaaaacccagtttgacacggaggaccaaaaaacctcaaatcccaatccaaaaaacaaaaacccttcttcttcttcttcatcgccgccatcaccaccatcatggaccccgagtcaactcagctccaacaatcccaactcgcttctatattaggtcccgatccaaccccattcgaaaccctaatctctcatctcatgtcttcttccaacgaccaacgctctcacgctgaatccctcttcaacctctgcaagcaaaatgaccctaataccctttccatcaagcttgcgtatctccttcaatcttcccctcaccacgaggcacgcgccatgtccgccatcctcctccgcaaacagttcactcgcctccacagcgaaattgatgatagtaactacctgtggccacgtctcaacggtaacactcaatcaacgcttaaatcgttgttgttgtcgtcgcttcaagcggaacaaactaaatcgatttcgaagaagctatgcgacaccgtttcggaactcgcttctggtattgttcctgataacggttggccggagttgttgcctttcatgtttcaatgtgtttcttcgtcggattcgccgaagcttcaggaatctgcgtttttgattttcgcgcaattgtcgcagtatattggagattcgcttgttccgcatatcaagcacctccacgctatttttctccagtgtttgacatcgtctgcggttgattctgatgttcggattgcggcgctgaatgcggttatcaattttattcagtgtttgtctggttcgggtgatagggataggtttcaggatttgttgccggcgatgatgaggactttgactgaggctttgaattcgggacaggaggccactgcacaggaggctctggagctgttgattgagctcgcggaaactgagccgaggtttcttaggcggcagcttgcggaggtggttggggctatgctgcaaattgctgaggcggagtcattggaggaagggacgcgtcatttggctattgaatttgtgatcacattggctgaggcgagggagcgtgcacccgggatgatgaggaaactgccacagtttataagtagattgtttgctatattgatgaagatgcttttggacattgaggatgatccggcttggcatagtgctgagactgaggatgaggatgcaggtgaaaccagcaattacagtatggggcaagagtgtttggataggttggctatatctttgggtggaaataccgttgttccagttgcatccgagcaattgcctgcttatttggctgctcctgagtggcagaaacgccatgctgcattgattgcacttgcccagatagctgagggatgctccaaggtcatgataaaaaatttagaacaagtggtggctatggtgttgaactcctttcctgaccaacatcctcgtgtaagatgggctgctattaatgcaatcgggcagttatctactgatttaggcccggacttgcagattcattatcaccagggagtgttgccagcactagcggctgctatggatgattttcagaaccctcgtgtacaggcacatgctgcttcagcagtgctcaacttcagtgagaactgcacacctgatattttaacgccatatttggatggaatagttagcaaactacttgtaattcttcagaatggtaaacaaatggtgcaagagggtgctttaactgctttggcatcagttgctgattcatctcaggaacacttcaagaaatactatgatgctgtcatgccatacctgaaggctatattgattaatgcaaatgacaagtctaaccgtatgcttcgtgctaagtccatggagtgtataagtttggttggaatggctgttggtaaggagaagtttagggatgatgctaagcaggtcatggaagtccttatgtccttgcaagtatctcaaatggagacagatgatccaacaacaagttacatgctgcaggcatgggctagactctgtaagtgcctggggcaagattttcttccttatatgacctttgtcatgccaccattgctttggtctgcttctcttaagcccgatgtaaccattacatcagcagattcagacaatgatatcgatgattctgatgatgaaagtatggagactatcactctcggggacaaaagaattggaatcaagactagcgttctagaggaaaaagcaacagcttgtaacatgctgtgttgctatgctgatgagctgaaggaaggattctttccatggattgaccaggttgcaggaattttagttccactcctaaaattttatttccatgaggaggttagaaaggcagctgtttcagcaatgccggagttgttacgatctgcaaagttagctatagagaaagggcaatctcaaggccgggatggaacctatttgaagtttttgacggacagtattgttccagctctggtggaagcgttgcataaagaaccagacacagagatttgtgcaagcctgttggattcactaaatgaaagtttacagatatctgggacgcttttggatgaaaatcaggtcaggtccattgttgatgtgttaaagcaggtgatcacagctagttcaagtagaaagagagagagggaggagagggccaaagctgaagattttgatgctgaagagggggagctgattaaagaggaaaatgaacaagaggaagaagtttttgaccaagttggtgagatattgggaactttgatcaaaaccttcaaagcctctttcttgcctttcttcgatgaactatcatcatatttgacacctatgtggggaagggacaagacacctgaagagagaaggattgcaatttgcatttttgatgatgttgcagagcaatgtcgtgaagcagctctcaagtattatgagacatatctcccattcctgttggaggcttgtaatgatgaaatccctgatgtcagacaggctgctgtatatggccttggtgtttgcgcagagttcggtggatctgtgtttaaacctctagttggagagggtctttcaagattaaatgctgttatccagcatccaaacgctcttcagggggataatgtaatggcatatgacaatgctgtttctgctctaggaaaaatttgccaatttcatcgtgacagtattgattctgcacaggtggttccggcatggttgaactgtttgccaataaaaggtgatttgattgaggcaaaagttgttcatgatcaactttgttcaatggttgagaggtctgacggggacctgttgggcccaaacagtcaataccttccaaaaatagtttcagtatttgccgaggttttatgtgccggtaaagagcttgcaacagaacaaacagttggccgtatgattaatttgctcagacagctccagcaaactctaccaccagctacccttgcttctacttggtcatctttgcagccgcagcagcagcttgcattacaatccatcctttcttcttaggaccgggttgaaggtcggtgtctcattcttctcggagaacatactttttccattttggccgtctctatatttgttacccattctttgccataagttggtttcattcatcattcatgcatggtgtttcatagtagcatggattcagttgagaatgctgcagtgtcaattgtgattggaaaggaaactttgtgtagaatttgtatattatgaagagtgttcatagcgcatttgagtccaaaagaaaaaggatcagcattcatggcgtgacagcttctcaatctgtttctccttttgtttttattttttatgttcaccatattttgtgagaggatagggttgtctgaggcaattcttgcagttttggccttttgtgtttcattttctggggtctctgttctggttttaaaaacatggtatttattgtattctgaaatactgatgttattggttcatcaagtttttgcaatagtctatctaaataagatggtatttattgtgttaaaatgagtattttggatctaaaatactcaactgcgtaagacaagttctcatgtagttactttatttcggaataaatatgtttttggtttctgtttgattttttaa

SEQ ID NO: 8988 - DNA, 4074 bp, Vitis vinifera
aaacacgcccttcatctctctcttctgttctcctctccttcttctattctcctctcctctctctcccgctgcctctctttctctgcgccggaggcatcgaaaaccctaactcgcagccatggatcccgagtcgactcaactccagcaagctcaactcgccgctatcctcggccccgatccagggcccttcgaaaccctaatctcccacctcatgtccacctccaatgaccagcgctcccacgctgaactccttttcaatctctgcaaacagtccgatccaaactcgctgtctttgaaactcgcccatcttcttcagttctctcctcacatcgaggctcgagccatggccgcgattctcctcagaaagcaactgactcgggatgattcctacctctggccgcggctcagtgcgtccactcagtcatcgctgaaatcaattttgttagggtgtattcagcgggaggatgcgaagagtatttcgaagaagctgtgcgacaccgtttccgagttggcgtcgtcgattctgccggagaacgggtggccggagctgttgccgtttatgtttcagtgcgtgacctccgattcggcgaagcttcaggaggcggcgttcttgattttcgcgcagttggcgcagtacatcggggaaaccctagttcctcatattaagcatctgcactcggtgtttttgcagagtctgacgtcgtcgtcgagctccgatgtgaaaatcgcggccttgagcgctgcgattaatttcattcagtgcttgtcgagttcggcggaccgggatcggtttcaggacttgttgccggcgatgatgcgcacgctaacagaggcattgaattgtgggcaggaggcgacggcgcaagaggcgctcgagttgttgatcgaattggccgggacggagccgcggtttctgagacggcagttggtggatgtggtggggtctatgttacagattgcggaggctgagagcctggaggaggggacgcggcatttggcggtggagttcgtgataacactggcggaggcgagggagcgcgcacctgggatgatgaggaagttgccgcagtttataagtaggctttttgctatattgatgaagatgctgttggatattgaggatgatccagcgtggcatagtgcggatagcgaggacgaggatgcgggtgagagcagtaattacagtgttgggcaagagtgtttggataggttagctatttcattgggtgggaatacgattgtacctgttgcttcagagcttttgccggcatatttggctgcgccggagtggcaaaagcaccacgcagctctgattgctcttgctcagatcgcagaaggctgttcaaaggtaatgataaaaaatttggagcaagtggtgacaatggttttgaatacattccaagatcctcatcctcgtgtccgatgggcagctattaatgccattgggcaactgtccacagacttgggcccagatttgcaagttcagtaccatcaacgagtgctaccggctctagctgcatctatggatgacttccagaatccacgggtgcaggcacatgctgcttcagctgtgctcaacttcagtgagaactgcactccagatattttaacgccatatttagatggaattgttggcaaattactagtacttctacagaatggaaaacaaatggtgcaagagggggccttgactgctttagcgtctgttgctgattcatctcaggaacatttccaaaaatactatgatgcagttatgccttacctaaaagcaatattgatgaatgccactgacaagtctaaccgcatgcttcgtgccaaagccatggagtgcatcagtttggttggcatggctgttggaaaagataagttcagggatgatgcaaagcaggttatggaagtacttatgtcattgcaaggatctcaaatggagacagatgacccaacaacaagctacatgctacaagcttgggccagactctgcaagtgcctgggacaagacttcctcccttacatgagtgttgtcatgccccctttgcttcaatctgctcaacttaaacctgatgtaaccattacatctgctgattcagacaatgaaatcgaagaatctgatgatgaaagtatggagaccattactcttggggataaacgaatagggatcaagactagtgtcctggaggagaaagccaccgcttgcaacatgctatgttgctatgccgatgagttgaaggaagggttctttccatggattgatcaggttgctccaactttagttccacttctcaaattttatttccacgaagaagttaggaaagctgctgtttctgccatgccagagctactgcgttcagcaaaattagctgtggagaaaggtctagctcaaggtcgtaatgagtcatatgttaagcaattgtctgactatataataccagctttggtggaagctttgcataaggaacctgatacagaaatatgcgcaagtatgctagatgcactaaatgaatgcttgcagatatctggacgaattctagatgaaagccaagtgagatctattgtggatgagataaaacaggtgattacagctagctcaagtagaaaaagagagagagcagagaggaccaaagctgaggactttgatgctgaggagggagaattgctcaaagaagaaaatgagcaagaagaagaagtttttgatcaagtgggtgaaattttgggaactttgatcaagacattcaaggcatctttcttgccattctttgatgagttagcttcatatctcacacctatgtggggcaaagataaaacagccgaagagagaaggattgcaatctgcatctttgatgatgttgcagagcaatgtcgtgaagcggctcttaaatattatgatacatatcttcctttcctcttggaagcttgcaatgatgataattcagatgttcggcaggcagctgtatacggacttggtgtttgtgcagagttcgggggtgctgcatttaaacctcttgttggagaggctctttcaaggctaaatgtcgtaatacggcatcctaatgcactgcaaccagataatgtaatggcatatgataatgctgtttctgctctaggaaaaatttgccagtttcatcgtgacagtattgattcagctcaggttgttcctgcctggttgagttgcttgccaataaagggtgatttgatcgaggccaaagttgttcatgaccaactttgttcaatggttgaaatgtcagatagggaacttctgggacctaacaatcaataccttcctcaaattgttgcagtatttgctgaggttctatgtgcgggtaaggatcttgcaacagagcaaaccataagccggatgataaacttgctgagacaacttcagcagacgctaccaccttccaccttggcctcaacttggtcatccttgcagccccagcagcagcttgcattacaatcaatcctctcatcttagcatctctcaactgacaaaaagggcttcttgctgtgcatggaagaactgttatgtccggtctggtcagtcggcttgtgtttagtataaatataaatatatattatttgttacccattcttttccataagatggtcccatcattcgtttttgcattatgttttacacaacctggcgtctgtccgtttggtttgagcatgaaaagccaacaatgaggattgaaatgaacccccctttttttgtagaatgtgtatattacgagtgttatatagtgggttcttgcttccaaacaaaaagggaaaaagggaaaaggggaaggtgattgtggttcttgtgaggtattgtgagtttctctttctttcagtgggtgaggtctgaggattgtttgtgaggcaattcttacagcagttttggtcggattgtgttttatttggttttacctttgttttttttttggggcatacattttgattgtgaaatatttggactggaaaaaatcataaatggtgattcttttcttgcagttattattttttttttcaaaatccgaatcctggtgggcaatggcataagaatgaagtagaatcctctgtttggaattttattta

SEQ ID NO: 8989 - DNA, 3899 bp, Vitis vinifera
cggaggcatcgaaaaccctaactcgcagccatggatcccgagtcgactcaactccagcaagctcaactcgccgctatcctcggccccgatccagggcccttcgaaaccctaatctcccacctcatgtccacctccaatgaccagcgctcccacgctgaactccttttcaatctctgcaaacagtccgatccaaactcgctgtctttgaaactcgcccatcttcttcagttctctcctcacatcgaggctcgagccatggccgcgattctcctcagaaagcaactgactcgggatgattcctacctctggccgcggctcagtgcgtccactcagtcatcgctgaaatcaattttgttagggtgtattcagcgggaggatgcgaagagtatttcgaagaagctgtgcgacaccgtttccgagttggcgtcgtcgattctgccggagaacgggtggccggagctgttgccgtttatgtttcagtgcgtgacctccgattcggcgaagcttcaggaggcggcgttcttgattttcgcgcagttggcgcagtacatcggggaaaccctagttcctcatattaagcatctgcactcggtgtttttgcagagtctgacgtcgtcgtcgagctccgatgtgaaaatcgcggccttgagcgctgcgattaatttcattcagtgcttgtcgagttcggcggaccgggatcggtttcaggacttgttgccggcgatgatgcgcacgctaacagaggcattgaattgtgggcaggaggcgacggcgcaagaggcgctcgagttgttgatcgaattggccgggacggagccgcggtttctgagacggcagttggtggatgtggtggggtctatgttacagattgcggaggctgagagcctggaggaggggacgcggcatttggcggtggagttcgtgataactctggcggaggcgagggagcgcgcacctgggatgatgaggaagttgccgcagtttataagtaggctttttgctatattgatgaagatgctgttggatattgaggatgatccagcgtggcatagtgcggatagcgaggacgaggatgcgggtgagagcagtaattacagtgttgggcaagagtgtttggataggttagctatttcattgggtgggaatacgattgtacctgttgcttcagagcttttgccggcatatttggctgcgccggagtggcaaaagcaccacgcagctctgattgctcttgctcagatcgcagaaggctgttcaaaggtaatgataaaaaatttggagcaagtggtgacaatggttttgaatacattccaagatcctcatcctcgtgtccgatgggcagctattaatgccattgggcaactgtccacagacttgggcccagatttgcaagttcagtaccatcaacgagtgctaccagctctagctgcatctatggatgacttccagaatccacgggtgcaggcacatgctgcttcagctgtgctcaacttcagtgagaactgcactccagatattttaacgccatatttagatggaattgttggcaaattactagtacttctacagaatggaaaacaaatggtgcaagagggggccttgactgctttagcgtctgttgctgattcatctcaggaacatttccaaaaatactatgatgcagttatgccttatctaaaagcaatattgatgaatgccactgacaagtctaaccgcatgcttcgtgccaaagccatggagtgcatcagtttggttggcatggctgttggaaaagataagttcagggatgatgcaaagcaggttatggaagtacttatgtcattgcaaggatctcaaatggagacagatgacccaacaacaagctacatgctacaagcttgggccagactctgcaagtgcctgggacaagacttcctcccttacatgagtgttgtcatgccccctttgcttcaatctgctcaacttaaacctgatgtaaccattacatctgctgattcagacaatgaaatcgaagaatctgatgatgaaagtatggagaccattactcttggggataaacgaatagggatcaagactagtgtcctggaggagaaagccaccgcttgcaacatgctatgttgctatgccgatgagttgaaggaagggttctttccatggattgatcaggttgctccaactttagttccacttctcaaattttatttccacgaagaagttaggaaagctgctgtttctgccatgccagagctactgcgttcagcaaaattagctgtggagaaaggtctagctcaaggtcgtaatgagtcatatgttaagcaattgtctgactatataataccagctttggtggaagctttgcataaggaacctgatacagaaatatgcgcaagtatgctagatgcactaaatgaatgcttgcagatatctggacgaattctagatgaaagccaagtgagatctattgtggatgagataaaacaggtgattacagctagctcaagtagaaaaagagagagagcagagaggaccaaagctgaggactttgatgctgaggagggagaattgctcaaagaagaaaatgagcaagaagaagaagtttttgatcaagtgggtgaaattttgggaactttgatcaagacattcaaggcatctttcttgccattctttgatgagttagcttcatatctcacacctatgtggggcaaagataaaacagccgaagagagaaggattgcaatctgcatctttgatgatgttgcagagcaatgtcgtgaagcggctcttaaatattatgatacatatcttcctttcctcttggaagcttgcaatgatgataattcagatgttcggcaggcagctgtatacggacttggtgtttgtgcagagttcgggggtgctgcatttaaacctcttgttggagaggctctttcaaggctaaatgtcgtaatacggcatcctaatgcactgcaaccagataatgtaatggcatatgataatgctgtttctgctctaggaaaaatttgccagtttcatcgtgacagtattgattcagctcaggttgttcctgcctggttgagttgcttgccaataaagggtgatttgatcgaggccaaagttgttcatgaccaactttgttcaatggttgaaatgtcagatagggaacttctgggacctaacaatcaataccttcctcaaattgttgcagtatttgctgaggttctatgtgcgggtaaggatcttgcaacagagcaaaccataagccggatgataaacttgctgagacaacttcagcagacgctaccaccttccaccttggcctcaacttggtcatccttgcagccccagcagcagcttgcattacaatcaatcctctcatcttagcatctctcaactgacaaaaagggcttcttgctgtgcatggaagaactgttatgtccggtctggtcagtcggcttgtgtttagtataaatataaatatatattatttgttacccattcttttccataagatggtcccatcattcgtttttgcattatgttttacacaacctggcgtctgtccgtttggtttgagcatgaaaagccaacaatgaggattgaaatgaacccccctttttttgtagaatgtgtatattacgagtgttatatagtgggttcttgcttccaaacaaaaagggaaaaagggaaaaggggaaggtgattgtggttcttgtgaggtattgtgagtttctctttctttcagtgggtgaggtctgaggattgtttgtgaggcaattcttacagcagttttggtcggattgtgttttatttggttttacctttgttttttttttggggcatacattttgattgtgaaatatttggactggaaaaaatcataaatggtgattcttttcttg

SEQ ID NO: 8990 - DNA, 3838 bp, Tabernaemontana elegans
accgaaactaaaagaaagagaaaagaccgagagcgccaccgcacacactccacgcacatagttgttcgctctttttcgttcgggaaaaaccctaactcatcgaggaggtggtaatggacgccgggtcaactcagatgcagcaagctcaactcgccgcgattctggggccggaccttgccccattcgaaaccttaatctctcatctcatgtcctcttccaacgatcaacgatcccaggctgagtccatcttcaatctcatcaagcagaatgatcccaattcgctggtgctcaaactcgctcagcttctatcatcttcccctcacgtcgaggctcgtgctatgtccaccatccttctccggaagcagctcacccgcgatgactcttatatctggcctcgactcactgtgtcgactcagtccaccatcaaatccatactcttgtcatgcatccaaaatgaaaattccaagagtataatcaagaagctctgcgatacaatctccgaattagcatcctctattttgcccgagaacaattggccggaaattttacccttcatgtttcaatgcgtcacttccgactctgtgaagttacaggagtcggcgtttttaattttctcgcaactagcgcagtacataggcgacacgcttatcccatacatcaaggatttgcatgctgtctttttgcaggtgctcaataattcgccaagctccgatgtgaaaatcgctgccttgagcgccgttattaattttattcagtgcttgactagccctagcgaccgggataggtttcaggatttacttccggctatgatgaggacgttgaccgaggccttgaactgcgggcaggaggcgactgcacaggaggcgttggagttactgattgagttggcagggactgagcctaggtttttgaggaggcaattggtggatgtggtgggttccatgttgcagattgccgaggctgagggtctggaggaaggcacaagacatttggcgattgaatttgtgattactttggccgaggcaagagagagggctcctgggatgatgaggaagttgccgcagtttattagtcggttgtttgcaattctgatgaaaatgttgttggatgtggaggatgagccagcttggcatagtgctgagccagatgatgaggatgctggggagaccagtaactacagtgttgggcaggagtgtttggataggctgtctattgccttgggtggaaatactattgttcctgttgcttcggagcagttgccggcctatttggctgctcctgagtggcagaagcatcacgcggcactcattgcacttgcacaaattgctgagggctgctcaaaggttatgattaagaatttggagcaagtggtgaatatggttttgaattcatttcaagatcctcacccacgtgtgagatgggcagctattaatgcaattggtcaactatcaacggatttgggcccagatttgcaagttcagtatcaccaacgcgtgttgccagcgctagctgctgctatggatgacttccagaaccctagagttcaggcacatgcggcttcagcagtgcttaacttcagtgagaactgcactccagaaattttaacaccttacttggatggaattgttagcaagctgctcgtacttctacagaatgggaaacaaatggtgcaagaaggggctttgacggctttagcttctgtggctgattcctctcaggagcacttccaaaaatactatgatgcagtcatgccttacttgaaaactatcttggtgaatgcaactgacaagtcaaatcgtatgcttcgtgccaaagctatggaatgtattagcttggttggaatggctgttggaaaagagaagtttaggaatgacgcaaagcaggttatggaggtgctcatgtcactacaaggatcgcagatggaaaccgatgatcccaccaccagttacatgctgcaagcatgggccaggctctgcaagtgtctcggacaagattttctcccttacatgagtgtagtcatgcctcccttgctccagtctgcacaacttaagcctgatgtgaccataacatctgcagattctgataatgaaattgatgaatcagatgatgaaagtatggagacgattacacttggggataaaaggataggcattaagactagtgtcctggaggagaaagctacagcttgtaacatgctatgttgttatgctgatgagctgaaagaaggtttctacccatggattgatcaggttgctccaactttagttccgcttttgaaattctacttccatgaggaagttaggaaagctgctgtttcagccatgcctgagctgttgcgttctgcaaaattagccattgagaaagggattgctcaaggccgtaatgagacatatttgaagcaattgtctgacttcataataccagccttggtggaagctttgcacaaggagcctgatacagaaatatgtgcagctatgttggatgcactgaatgaatgtcttcagatctctggaccccttctagatgaaagccaggttcgaagcattgtggatgaggtaaaacaagtgatcacagcaagctcaagtagaaaaagagaacgagcagagagagctaaagctgaggactttgatgcagaggaaggggaattgctcaaagaggagaatgagcaagaagaggaagtctttgatcaggttggtgaaatcttgggtacattgatcaagacattcaaggctgctttcttgcccttctttgatgagctgtcgtcgtatttaatgcctatgtggggaaaagataaaactcctgaagagagaagaatagcgatttgtatttttgatgatgttgcggagcaatgccgtgaaacagctctcaagtattacgacacatatctcccttttcttttggaagcttgcaatgacgagaatccagatgtccgacaggctgctgtttatggacttggtgtatgtgccgaatttggtggctctgtttttaaaccacttgttggagaggcgctctcaaggttaaatgttgttatacagcatcctaatgctctgcagcccgataatgtgatggcatatgataatgctgtgtctgcattggggaagatatgtcagtttcatcgtgacagtatcgattcagctcaggttgttcctgcatggctgaactgtttgccgataaaaggtgatctaattgaagccaaagctgttcatgatcagctttgttcaatggtcgaaaggtcagatagggagcttttaggtcccaacaatcaacatctgcccaaaattgtctctgtttttgctgaggttctttgtgccggcaaggaccttgctacagagcaaaccgcaagtagaatgataaacttgttgaggcagcttcaacagacactgccaccttctgccctggcatcaacatggtcatccttgcagcctcagcagcagcttgcgttgcaatccatcctctcatcatagccagttaacttatgtttttggcttgggggttaccttgtgtctatcatatttgtattcaattctttcccatgagttgttcccataattcatttttctctggaaggtgatgcatcaacctcatcgtggttgtggtgagtgtgaagatatgcgagtaaaattcaaacttcttcctgtagaatgtgtatatttcagtctttgcagttgaatcttcagtaggagaggaaggcttgatccttatggcttgagattttgttcaaatgggtcgaatgtaagagttgtcattttggcaattcttgtcacagttttggtcggtcttgttgttctcttaagttgtcgattgttaagtacaaggatgaaatataaatggttattca

SEQ ID NO: 8991 - DNA, 3951 bp, Panax ginseng
atgagagagagagagagagcgccacagccgtcacctcgagttgttgattcgccggccttgtcaacccaaaaaccgtaactcgccttcgcgatggattcttcacagtcgactcagattcagcaagctcaacttgcagcgattttggggcctgatcccgccccatttgaaaccctaatctctcacttgatggcctcttccaacgagcaaagatcgcaagccgaactgattttcaatctctgcaagcaatccgatccgaactcgctggttctgaaactcgctcacctccttcagttctcccctcatgttgaagcccgtgccatgtccgctattctacttagaaaacagttgactcgtgatgactcgtacatatggcctcgattatctccttcaactcagtcatccctcaaatcgttcttcctctcttgcgttcaaagggaagaagccaaaacgattatcaaaaagctctgtgacaccatttcggaacttgcttctgggattttacccgacaatggatggccggagctcttacctttcatgttccaatgcgtatcgtcggattcacataagcttcaagaatccgcatttttaatcttcgcacaattgtctcagtacataggtgaaaccctgattccgcacataaagcacctacatactgtatttttacagtgtttgacgtcttcgtctagctcggatgtaagaattgcagcactcagtgcagttattaatttcattcagtgcttgtctagctccagcgaccgtgatcgctttcaggatttgttgcctgccatgatgaggactttgacagaagcattgaattgtgggcaggaagccacagctcaggaagcattagaattaatgattgaattggctgggacagagccaaggtttttgaggaggcaattagtggaagtagtggggtccatgttgcaaattgcagaggctgaaactttagaagagggtacaagacatctggccattgagtttgtgattactcttgcagaggccagagagagagctcctggaatgatgaggaaattgccccagtttattagcaggttatttgcaattttgatgaagatgctgttagatattgaagatgatccggcgtggcatcttgcggatactgaggatgaggatgccggagagactagtaattacagtgttggacaggaatgtttggatcggttggccattgctttgggagggaatactattgttcctgttgcatcggagcagttgccggcttatttggctgccccagagtggcaaaaccatcatgctgcattaattgcacttgcacagattgctgaaggatgctcgaaggtgatgataaaaaatttggagcaagtggtaacaatggttcttaattcatttcaagacccctatgctcgagtaagatgggctgcaattaatgcaattgggcagttgtctacagatttgggaccggatttgcaagtacagtaccatcaaagggtgctgccagcactagctgctgccatggatgacttccagagtccgcgtgtgcaggcgcatgctgcttcggccgtgctcaatttcagtgagaactgtacaccagatatattaacgccttacttagatggaatagtgagcaagctgcttgtgcttctagagaatggcaaacaaatggtgcaggaaggtgccttgactgctctggcctctgtagctgactcatctcaggagcattttcaaaagtactatgatgcagttatgccctacttgaaagctatattggttaatgcaaatgacaaatctaaccgcatgcttcgtgcaaaagccatggaatgcattagtttggttggaatggctgttggaaaggagaagttcagggatgacgcgaagcaggtaatggaagtgcttatgtcattgcaaggatctcaaatggagaccgatgatcctactacaagctacatgctacaagcatgggcaagactttgcaagtgtttggggcaagatttccttccctatatgagtgtagtcatgcctcccttgcttcagtctgctcaactgaaacctgatgtgatcattacatctgcagattcagataatgaaattgatgaatctgatgatgacagcatggagaccatcactctaggcgataaaagaattgggatcaagactagcgtcctagaagagaaagctacagcttgtaacatgctttgttgctatgctgatgagttgaaggagggtttctatccatggattgatcaggttgccccaactttggttccgcttcttaaattttattttcatgaagaagtcaggaaagcagctgtttcagccatgccggagctgttgcgttctgcaaaattagctgtagagaaaggacttgctcagggtcgaaacgagtcttatattaaacagttgtctgactacataataccagctctggtcgaagctttacataaggaacctgatacagaaatctgtgcaaatatgttggatgctttgaatgaatgtgttcagatctctggaccaattttggatgaaggccaggtaagaagcattgtggatgagataaaacaggtgataacagccagttcaagtaggaaaaaggaaagagctgaaagggccaaagctgaagacttcgatgctgaggagggggagttgcttaaagaggaaaatgagcaagaagaagaagtttttgaccaagtcggtgaaattttgggaactttgatcaaaacattcaaagcctctttcttgcctttcttcgatgagctatcatcatatttaatgcctatgtggggcaaggataaaacagcagaagagaggaggattgccatatgtatctttgatgatgttgcagaacagtgccgtgaagcagctttgaagtattatgatacatatcttcctttccttttggaagcatgcaatgatgagaattcggatgtccgacaggcagccgtatatggacttggtgtttgtgcggaatatggcggttctgttttcaaaccacttgttggagaggctctttcaaggctgaatgttgtgataagacacccaaatgctttgcaaccagataatgtaatggcatatgataatgctgtttctgctctggggaaaatatgccagtttcatcgtgacagtattgattcagctcaggttcttcctgcctggttaagctgcttaccaataaaaggtgatctgattgaggccaaagttgttcatgaccaactttgttcaatggttgaaaggtcggatacagagcttttgggtcccaacaatcagtatctctctaaaatagtttcagtatttgcagaggtcctgtttgccggcaaggatcttgcaactgagcaaactgccagccgaatgattaatctgctgagacagctacagcaaacgctaccgccatctaccttggcttcaacatggtcatcactgcagccccagcagcagcttgcattgcaatccatcctctcgtcatagccagctatgtgttgattgagaagagtagagctcgctatcaattgggggaaaactgctttgtccagtccattgcgtcaaatcatatgctggttacccattctttaccataaggtgttccccacattcatttttgcatgatgatgatgtgctgcaatctgtggttggttgcgcggtcgagtgtgaatgtcattgcgagtgaaatgaaacccacagttttctgtagcatgtgtatatttaaaagaaagaaaggttagcaattgtgtttgtgaggttcttgttggtccgtccatgcatgaggtttgagggttgtggctttggcaatttttgttgcagttttggtcgtgtcaaattatatactatgattcttttgttatttctctcaatgattaattatatgaatttgttgttggggtctaaagttacagctttgtgcaagtaatttggttttacatatatccttttcttcattttcatatgtttccaccatttgtgtagcttcttagacga

SEQ ID NO: 8992 - DNA, 4238 bp, Populus trichocarpa
ctaatccccttcccaccattctttctctctcctactttgccctagtcccctcccctccctttcttattatcccctctccctttccccctcctttcctcccaccctctctatctccccacatatacccgtagagagaacacacacacccacacacacaaaaaacactctccctgtccctccctccctccctctacaatccctaaaccccaaaaagcctagccgccacaaccagctccgcagccgcagcaacaaaatctaatcttcggccaccatggacgagtcaactcaactccagcaagcgcaactcgcggcagtccttgggggcgatccttcgcaattcgaaaccctaatctcttcgctcatgtcatcatccaacgaaactcgatctcaagcggagctcatcttcaacctcgccaaacaacacgatccaaactcgctctgtctaaaactcgctcacctccttcagttctctcctcacctcgacgcccgtgctatgtccgctgtcctcctccgtaaactcctcactcgcgatgactcgtacctctggccgcgcctctctccgcaaacccagtcctctctcaaatcgatcctcctcgcctgtctacagcaagagtctgttaaatcgaacaccaagaagttgtgcgacaccgtttctgagcttgcttccgggattttgcccgataatggctggcctgagcttttgccgtttatgtttcagtgtgtgacgtcagattccttcaagttgcaggaatctgcgtttttgatcttcgcacagctgtctcagtatatcggagagagtttgattccctttatcaaggagttgcacggggtttttctgcagtgtttggggtcgagcacgaatttcgatgtcaaaattgcggccttgaatgctgtgattaattttattcagtgtttggataattcgtccgatagagatcgatttcaggatttgttgccgtcgatgataaggactttaacggaggctttaaataatgggaatgaggcgactgctcaggaggcgttggagttgttgattgagttggcggggacggagcccaggtttttgaggaggcagttggtggatgtcgtgggttcaatgttgcaaattgcggaggcggagagtttggaggaaggaactaggcatttggctattgagtttgtgattacattggcggaagctagggagagggcaccagggatgatgaggaagttaccgcagtttatcagtagattgttcgggatactgatgaggatgttgttggatattgaggatgatccggcatggcatagtgcggagaatgaggatgaagatgcgggggaaacaagtaattatagcgtggggcaagagtgtttggataggttggccatttctttgggtgggaatactattgttcctgttgcttcggaacaattgcctgcgtatttggctgctcctgagtggcagaaacatcatgctgctcttattgcattggctcagattgctgaagggtgctctaaggtaatgctaaaaaacctggaacaagtagttacaatggtcctaaattcattttatgacccccatccccgtgtgagatgggcagctattaatgcaattgggcagttgtccacggatttgggtccagatttgcaaaatcaataccatcagagagttttgcctgcattagcagctgccatggatgattttcagaatcctcgtgttcaggcacatgctgcttcggctgtgcttaacttcagtgagaattgtactccagaaattttaacaccgtacctagatggagtagtgagcaaattgcttgttcttctacagaatggaaaacaaatggtgcaagagggagcgttgactgctttggcatcagttgctgattcctctcaggagcacttccaaaaatactatgatgcagtcatgccttacttgaagactatcttggtgaatgcaaatgacaaagctaaccgcatgcttcgtgccaaatccatggagtgcatcagtctagttgggatggcagtggggaaagagaagtttagggatgatgccaagcaggttatggatgtacttctgtcattgcaagtatctcagatggagtcagatgatccaacaacaagttacatgctacaagcatgggccagactttgcaagtgtttaggacaagattttcttccttacatgagtgttgtcatgccacctttgcttcagtctgctcaactcaagcctgatgtaaccattacatctgcggattcagataatgacattgatgattctgatgatgaaagcatggagactatcacccttggtgacaaaagaattgggatcaagactagtgttctggaagaaaaagctactgcttgtaacatgttatgttgctacgctgatgagctgaaggaaggattctttccatggattgatcaggttgccccaaccttggtacctcttcttaaattttattttcatgaagaggttaggaaagcagctgtttcagccatgccagaacttctgcgttctgcaaaattagctatcgagaaagggcttgctcagggtcgcaatgagtcttatgtaaagcagctgtctgactatattattccagccctggttgaagcactgcacaaggaacccgatactgagatctgtgcaagcatgttggatgccttaaatgaatgcttgcagatatctggagtgcttgttgatgaaggtcaagtgcgatctgttgtggatgagataaaactggtcatcactgccagctcaagtcgcaagagagagagagcagagagagccaaagctgaagactttgatgcagaggagggagagttgatcaaggaggaaaatgagcaagaggaggaagttttcgaccaagttggtgaaatcttgggaactctgattaaaacattcaaagcttctttcttgcctttctttgatgagctatcatcctatcttactcccatgtggggcaaggataagactgctgaagagagaaggattgcaatttgcatttttgatgatgttgcggagcaatgtcgcgaggcggctcttaaatattatgatacatatcttcctttcttactggaggcttgcaatgatgacaacccggatgttcggcaggcagccgtatacgggcttggtgtttgtgcagaagttggtggttctgtgtttaaacatctagttggagaggctttatcaagacttaatgttgtaatacggcatcctaatgctaagcaaccagacaatgtcatggcatatgataatgctgtttcagctttagggaaaatttgccagtttcatcgtgacagtatagattcagctcaggttgttcctgcatggttaaactgtttgccaataacaggagacttgattgaagcaaaagctgttcatgaacaactttgttcaatggtggagaggtcagatagagaacttttgggacccaacaatcagtatcttcctaagattgtttcagtatttgctgaggttctatgtggtaaggatctagcaaccgaacaaactctaagccgaatggttaatcttctgagacaactacaacaaaccttaccaccagctacctgggcctcgaccttgtcggtgttgcatccacaacaacagatggcattgcaatccatcctctcatcataatatcttggctggcgaacccaactggctatggtgaagatgcaatctccagtttgttgttaaaatatatttataacccattctttggatgagatgtttcccatcgtttgctttctgcaaggcgttctacaacaacctggcgtcggtttgaatgagtgtgagagtcgttgccattgaaaatgaatccgtttttgtagaatgtgtatattcatttataagtgttatttatactccagattgagtggcgggggggaaagaaaaaggaagtataggtatcgtttgtccctttttgttctttttttattttttggtggtggtttaaggtttgagggttgtcagtgaagcaattcttgtcgcagttttgtccccattgtgttgctatttttgggttcaatacaaaaaaacatcttgattgtgatcatgtatgcactgaaatcttgaattggttattctttcattataattgcaattttgattccgataagtagctgatataaataaatcgattatgctattgatccctgttaacctggcaatctaccatctgcaggaggattgctatgaacggattttaagtttggattttattatattagcgaacgaggatatagtttgttttcaatct

SEQ ID NO: 8993 - DNA, 4162 bp, Panax ginseng
cgcagagtacatggggacagctaatctcccattccctagtgtctgttgccctaatttgccccacgatcaccctacttcaccagccaaacgccctcaaaaatctcaaaaaaccacctcattccctctttaaacattagagatagaatagtgttgcgaatttgctgtgaaacataatatatatacacacacatacatatagagagaggaaaagggaaaacgccacccttattaaccaaaagaccctaattcgccgccgcgatggattcttctcagatgcagcaagctcagctagcggcgattttgggacctgatcccgccccatttgaaaccctaatttctcacctgatggcctcttccaatgagcaaagatcgcaagccgaagtcattttcaatctctgcaagcaaaccgatcccaactcgctcgttctcaaactcgctcagctcctccagttctcccctcatgttgaagcccgagccatgtccgcaattctactcagaaagcagttgactcgtgatgactcgtacatatggccccggttgtctccttcaactcagtcatcgctcaaatcgatcttccttgcttgcgttcaatgtgaagaagctaagactataattaagaagctttgcgacactgtttcggagctcgcctccgggattttaccggacaatggatggccggagctattgcctttcatgtttcaatgcgtatcgtccgattcgcataagcttcaggaatctgcgtttttgatatttgcccaattgtctcagtacataggtgaaacactaattccccacataaaacacctgcatactgtgtttttacagtgtttgactacttcgtcgagctcggatgtgaggattgcggcgcttagtgctgttattaatttcattcagtgcttgtctagctccagcgaccgtgatcgctttcaggatttgttgcctgcgatgatgaggactttgacagaagcattgaattgtgggcaggaagccacagctcaggaagcattagaattaatgattgaattggctgggacagagccaaggtttttgaggaggcaattagtggaagtagtggggtccatgttgcaaattgcagaggctgaaactttagaagagggtacaagacatctggccattgagtttgtgattactcttgcagaggccagagagagggctcctggaatgatgaggaaattgccccagtttattagcaggttatttgcaattttgatgaagatgctgttagatattgaagatgatccggcgtggcatcttgcggatactgaggatgaggatgccggagagactagtaattacagtgttggacaggaatgtttggatcggttggccattgctttgggagggaatactattgttcctgttgcatcggagcagttgccggcttatttggctgccccagagtggcaaaaccatcatgctgcattaattgcacttgcacagattgctgaaggatgctcgaaggtgatgataaaaaatttggagcaagtggtaacaatggttcttaattcatttcaagacccctatgctcgagtaagatgggctgcaattaatgcaattgggcagttgtctacagatttgggaccggatttgcaagtacagtaccatcaaagggtgctgccagcactagctgctgccatggatgacttccagagtccgcgtgtgcaggcgcatgctgcttcggccgtgctcaatttcagtgagaactgtacaccagatatattaacgccttacttagatggaatagtgagcaagctgcttgtgcttctagagaatggcaaacaaatggtgcaggaaggtgccttgactgctctggcctctgtagctgactcatctcaggagcattttcaaaagtactatgatgcagttatgccctacttgaaagctatattggttaatgcaaatgacaaatctaaccgcatgcttcgtgcaaaagccatggaatgcattagtttggttggaatggctgttggaaaggagaagttcagggatgacgcgaagcaggtaatggaagtgcttatgtcattgcaaggatctcaaatggagaccgatgatcctactacaagctacatgctacaagcatgggcaagactttgcaagtgtttggggcaaggatttccttccctatatgagtgtagtcatgcctcccttgcttcagtctgctcaactgaaacctgatgtgatcattacatctgcagattcagataatgaaattgatgaatctgatgatgacagcatggagaccatcactctaggcgataaaagaattgggatcaagactagcgtcctagaagagaaagctacagcttgtaacatgctttgttgctatgctgatgagttgaaggagggtttctatccatggattgatcaggttgccccactttggttccgcttcttaaatttatttcatgaagaagtcaggaaagcagctgttcagccatgccggagctgttgcgttctgcaaattagctgtagagaaaggacttgctcagggtcgaaacgagtcttatattaaacagttgtctgactacataataccagctctggtcgaagctttacataaggaacctgatacagaaatctgtgcaaatatgttggatgccttgaatgaatgtgttcagatctctggaccaattttggatgaaggccaggtaagaagcattgtggatgagataaaacaggtgataacagccagttcaagtaggaaaaaggaaagagctgaaagggccaaagctgaagacttcgatgctgaggagggggagttgcttaaagaggaaaatgagcaagaagaagaagtttttgaccaagtcggtgaaattttgggaactttgatcaaaacattcaaagcctctttcttgcctttcttcgatgagctatcatcatatttaatgcatatgtggggcaaggataaaacagcagaagggaggagatgccatatgtatctttgatgatgttgcagaacagtgccgtgaagcagctttgaagtattatgatacatatcttcctttccttttggaagcatgcaatgatgagaattcggatgtccgacaggcagccgtatatggacttggtgtttgtgcggaatatggcggttctgttttcaaaccacttgttggagaggctctttcaaggctgaatgttgtgataagacacccaaatgctttgcaaccagataatgtaatggcatatgataatgctgtttctgctctggggaaaatatgccagtttcatcgtgacagtattgattcagctcaggttcttcctgcctggttaagctgcttaccaataaaaggtgatctgattgaggccaaagttgttcatgaccaactttgttcaatggttgaaaggtcggatacagagcttttgggtcccaacaatcagtatctctctaaaatagtttcagtatttgcagaggtcctgtttgccggcaaggatcttgcaactgagcaaactgccagccgaatgattaatctgctgagacagctacagcaaacgctaccgccatctaccttggcttcaacatggtcatcactgcagccccagcagcagcttgcattgcaatccatcctctcgtcatagccagctatgtgttgattgagaagagtagaggtcgctatcaattgggggaaaactgctttgtccagtccattgcgtcaaatcatatgctggttacccattctttaccataaggtgttccccacattcatttttgcatgatgatgatgttgtgctgcaacctgtggttggttgcgcggtcgagtgtgaatgtcattgcgagtgaaatgaaacccacagttttttgtagcatgtgtatatttaaaagaaagaaaggtcagcaattgtgtttgtgaggttcttgttggtccgtccatgcatgaggtttgagggttgtggctttggcaatttttgttgctagttttggtcgtgtcaaattatatactatgattcttttgttacttctctcaatgattaattatatgaatttgttgttggggtctaaagttacagctttgtgcaagtaatttggttttacatatatccttatcttcttcattttcatatgtttccaccatttgtgtagcttcttagacgatgggcttttttctttggtctcattatcttgattcttgttccttttgtagtc

SEQ ID NO: 8994 - DNA, 4001 bp, Lactuca sativa
ctttttacccctactaccactactccatctatgcccctttgccctaattagtcttccgcccaaatccaaacacgcaccccattttctccactccgtcatcgtcaaagccaccggtaatcgcatcggcaccatcaatcactaccggcgattacttctgcggcaatggatcctcaggttcagcaagcacaactggcggcgatactgggggccgatccggcgccgttcgaaaccctaatatctcacctgatgtcttcatcgaacgagcaacgatcgcaagcagaacttatattcaatctatgcaaacaaactgatccgaactcgctgtttctcaaactcgggcatctgctacaactatctcctcacatggaagctcgtgccatgtcagcaattctgttacggaagcagttgactcaggatgattcattggtatggaatcggttatctccgacgactcaggtttcacttaaatctattcttttggcttgtgtgcaacaagaagaagcgaagacgataatgaagaagttatgcgatacgatctcggaattggcttcgagtatcctgcctgataacggttggccggaactgttgccgtttatgtttcagtgcgtttcttccgattctcccaagcttcaagaatctgcgttcttgatatttgcgcagttgtcacaatacattggggaaactttaattccacacataaagcatcttcatggagtgtttttgcagtgcctgactacgtcggggagttcagacgtgaggattgctgctttgagtgctgtaattaattttattcagtgtttgtcgagttccggtgatagagatcggttccaggatttgcttccagcgatgatgacgacgttgactgaagctttgaatggtggacaagaggctactgctcaagaggcattggaattgttaattgagttggcagggactgagcctaggttcttgaggaggcagttagtggaggtggtggggtctatgttgcagatagctgaggcagagacactagaagagggcacacgacacctagccattgagtttgtgatcacgctagcagaggccagagagagggcacctggtatgatgaggaagttgccacagtttatcagcaggttgttctgcattttgttgcagatgctgttggatgtcgaggatgaacctgcatggcatactgctgaaaatgaggacgaagatgcaggagagtcaagtaattacagtgttgggcaggagtgcttggatcggttggctattgctctaggtgggaataccattgtccctgttgcatcagagcagttgccggcttacttggctgcccctgagtggcagaaacatcatgctgcactcatcgctcttgcacagatagctgagggatgctcaaaggtaatgatcaagaatttggaacaagtggtgtccatggttttaaattcattccaagatcctcacccacgtgtgagatgggctgcaattaatgcaatcgggcaattggccacagatttaggcccagacttgcaagttcaataccatcaacgagtgctgccagctcttgctaatgccatggatgatttcaataatccaagagttcaggcacatgctgcttcagcagtgttaaatttcagtgagaactgtactcctgatatcttgacgccttacctagatggaatagtgagcaaactgcttgtgttgttacagaatggtaaacaaatggtacaagaaggggccttgactgctctagcatcagttgctgattcatcacaggaacacttccaaaagtactatgatgcagttatgccttacttgaaagctatcttagtgaatgcaaatgataaagctaatcgcatgcttagagccaaagccatggaatgcattagtttggttggaatggctgttggaaaggaaaaattcagagatgatgctaaacaggtgatggaggtgcttatgtccttacaaggatctcaaatggagactgatgatcccaccaccagttacatgcttcaagcgtgggccaggctatgcaagtgcttagggcaggatttccttccttacatgagtgttgttatgcctcctttacttctatctgctcaactcaaacctgatgtcatcattacctcagcagcttcagataatgaacttgatgaatcagatgatgaaagtatggagacaatcacacttggtgataaaagaatagggatcaagacaagtgttctagaagaaaaagctacagcttgcaacatgttgtgttgttatgcagatgagttgaaggagggtttctatccatggattgaccaggttgcaccaaccttggtcccacttctcaaattttactttcatgaagaagttaggaaagctgctgtttcagccatgcctgaattattgaggtctgcaaagttagcaatagagaaagggcttgctcaaggtcgtaatgaatcttatataaagcagctctctgactacatagttcctgctttggttgaagctttacataaggaacctgatacggaaatctgtgcaagtatgctggatgctttaaacgagtgtatacaggtatctggaacacttctagatgaaaaccaggtgagaagcattgtggatgagataaaacaggtgatcacagccagctcaagcagaaaaacagaaagagcagagagggccaaagctgaagattttgatgctgaggaaggagaattgcttaaagaggaaaatgagcaagaagaagaagtctttgatcaaattggtgaaatcttgggaactttgataaaaacatttaaagcctccttcttgcctttctttgatgagatgtcatcatatttgatgcctatgtggggcaaggacaaaacagctgaagaaagaaggattgctatttgcatctttgatgatgtggctgaacagtgtcgtgaagcagctctaaagtattacgatacatatcttcctttccttctagaagcttgcaatgacgagagtccagatgtccgccaggcagctgtatatggacttggagtgtgtgcagagtatggtggatctgttataaagccacttgttggagaggctctttcgaggctaaatgttgtaatcagacaccctaatgctgttcatcccgagaatgtgatggcatatgataatgcggtttctgctttggggaaaatttgccattttcatcgcgatagtatcgactcagctcaggttattcctgcatggttaagctgtttgccaatcaaaggagatctcatcgaagccaaagttgttcacgagctgctatgttcaatggttgaaaggtcagacgcggtacttctaggcccaaacaaccagtatctccctaaaattgtttctgtatttgctgagattatttgtggagggaaggatcttgcaacagagcaaactataaaccggatagtgaacttgctgagacagcttcagcagacactgccacctgcgacatttgcgtcgacatggtcaagcttgcagccacagcagcaacttgcattacaatcagtcctcacatcatagcaaagcaaagcaaagcaatacaaaacgactgaatagttaagttgttcttgttcttgtggtttggtttggttagaaaggaaatgtgtttgttgcccattctttgatgctgacatataaagatagacgatgatgatgatgatgtttctggcatattcattttttcagcgtgacatatgtcatgcaatgagaccctaggtgggttggttggtttggttgagtgtggagagcgacagagatgatgggaacaagagttggatatcttgttttgtttttttgttttttttggttacaagttgttgtgcatattgtacaagtattgttgtgaggtatttgttgcttaaacaaagcaatgactcttactcgagttttggtcgcttttaatcacttttgatgtttgtggcataaatttatccgcttttttttttttcaacttctttttattgctaaactcgtttggtaagatggttatcaatggaaaataaaagttataattttgc

SEQ ID NO: 8995 - DNA, 3979 bp, Solanum lycopersicum
gtaagagaaaaccccaatttcacaaaaacacagccaccttctctgcttttctctcctgtgcagccagccatcttctcttctctactctacagccatatccacacatccgcctctctttactcattcgccatggctgccgagcaagctcaactggctgctatccttggacccgattcagcaccattcgaaaccctaatttcacatctcatgtctgcttccaacgagcaacgatctcaagccgagtcaatcttcaatctcatcaagcaaaacgatcctaattcactcgctctcaagcttgctaatcttctctcctcttcacctcaccacgaagcccgtgccatgtccacaatccttctcagaaagttgcttaccagagatgactctttcatctggcctcgcctcaccgaatctactcagtcaggtatcaaatcagtccttctcagatgtattcaacacgaagaatcaaaatccatcatcaagaagctttgcgacactatttccgaacttgcttcttcaattctccctgaaaacaattggcctgagttgttaccctttatgtttcagtgtgttacttcagacgtacctaaattacaggaatctgccttcttgatctttgctttattagctcaatatgttggggagatgttagttccttacattaaggacttgcatacagtgtttatgcagacattgaataactcgcctaatcctgatgtcaggattgcgggtttaagtgctgtcattaattttattcagtgtttatcaagctcaaatgacagggataggtttcaggatctattgcctgcaatgatgaagaccttgactgaggctttgaatagtggacaagaggcaactgcacaagaagctttggagttgttgattgaattggcgggtactgagcctagatttttgaggaggcagcttgttgatgtggtgggtgcaatgttgcaaatagccgaggctgagagtttagaagaggggacaagacatttggctattgaatttgttattaccttggctgaggctagggaaagggctcctggaatgatgaggaaattgccgcagtttatcagtaggctgtttgctattttgatgaaaatgttgctggatatcgatgatgaacctgtctggcatagtgctgaagttgagcatgaggatgcgggggaaacaagtaactacagtgttggtcaggagtgtttggatcgtttgtccattgcgttgggcggcagtacaattgttcctgttgcatcagagcagttgcctccttacttggctgctccagaatggcaaaagcaccatgctgcgctcattgcgcttgctcagattgctgaaggttgcacaaaggtaatgattaagaatttggagcaagtcgtgaacatggttttgagctgtttccaagatcctcatcctcgagtgagatgggcagctattaacgcaattggccagttgtctactgacttggggcctgatttgcaagtacagtaccacagcagagtattgccagctttggcaacagctatggatgattttcaaaatccacgagtgcaggcacatgctgcgtcagctgtcctcaacttcagtgagaactgcacaccagaaattttgacaccttacttggatggaatagttagcaaactacttgttcttctacagaacggaaaacaaatggtgcaagaaggagcattaactgctttggcttcagtggctgattcatcacaggagcacttccagaagtactatgacgctgtaatgccatatttgaaaaccatactggtaaatgcgaatgataaatctaatcgcatgcttcgagccaaagccatggagtgcataagcttggttggaatggctgttggaaaagataaattcagagatgatgctaagcaggttatggaagtgcttatgtcactacaaggatcgcaaatggagacagatgaccctactactagttatatgttgcaggcatgggccaggctttgcaagtgcttgggacaggatttcctgccttacatgagtgttgtcatgcctcctttacttctgtctgctcaactaaagcctgatgtgaccatatcatccgcagattcagacaatgaacttgatgactcagatgatgacagcatggagaccataactcttggagataaaaggataggcatcaaaacaagcgtcttagaagagaaggctacagcttgtaatatgctatgctgctatgctgatgaactcaaggaaggtttctatccatggattgatcaggttgctcctacattagttccacttctcaaattctatttccacgaagaagtcaggaaagctgccgtgtctgcaatgccagagctgttacgttctgctaaactggctgtagagaaagggattgctcagggccgaaatgagacctatgtcaagcaattatcagactacatcattccagctctggttgaagcattgcataaggagcctgatacagagatctgtgcaagtatgttggatgcattgaatgagtgtgttcagatctctggaccactcctggatgaaggtcaggtccgaagcattgtggatgagataaaacaggttatcacagccagttcaagtagaaaacgagaacgtgcagagagggcaaaagctgaagacttcgatgcagaggaaagtgagttgctcaaggaggaaaatgagcaagaagaagaagtttttgaccaagttggtgaaatattgggcacattgattaagactttcaaggcagttttcttgccattctttgatgaactgtcatcttatctaatgcctatgtggggcaaggataaaacagccgaagaaaggagaattgcaatttgtatttttgatgacattgctgagcagtgccgtgaagcagctcttaagtattatgacacatatcttcctttccttttggaagcatgcaatgacgagagcccggatgtccggcaggctgctgtttatggtcttggggtatgtgcagaatatgggggttctgttatcaaacctcttgttggagaggctctttcaaggctgaacgtagttatagggcatcccaatgctcttcaacccgagaatgttatggcatatgataatgctgtttcagcactggggaagatatgtcagtttcatcgcgacagtattgactcagcccaggttgttcctgcttggttgaattgcctgcctataaaaggtgacctgatagaggccaaggttgttcatgatcaactctgttcaatggttgaaaggtcagatgtagaacttctgggtcctaacaatcagaaccttccaaaaattgtatcagtttttgctgaggttctatgtactggtaaggaccttgctactgaacaaacagccagtaggatgattaatctgctgaggcagcttcagcaaacattaccaccagccaccctggcctcaacatggtcttccctgcagcctcagcagcagatagcattgcaatccattctatcatcgtagtgttttggatcatgacaaaatcgaatgcaatggaagttgctaggctgaagcttcttgggtttcaaatatttgattatcaattctttcttgcaaacattattattcatttgggcttttgaggtcatgcatcagcctgttgttactttggtcaaaagagtgtgagcaaaggcctggaaaccttttcctctttttgtagagtgtgtatattaaaagtgttgcattttgagtcccccttcagtaaggatagaattgttggtgatcaggttttttttttttttttggcatcaaatgagttttaagctcaagggtcgtcagggagacactcttgtcacagttttggtccagtcatattggagttctttacattgtgggatggttcaaggattaaattataaatggtgattatttgttgctttgattgtgatattttcttgccttgggtcttggaattttatttgggtattagctgctgaatttgtacgtgaaatacctctgattctaaatttgatttttg

SEQ ID NO: 8996 - DNA, 7051 bp, Solanum lycopersicum
acagccaccttctctgctcttctctcctgtgcagccagccatcttctcttctctactctacagccatatccacacatccgcctctctttacttattcgccatggctgccgagcaagctcaactggctgcaatccttggacccgattcagcaccattcgaaaccctaatttcacatctcatgtctgcttccaacgagcaacgatctcaagccgagtcaatcttcaatctcatcaagcaaaacgatcctaattcactcgctctcaagcttgctaatcttctctcctcttcacctcaccacgaagcccgtgccatgtccacaatccttctcagaaagttgcttaccagagatgactctttcatctggcctcgcctcaccgaatctactcagtcaggtatcaaatcagtccttctcagatgtattcaacacgaagaatcaaaatccatcatcaagaagctttgcgacactatttccgaacttgcttcttcaattctccctgaaaacaattggcctgagttgttaccctttatgtttcagtgtgttacttcagacgtacctaaattacaggaatctgccttcttgatctttgctttattagctcaatatgttggggagatgttagttccttacattaaggacttgcatacagtgtttatgcagacattgaataactcgcctaatcctgatgtcaggattgcgggcttaagtgctgtcattaattttattcagtgtttatcaagctcaaatgacagggataggtttcaggatctattgcctgcaatgatgaagaccttgactgaggctttgaatagtggacaagaggcaactgcacaagaagctttggagttgttgattgaattggcgggtactgagcctagatttttgaggaggcagcttgttgatgtggtgggtgcaatgttgcaaatagccgaggctgagagtttagaagaggggacaagacatttggctattgaatttgttattaccttggctgaggctagggaaagggctcctggaatgatgaggaaattgccacagtttatcagtaggctgtttgctattttgatgaaaatgttgctggatatcgatgatgaacctgtctggcatagtgctgaagttgagcatgaggatgcgggggaaacaagtaactacagtgttggtcaggaatgtttggatcgtttgtccattgcgttgggcggcagtacaattgttcctgttgcatcagagcagttgcctccttacttggctgctccagaatggcaaaagcaccatgctgcgctcattgcgcttgctcagattgctgaaggttgcacaaaggtaatgattaagaatttggagcaagtcgtgaacatggttttgagctgtttccaagatcctcatcctcgagtgagatgggcagctattaacgcaattggccagttgtctactgacttggggcctgatttgcaagtacaataccacagcagagtattgccagctttggcaacagctatggatgattttcaaaatccacgagtgcaggcacatgctgcgtcagctgtcctcaacttcagtgagaactgcacaccagaaattttgacaccttacttggatggaatagttagcaaactacttgttcttctacagaacggaaaacaaatggtgcaagaaggagcattaactgctttggcttcagtggctgattcatcacaggagcacttccagaagtactatgacgctgtaatgccatatttgaaaaccatactggtaaatgcgaatgataaatctaatcgcatgcttcgagccaaagccatggagtgcataagcttggttgggatggctgttggaaaagataaattcagagatgatgctaagcaggttatggaagtgcttatgtcactacaaggatcgcaaatggagacagatgaccctactactagttatatgttgcaggcatgggccaggctttgcaagtgcttgggacaggatttcctgccttacatgagtgttgtcatgcctcctttacttctgtctgctcaactaaagcctgatgtgaccatatcatccgcagattcagacaatgaacttgatgactcagatgatgacagcatggagaccataactcttggagataaaaggataggcatcaaaacaagcgtcttagaagagaaggctaccgcttgtaatatgctatgctgctatgctgatgaactcaaggaaggtttctatccatggattgatcaggttgctcctacattagttccacttctcaaattctatttccacgaagaagtcaggaaagctgccgtgtctgcaatgccagagctgttacgttctgctaaactggctgtagagaaagggattgcacagggccgaaatgagacctatgtcaagcaattatcagactacatcattccagctctggttgaagcattgcataaggagcctgatacagagatctgtgcaagtatgttggatgcattgaatgagtgtgttcagatctctggaccactcctggatgaaggtcaggtccgaagcattgtggatgagataaaacaggttatcacagccagttcaagtagaaaacgagaacgtgcagagagggcaaaagctgaggacttcgatgcagaggaaagtgagttgctcaaggaggaaaatgagcaagaagaagaagtttttgaccaagttggtgaaatattgggcacattgattaagactttcaaggcagttttcttgccattctttgatgaactgtcatcttatctaatgcctatgtggggcaaggataaaacagccgaagaaaggagaattgcaatttgtatttttgatgacattgctgagcagtgccgtgaagcagctcttaagtattatgacacatatcttcctttccttttggaagcatgcaatgacgagagcccggatgtccggcaggctgctgtttatggtcttggggtatgtgcagaatatgggggttctgttatcaaacctcttgttggagaggctctttcaaggctgaacgtagttatagggcatcccaatgctcttcaacccgagaatgttatggcatatgataatgctgtttcagcactggggaagatatgtcagtttcatcgcgacagtattgactcagcccaggttgttcctgcttggttgaattgcctgcctataaaaggtgacctgatagaggccaaggttgttcatgatcaactctgttcaatggttgaaaggtcagatgtagaacttctgggtcctaacaatcagaaccttccaaaaattgtatcagtttttgctgaggttctatgtactggtaaggaccttgctactgaacaaacagccagtaggatgattaatctgctgaggcagcttcagcaaacattaccaccagccaccctggcctcaacatggtcttccctgcagcctcagcagcagatagcattgcaatccattctatcatcgtagtgttttggatcatgacaaaatcgaatgcaatggaagtttgctaggctgaagcttcttgggtttcaactatttgattatcaattctttcttgcaaacattattattcatttgggcttttgaggtcatgcatcagcctgttgttactttggtcaaaagagtgtgagcgaaggcttggaaaccttttcctctttttgtagagtgtgtatattaaaagggttgcattttgagtcccccttcagtaaggatagaattgttggtgatcaggttttttttttttttttggcatcaaatgagttttaagctcaagggtcgtcagggagacactcttgtcacagttttggtccagtcatattggagttctttacattgtgggatggttcaaggattaaattataaatggtgattatttgttgctttgattgtgatattttcttgccttgggtcttggaattttatttgggtattagctgctgaatttgtacgtgaaatacctctgattctaaatttgatttttgcttttggaacaaccagcttaagtagttctggtgataggggtaaaaggggaacaagtccaccttatatctctcgtaacttggtcatggatttctttttagttacccgaccggaagctcaaatttacttgaagccttactatttattaccccttgctcattaatgttgttataagatgcaattaagaggttaatatttggaaattataaagaatttagaaataaataatatggtaggagaaattattgttttataataataaaaagaaaaaggaaaaagagaatagatttcttgatctatgtatatataataatataatgtgcattcgtaatttttaattataatttttagttgtgcatccagggcaatatgacactattacctacattcatatttatttttgttgtcttgaccttttcttttctttatttaattattgatttttatttttaatatctcaaaatgatggcttaggagttgaggttgagagcgaggaatatattgatgctaaaacatccgatacggaaagaaagacgaatgaaaaatagtggctctttagtgaaattgtttgaagatttttaacaaaaataaattctgcaagaagaaagggtaagacgtatatagtttgagagtaaaaatgaaaaatagatgggcaataacttttgggcttttaaaaatgaaaaatagatgggtaattaagaaataattttaagtttttttaatatatcatataatataaatttttaaaaaaaagatgtcaaaattttgagaataaaaaggtaaatgacattcttaaactaatcatttttattacatataatatgcatttagaaatatcttttttaatatattactatataaaaaaggaaaataacaggcatcataccgtcaaacagtcttgtgctgcctgcttattccccttggttgcctcattttcctttagctgttatttgttctttcaattgaaaaaacgtgggatccacttactttaattgtggaacttgccttttaggattcttcataagatggggcccatttctgtggagcggattcttcataagatggggcccatttctgtgggctccattcatatttctttattcttatttacttaattttaattggaaaaataatgctttaagtaaatttatattatttaattactcatcataattatagttagttataattatcactcgcgactaacattattcattaattaagtggattgacttcgagtttatataattaactatattagtatatgtataattcgcctgaatatacaaatacaaatatataaatatgcaattatctaactgatatacatatacaattcacctctattccactctttttcctctctcctccctcttccaatgtcgttcgcctctctcctccctctcccaatctctcttgtcatattatacaaatgcatatatacaaaatacaattatctaaacgatatacatatacggttcatctcactccctctctttttcctctctcgcttgccctctctcctccctctctcaatctctcttgagtctctcctctctctcccaatctcgcttgccatatgtataatttacaattatcttgctgatatacatatacaattcacctctctccctctcgttaccttctctccctcacctctcctctttctcctagtctctctcgcatctcccctccctataacatgtagctacaaattgtaattatcaaactatagctattgagaataattaagcaattttgagtggctatatatgaaagtttttcatcttaattttacatctcttttaaatcaatatttaagacatatcttccatcataatctccatattaactgatatatagtcttaagttttgaaaaataacctaagaaataagtaattaatgttgtagataaatgatgggaaaaaacttgtgcttcttcaaaattagtatttattttttgtcatttaataatttgcacatttattatttcatttatttatttaaaaaatcaagacaggtttattattttcgttcaatattatttttatctttatattactgtgtaaagtaatagtaataaaaattaaaaatataattaataattttagattaataaaaatttaaaattaataacatttgtgaaatttttttgattaactacaaaaggatttaaaaataattagtgaactaacttaataactaattatatttaatatatataaaaatattattaaaaattatgattaaaaagactacataaatatttaactcataatattgagcccgtgcacgatacgagcaacccttaacccctttactagtatatataaatatatatatatttccccttacttagaagacacagttgagagggacgaacacagcaaaacaaatttgtaccaaaagcaagtttaattgtacacctttattttcataaaatgtatgtattgtaatattttaacaagtgtaactttctttctctgcataatacatctgtactatatttacccatctaaaccctattactgaagaagaatcgaccatttatttctctcaaagccggtgaaagagaattaaaaatttcttcctattcagatttgttaatgcttttttggtccaaacatatttcaatccagatgaacactggcaagcccttgaagttgctcatcgaatctcatttggatgtggacatttgacgtagaaatgggaaaagggaataaggagttatcttcatccagtgatatttgttggattgtataaagttcttgccctttttcatcttgacaaaccttgtttcatggtaagaattgtatatcctggttccctacctaatgtatcaaataatggtagagaagcagcttcaaaggcaaggtatgattatacatttaatggcttatgtgagcaattttttttgacatgttcgaaactaccttattctgcttctttttgtaatttaattctgtcacttttcttctcagatgaactttgttttaacaacatgaacacgataattatttgtagatgtctacatctttatgagtttgacatttgttgaagaacttttctttcagattatgaaattttagtatatattttgac

SEQ ID NO: 8997 - DNA, 3600 bp, Vinca minor
aagacagagagcgccacaactctcctctttctttgttatctcgttttgttgataaaccctaactcgtcgagagagatagagtcagttatggattccgagtcgacccagttgcagcaagctcaactcgtggcgattctagtgccagaccttgctccattcgagaccttaatctctcatctcatgtccaccatcaacgagcaaagatctcaggctgagtcaatctttaatcttataaagcaaaccgatcccaactcgctcgctctgaaactcgctcagcttttatcgtcttctcctcatgtggaagcgcgtgctatgtccactatccttctccgaaagcaactcacccgcgatgactcgtatatctggcctcgactcagtgtttcaactcaatccaccatcaaatctatactcttatcgtgcatccagaatgaagaatccaagagtataatcaagaagctttgtgatacaatctctgaattggcttcctcaattttgccggagaacaattggccagaaattctgccgttcatgttccaatgtgttacttccgaatctcataagttacaggagtcggcgtttttgattttctcgcaacttgcgcagtacataggtgagactcttaccccattcatcaaggatttgcatgctgttttcttacaggtgctgaataattcgccaaattcctatgtcaaaatcgcggccttgagcgctgttatcaattttattcagtgcttgaatagccctagcgatcgggataggtttcaggatttacttcctgctatgatgaagacgttgaccgaggccttgaactgtggtcaggaggcgacagcacaggaggccttggagttgttgattgagttggctgggactgagcctaggtttttgaggaggcaattggtggatgtggtgggttcaatgttacagattgccgaggccgatggtctggaggaaggcactagacatttggctattgaattcgtgattactttggccgaggcaagagagagggctcctggaatgatgaggaagttgccccagttcataagtaggttgttcgctattctgatgactatgttgttggatgtcgaggatgacccggcttggcatagtgctgagcctgaagatgaagatgctggtgagaccagcaactatagtgttggccaggagtgtttggataggctgtctattgctttgggaggaaacaccattgttcctgttgcttcggagcagttgcctgcctacttggcagcacccgagtggcagaagcatcatgccgcattgattgcactagctcagattgctgagggctgctcaaaggttatgattatgaatttagagcaagtgttgagtatgattttgaattcctttcaagaccctcacccacgtgtaaggtgggcagcaattaatgcaattgggcaattatctaccgatttgggaccggatttgcaagttcaatatcacaatcgcgtattgccagcactaggtcattctatggatgactttcagaaccccagagttcaggcacatgctgcttcagcagtgctcaacttcagtgagaattgcaccccagaaattttaacaccttacttggatggagtcgttagcaagctgcttgtacttctgcagaatggcaagcaaatggtgcaggaaggagccttaactgctttagcttcagttgctgattcctctcaggagcacttccaaaaatactatgatgcagtcatgccttacttgaaaactatcttggtgaatgcaactgacaagtcaaaccgcatgcttcgtgccaaagctatggaatgtattagcttggttggaatggctgttggaaaagaaagtttagggaagacgcaaagcaggttatggaggtgctcatgtcacttcaaggatcacaattggaagccgatgatcccaccaccagttacatgctgcaggcatgggccagactctgcaaatgcttgggacaagattttcttccttacatgaatgtagtcatgcctcccttgctccagtctgctcagcttaagcctgacgtgactataacatctgctgattcggataatgaaattgatgaatcagatgatgaaagtatggagatgattacactcggtgataaaaggataggaattaagactagtgttctggaggagaaagctacagcttgtaacatgctatgttgttatgctgatgagctgaaagaaggtttcttcccatggattgatcaggttgctccaactttggttccactcctgaaattttacttccatgaagaagttaggaaagctgccgtttcagccatgcctgagctgttgcgttctgcaaaattggccattgagaaagggattgctcaagctcaaggccgtaatgagacgtatgtcaagcagttgagtgacttcataataccagctttggtggaagccttacacaaggagcctgatacagaaatatgtgcagctatgttggatgcgctgaatgaatgtcttcagatctctgggtcccttctggatgaaaaccaggtacgaagcattgtggatgagataaaacaggttattacagcaagctcaagtagaaaaagtgaacgagcttatagagctaaagccgaggacttcgacgcagaggaaggggaattgctcagagaggaaaatgagcaagaagaggaagtctttgaccaggttggtgaaatcttgggaacactgattaagacattcaaggctgctttcttgcccttctttgatgagctgtcatcatatttaatgcctatgtggggaaaagacaaaactcctgaagagagaagaatagctatttgcatctttgatgatgttgcggagcaatgtcgtgaaaaagctctcaagtattacgacacatatcttcctttccttttggaagcttgcaatgatgagagtccagatgtccgacaggctgccgtttatggacttggcgtatgtgctgaatttggtggctctgtttttaaaccacttgttggagaggccctttcaaggttaaatatcgttatacagcatcccaatgctctgcagcctgataatgtgatggcatatgacaatgctgtgtctgcacttgggaagatatgtcagtttcatcgtgacagtatcgactcagcacaggttgttcctgcgtggctgaactgtttgccaataaaaggtgatctgattgaagccaaagcagttcatgaccagctctgttcgatggttgaaaggtcggatagggagctattgggtcccaacaatcaatatctgcctaaaattgtctctgtatttgccgaggttctttgtgccggcaaggaccttgctacagagcaaactgcgagtagaatggtaaccttgttgcggcagcttcaacagacactaccacctgctgccctggcatcaacgtggtcatctttgcagcctcagcagcagcttactttgcaatccatcctatcatgatatagccaattgaattaatgtttgtgatttggttgggggttaccttgtgtctgtcatatttttaccaaattctttctcgagttattcccattgttcattttgctcttgaaggttatgcatcaacctcatcttggttgtgtggtggtgagtgtgaagatat

SEQ ID NO: 8998 - DNA, 3996 bp, Populus trichocarpa
taagagaggaaaaaaaaaaaaaacaaatctctctctctctcgctttctcactccctctaatccctaaaccccccaaaagaaacctagccacctccaccaccaccaccacaaaccctaattcttcaccaccatggacgagtcaactcaattccagcaatctcaactcgctgccatcctcgccggcgatccttctcaattcgaaatcttaatctcttcccttatgtcttcctctaatgaaacccgatctcaagccgagcttctgttcaacctcgccaaacaacacgatcctaactcactctctctcaaactcgctcaactccttcaattctctcctcaccttgatgctcgtgccatgtcagccgtcctcctccgtaaactcctcactcgagacgactcctacctctggccgcgcctctcgttacaaactcagtcctctctcaaatcgatcctgcttgcctgtctccagcaggaatctgttaaatcgatcaccaagaagttgtgcgacaccgtttccgagcttgcttccgggattttgcctgataatggatggccagagcttttgccgtttatgtttcagtgtgtgacgtcagattctgttaagttgcaggaatctgcttttttgattttcgcacagctgtcgcagtatattggagagagtttggttccctatatcaaggagctgcacggggtttttctacagtgtttgggatccagcacgaacttcgatgtgaaaatcgcggctttgaatgctgtgactaactttatccagtgtttgaataatacgtctgagagggaccggtttcaggatttgttgccgtcgatgattaggactttaacggaggcgttgaataatgggaatgaggcgacagcacaggaggcgttggagttgttgattgaattggcaggggcggagcccaggttcttgcggaggcagctggtggatgttgtggggtcaatgttgcagattgccgaggcagagggtttggaggaagggactaggcatttggctattgagtttgtgatcacgttggcggaagctagggagagggcaccagggatgatgagaaagttacctcagtttattagtagattgtttgcgatattgatgagcatgttgctggatattgaggatgatccagcatggcacagtgcagagaacgaggatgaagatgcaggggaatcgagtaattatagcatgggacaagagtgtttggataggttggcgatttctttgggtgggaatactattgttccagttgcttcggaacaattgcctgcctatttggcggctcctgagtggcagaaacatcatgctgctcttattgcattagctcagattgctgaaggttgctctaaggtaatgctaaaaaatctggaacaagtagttacaatggtcctaaattcattttatgatccacatccccgtgtgagatgggcagctattaatgcaattgggcagttgtccacggatttgggtccagatttgcaaaaccaataccatcaaagggttttgcctgcattagcagctgccatggatgattttcagaatcctcgagttcaggcacatgctgcttcagcagttcttaacttcagtgagaactgcactccagaaattttgacaccttacttagatggagtagtgagcaaattgcttgttcttctacagaatggaaaacaaatggtgcaagagggagcattgactgctttggcatcagttgctgattcctctcaggagcacttccaaaaatactatgatgcagttatgccttacttgaagaccatcttggtgaatgcaaatgacaaggctaactgcatgcttcgtgccaaatctatggagtgcattagtctagttgggatggctgtggggaaggataagttcagggatgatgccaagcaggttatggatgtacttatgtcattgcaaggatctcagatggagtcggatgatccaacgacaagttacatgctccaagcatgggccagactttgcaaatgtttgggacaagattttcttccttatatgagtgttgtcatgccacctttgcttcagtctgctcaactcaagcctgatgtaaccattacatctgcagattcagataatgacattgatgatactgatgatgaaagtatggaaaccatcacccttggtgacaaaagaatagggatcaagactagtgttctggaagaaaaagctactgcttgtaatatgttatgttgctatgctgatgagttgaaggaaggattctttccatggatcgatcaggttgctccaactttagtacctcttcttaaattttatttccatgaagaggttaggaaagcagctgtttcagccatgccagaacttctgcgctctgcaaaattagctgtagagaaaggacttgcgcaaggtcgcaatgagtcttatataaagcagctgtctgattatattattcccgctctggttgaagcattgcacaaggaacctgatactgagatctgtgcaaacatgttggatgcattaaatgaatgcttacagatatctgggacatttgttgatgaaaaccaagtgcgatccattgtagatgagataaaactggtcatcactgccagctccagtcgaaaaagagagagagcggatagagccaaagctgaagactttgatgcggaggagagtgagttgatcaaggaggaaaatgagcaagaggaggatgtttttgaccaagtcggtgaaatcttgggaactctgattaaaacattcaaagcctctttcttgcctttatttgaggaactatcatcctacctgactcctatgtggggcaaggataagactgctgaagagagaaggattgcaatttgcatttttgatgatgttgcagagcagtgtcgtgaggcagctcttaaatattatgacacatatcttcctttcttactggaggcatgcaacgatgaaaacccagatgttcggcaggcagctgtatatggacttggtgtttgtgcagaatttggtgggtccgtgtttaaatctttagttggagaggctctatcaagacttaatgttgtcataaggcatcctaatgctaagcaaccagacaatgtcatggcatatgataatgctgtttctgctttagggaaaatttgccagtttcatcgtgacagtattgattcagctcaggttgttcctgcatggttaaactgtttgccaataacaggcgatttgattgaggcaaaagttgttcacgaacaactttgttcaatggtggagaggtcagacattgaacttttgggacccaacaatcagtatcttcctaagattgtttcagtatttgctgaggttttatgtggtaaggatctagcgactgaacaaactctaagccgaatggttaatctgctgagacaccttcaacaaaccctaccaccagctaccttggcctcaaccttatcactgttgcatccacaacaacagttggcattgcaatccatcctctcaacatagtctcttgggctgtggaagcgatggctctggggaagatgcaatcaaaccccggtctgttgttggaatattattcattacccattctttcgataagatggtatcggttcccatcatttgttttttgcatggcgctctacaaccacctggcgtcagtttgattgagtgtgaaagtcactgccattgaattttttttttttttttgtagaatgtgtatatgatttataagtactattttatactgcatccatcaagatcgagtcaaggaggaaaaagaaaaacaaaagagtgtaggtaatgtttttgtttgcctgtttttcttctttttttgttggttggtgcgtccgtccagtctgagggttgtcagtgaggcaattcttgtcacagttttgtcccccattgtgatgctatttctgggtttcatacaaataacatctgagattttgatcagttgtatgcactgaaattttgaaatggtgattctttcattataattgcaatattggatctactgttttaagttc

SEQ ID NO: 8999 - DNA, 3871 bp, Ambrosia trifida
cctacacccactcctctatccgcctctctgccctaattattattcttccgccccattccattcccccttcgtcaaacgccaccaccaacaacaataataatattaatccaacccatcaatccttcacttcaccaacaatggatccacaggttcaacaagcacacgtggcagcaatcctaggatccgatccatcccctttcgaaaccctaatctctcatctcatgtcttcatccaacgaccaacgttcacaggccgaattaatattcaatctatgcaaacaaactgatcccaatcggttgtttcttaaactaggtcacatgcttcaatcatctcagcatattgaggcccgtgccatgtcagcaattctgttacggaaacagttaactcaagatgagttgctgatatggaaccggttatcgcctgagtctcaatctttaattaaatctatacttttgagttgtgttcagaaggaagaaactaattctattatgaagaagttgtgtgatacggtttcggagcttgcttcgagtattttaccggataacggttggcccgaattgttgccttttatgtttcagtgtgttgtttcggataattataagttgcaggagtctgcgtttttgatatttgctcaattgtcgcagtatattggtgagacgttgataccgcatataaagcatcttcatggtgtgtttttgcagtgtttgacaacgtctcctagttcggatgtgcgaatcgctgcgttatctgctgtgattaattttattcagtgtttgagttcgggtgatagggataggtttcaggatttgcttcctgcgatgatgacgacgcttactgaagcgttgaatggcggtcaggaggcgactgcacaagaggcgttggagttgttgattgaattggctgggactgagcctaggtttttgaggaggcagttggttgaggtggttgggtctatgttgcagattgctgaggccgagacgttggaagaagggactagacatttagcgattgagtttgtgataacgttagcggaagctagggagagagcgcccggtatgatgagaaaattgccgcagtttataagtaggttgtttggaatattgttgcgtatgcttttggatattgaggatgaacctgcttggcatacggcggagaatgaggacgaggatgctggagagtcgagtaattatagtgttggacaagagtgtcttgatcggttggctattgctttaggtgggaatacgattgttccggttgcgtctgagcagctaccggcttatttggctgctcctgaatggcagaagcgtcatgctgcattgatttcccttgcacagatagctgagggatgttcaaaggtaatgatcaagaatttggaacaagtggtgtccatggttttaaattcattccaagatcctcacccacgtgtgaggtgggctgcaattaacgcgattgggcaattggctacagatttagggccagatttgcaagttcaatatcaccaaagagtgcttccagctctagccaatgctatggatgactttcaaaatccacgagttcaggcacatgctgcttcagcagtgctaaatttcagtgaaaactgcacccctgatatcttaacaccttacttggatggaatagtgagcaaactacttgtgttgctacagaacggtaaacaaatggtacaagaaggggctttgactgcactagcatcagttgctgattcatcacaggaacacttccaaaaatattatgacgcggttatgccatatttaaaaaccatattggtgaatgctaatgataaagcaaatcgtatgcttcgagctaaagccatggaatgcattagtttggttggaatggctgttgggaaagaaaaatttagagatgatgctaaacaggtgatggaagtgctcatgtcattgcaaggatctcaaatggagactgatgatcccaccaccagttacatgcttcaagcgtgggctcggctatgcaagtgcctaggacaagactttctcccttatatgactgttgttatgcctcctttgcttcaatctgctcaactcaaacctgatgtcgtcataacctcagcagattcagataatgaaattgatgaatcagatgatgaaagcatggagacaattacacttggtgataaaagaatagggatcaagactagtgttctagaggagaaagcaaccgcgtgcaacatgttgtgctgttatgcagatgagttaaaggagggtttttacccatggattgatcaggttgccccaatcttggtgccacttctgaagttttatttccatgaagaagttaggaaagcagctgtttctgccatgcctgagctgttgcggtctgcaaagttagccatagagaaagggctagctcaaggtcgtaatgaatcttatataaaacagctctctgactacatagttcccgctttagttgaagctttgcataaggaacctgatacagaaatctgtgcaagtatgctggatgctttaaatgaatgtatacaggtatctggaccacttctagatgaaaaccaggtgaaaagcattgtggatgagataaaacaggtaatcacagcaagttcaagtagaaaaacagaaagagcagaaaggactaaagctgaagattttgatgctgaggaaggagaactgcttaaagaagaaaatgagcaagaagaagaagtctttgaccagattggtgaaatattaggaacactgataaaaacatttaaagcctccttcttgcctttctttgatgatatgtcatcatatttgatgcctatgtggggcaaggacaaaacagctgaagaaaggaggattgctatttgcatctttgatgatctggcagagcagtgtcgtgaagccgctataaagtattatgatacatatcttccttttcttcttgaagcgtgcaatgatgagagtccagatgttagacaggcagctgtatatggacttggagtttgtgcagaatatggtggttctgctataaaaccacttattggagaggctttatcaaggctaaatgttgtaattagacaccctaacgctctccagcctgaaaatgtgatggcgtatgataatgctgtttctgctttggggaaaatatgtcagtttcatcgggatagtatcgactccactcagattattcctgcatggctaagctgtttgccaatcaaaggagatcttattgaggctaaagttgttcacgaactactttgttcgatggtggaaaggtcagacatggaacttctgggccccaacaaccaatatgtgcccaaaattgtttctgtatttgctgagattctttgtgccggcaaggatcttgctacagaacaaacaatcaaccgaatagtcaacctactgagacaactccaacaaacactgccacccgcaacctttgcatcaacatgggcatccctgcagccacagcagcaacttgctatacaatctgtccttacatcataatatcatcatccatcatatatacacacaagaagcttttagaaacatctgcttctcgctctttgtggaaattgatgtgtgtttttaagcgtgtcacccatttttgcgacaaaagttcagttttttcagcttgatgtcatacgacaaccttggatgggttgtttggttgagtgtgaacaaaatgggaagaaaagttgtttgatatttccttttgtatattggtactgttggtcgtctgcggttgtgaggtttgtgttgttcggtcgggtcgggtcggtcagtcaccaagagttgttttaggaaagcaactctggttggagttttgggtcgttatcattattttgatatattgtggcataaattcattaacttattcatttggcttgtattactgaatc

SEQ ID NO: 9000 - DNA, 3610 bp, Amsonia hubrichtii
tctctcatcttatgtccgcctccaacgagcaacgatcccaggctgagtcaatctataatcttatcaagcagaccgatccaactcgctcgccctcaactcgctcagctttatcgtcttcccctcacctcgaggttcgtgctatgtccactatccttctccggaagcaactcacccgcgatgactcgtatatctggcctcgactcactgtctcgactcagtccaccatcaaaaccatactcttatcctgcatccaaaatgaaaattctaagagtataatcaagaagctctgtgatacaatctctgaattagcgtcctccattttgcccgagaacaattggccggaacttttgcccttcatgtttcagtgcgtcacttccgactctgtaaaattacaggagtcggcgtttttaattttctcgcaactagcgcagtacataggcgagacgcttatcccatacatcaaggatttgcatgctgttttcctacaggtgctgaataattcgcagagctccgatgtgaaaatcgccgccctgagcgccgtaattaattttattcagtgcttgagtagccctagcgatcgggataggtttcaggatttactgccggctatgatgaggacgttgaccgaggccttgaattgcggccaggaggccacggcgcaggaggctttggagttgctgattgagctcgcagggacagagcctaggtttctgaggaggcaattggtggacgtagtgggttccatgttgcagattgcccaggcagagagtctggaggagggtacaagacatttggccattgaatttgtgattactttggccgaggcaagagagagggctcctgggatgatgaggaagttgccgcagtttataagtacgctgtttgccattttgatgaaaatgttgttggatgttgaggatgatccagcttggcatagtgctgagccagatcatgaggatgctggggagaccagtaactatagtgttggccaggaatgtttggataggttgtcaattgccttgggtggaaatactattgttcctgttgcttcggagcagttgcccgcctatttggctgctccggagtggcagaagcatcacgccgcactcattgctcttgcccaaattgctgagggctgctcaaaggttatgattaagaatttggagcaagtggtaaatatggttctgagttcatttcaagatcctcacccacgagtgagatgggcagctattaatgcaatcggtcaactatcaacagatttgggcccagatttgcaagttcaataccaccaaagcgtgttgccagcacttgccgcctctatggatgacttccagaaccctagagttcaggcacatgctgcttcagcagtgcttaacttcagcgagaactgcacgccagaaattttaacgccttacttggatggaattgttggcaagctgcttgtacttctgcagaatggcaaacaaatggtgcaagaaggggccttaactgctttagcttcggttgctgattcctctcaggaacacttccaaaaatactatgatgcagttatgccttacttgaaaactatcttggtgaatgcgactgacaagtcaaaccgtatgcttcgtgccaaagctatggaatgtattagcttggttggaatggctgttggaaaagagaagtttagggatgacgcaaagcaggttatggaggtgctcatgtcacttcaaggatcacaaatggaaaccgatgatcccaccaccagttacatgctccaagcatgggctagactctgcaagtgcctgggacaagattttcttccttacatgagtgtagtcatgccccccttgctccagtctgctcaactcaagcctgatgtgaccataacatctgcagattcagataatgaaattgatgaatcagatgatgatagtatggagacaattactcttggggataaaaggataggcattaagactagtgtcctggaggagaaagctacagcttgtaacatgctatgttgttatgctgatgagctgaaagaaggtttctacccatggattgatcaggttgctccgactttggtcccacttttgaaattttacttccatgaggaagttaggaaagctgctgtttcagccatgcctgagctgttgcgttctgcaaaattggccattgagaaagggattgctcaaggccgtaatgagacatatgtgaagcaattgtctgacttcataattccagctttggtggaagctttacacaaggagcctgatacagaaatatgtgcagctatgttggatgccctgaatgaatgccttcagatatctggaccccttctagatgaaagtcaggtccgaagcattgtggatgagataaaacaggtgatcacagcaagctcaagtagaaaaagagaacgagcagagagagctaaagctgaagactttgatgcagaggaaggggaattgctcagagaggagaatgagcaagaagaggaagtctttgatcaggttggtgaaatcttgggcacattgatcaagactttcaaggctgctttcttgcccttctttgatgagctttcatcatatttaatgcctatgtggggaaaagataaaactcctgaagagagaagaatagctatttgcatctttgatgatgttgcagagcaatgccgtgaaacagctctcaagtattatgacacacatcttccttttcttttggaagcttgcaatgacgagaatccagatgttcgacaggctgctgtttatggactcggcgtatgtgctgaatttgggggctctgtatttaaaccactcgtaggagaggctctctcaaggttaaatgttgttatacggcatcctaatgctctgcagcctgataatgtgatggcatatgacaatgctgtgtctgcactggggaagatatgtcagttccatcgtgacagtatcgactcagctcaggttgttcctgcatggctgaactgtttgccaataaaaggtgatctaattgaagctaaagctgttcatgatcagctttgttcaatggttgaaagatcggatagggagcttttgggtcccaacaatcagtatctgcctaaaattgtctctgtttttgctgaggttctttgtgccggcaaggacctagcaacagagcaaactgcgagtagaatgataaatttgttgaggcagcttcaacagacgcttccaccttcagccctggcatcgacatggtcatccttacagcctcagcagcagcttgcattgcaatctatcctctcatcatagccagttaatttatgtttgtggcttgggggggttacctgtgtctatcgtattgtgattctattctttctcatgaattgttcccaatattcatttgctcttgaaggttatgcatcaacctcatcttggttgtgtggtgagtgtgaagatatgcgagtaaaatacaaacctttttctgtagaatgtgtatatttcagtctttacagttgaatcttcagtaggagagggggaagggttgatctttcgttgcttgagattttgttcgatgggtcagatctaagagttgtcagtttgggcaattcttgtcgcagttttggtcggtcttgttattctcttaagttgtcgat

SEQ ID NO: 9001 - DNA, 4054 bp, Eucalyptus grandis
tccaatctcaatagtttctctctctataaccctcactctcctcgccccccttcgcctccctccccttctccctctcgtctccctcgtcccgccaccgcagccgatagagggaagcgaaaaccctaatcctccgccgccgacgccgcccccgccgtcgccgccgtcgccgccgctcccgctccccgccgtccgccatggatccccaatcggcgcagctccagcaggcgcagctcgcgatggcgctggggcccgacccgtcccacttcgaaaccctaatcacgcacctcatgtcctcctccaacgagctccgatcccaggcggagtcgctgttcaacctggcgaagcagacggatcccaactccctctccctgaagctggcccacatcctccacaactgcccccgcctggagctccgcgccatgtccgccatcctcctccgcaagctcctcacccgcgacgactcctacatctacccccgcctcaccccgcagacccaggcctccctcaagtccgtcctcctcacctcgattcagcgcgaggaggccaagaccatcaccaagaagctctgcgacaccgtctccgagctcgcctccggcatcctcccggacaacggctggcccgagctcctccccttcatgttccagtgcgtctcctccgacgtccccaagctccaggaggccgccttcctcatcttcgcccagctcgcccagtacatcggcgactcgttgaccccctacatcaaggagctccacggcgtcttcctccagtgcctcagttcctccaagaaccccgacgtcaagatcgccgccctcaacgccgtcatcaattttatccagtgtttgtccaattcctccgatcgcgacagatttcaggatttgttgccagtgatgatgcacaccttgactgaggcactaaataatgggaatgagccaactgcacaagaagcgcttgaactgctaattgaattagctggaacagagccccggttcttgaggaggcaattagtggaagtggttggttctatgctgcagattgcagaggctgaatcattagaagaaggcacaagacacttggcgattgagtttgtgattacccttgcggaggctagggagcgggcacctggaatgatgaggaaattgccgcaattcataagtagactttttgcaatcctgatgaagatgcttttggatattgaagatgacccagtttggcatagcgcagagagtgaagatgaggatgcaggggagagcagcaattatagtgtggggcaggaatgcttggatcgactgtccatctcacttggtggaaacaccattattcccgttgcttctgaacagttgcctgcatacttggccgctcctgagtgggagaagcatcacgctgctttgatagcaattgcccagattgcagagggttgtgcaaaggtaatggtaaagactttggagagagttgtttcaatggttttaacttcatttcaagatccacaccctcgtgtaagatgggcggcgatcaatgcaattgggcagttgtccaccgatctaggcccagacctgcaggagcaataccatcaacaggtcctgccagcacttgctggtgctatggacgactttccgaatcctcgtgtacaggctcatgctgcgtctgctattcttaacttcagcgagaactgtacagctgtgatattgatgccctacttggatggaattgtgagcaaactgcttgtgcttctacagaatgggaaacaaatggtgcaagagggcgcattgaccgcattggcttctgttgctgattcctctcaggagcaattccaaaagtactatgatgcggtcatgccttatttgaaaaatatcttggtcaatgcaactgacaagtctaaccgaatgcttcgtgccaaagcaatggaatgcattagtttggttgggatggctgttggaaaagagaaattcagggatgacgctatacaggttatggatgtgcttatggcattgcaaagatcacagatggaaacagatgatccgacgacaagctatatgctgcaagcttgggctaggctttgcaaatgcttggggcaagattttcttccttacatgaaagtcgtcatgccccctttgcttcagtctgctcaactcaagcctgatgtgacaatcacgtccgcagattctgataatgatattgatgaatctgatgatgagggaatggagaccataacacttggagataaaagaataggaataaaaaccagtgtcttggaagagaaggcaacagcttgcaacatgttgtgttgctatgcagatgagttaaaggaagggttttttccatggatcgagcaggttgctccaactttagttccacttctcaaattttattttcatgaagacgtcaggaaagcagctgtttctgcaatgccggagttacttcgttctgcaaaattagctgttgagaaagggttagcacaaggtcataatgaaacctacgtgaagcaactaactgattacatcattccagctttggtggaagctatacctaaggaacccgacacagagatctgtgctagtatgttggatgcactaaatgagtgtttacagatttcaggcccactcttggacgaaaatcaagtcagatcgattgttgatgagattaaacaagtgattactgctagctcaagtagaaagagagagagagcagagcgtgctaaagccgaagattttgacgcagaagaaggcgagctgcttaaagaggagaatgaggcggaggaggaagtttttgagcaagttggtgagattttgggcactatggttaaaacattcaaagcatctttcttgcctttcttcgatgagctgtcatcttacctaacgcccatgtggggcaaagataagacttctgaagagaggagaattgccatatgcatttttgatgacgttgctgaacagtgtcgcgaaacagctcttaaatattacgatacctatctccctttccttttggaggcttgcaacgatgagaatccagatgtccgacaggctgctgtctatggattgggggtttgtgcagagtttggcggttccgttttcaaaccacttgttggagaggctctttcaaggctgaatgttgtgatacgtgatcccaacgctctgcaacctgataatgtaatggcatatgataatgctgtctctgctctgggaaaaatatgccaatttcaccgtgatagcatagattcttctcaggttgttccagcatggttaaattgcttgcccataaaaggcgatgtaatagaggccaaagttgtccatgatatgctttgttcaatggtggaaagatctgatagggaactattgggccctaacaatcagtatcttcctaagattgttacagtgtttgtggaggttttgtgtggtaaggatctagctactgagcaaactttaaaccggatgaccagtctgttgaggcaactacaacaaactttgccaccatctgctttggcctcaacatggtcatctttgcagccccaacaacagcttgctttgcaatcaatcctctcctcgtagatccggcaaaaagaggttgacaagttgctcttctcaaggattgctgtccagtcggtgtgtcgaatatatgcatttgttacccattcttttccataaatggttgccattcctgcgtgatgagtgtgggagtcacatctacgagtggactttttttctgtagcatgtgtatagtgcaagcattaagtctatacttcagttttgagtcccctactgtgccatgagaaggatcaacatcccttcggtgcatgcggtttgaggattgtctggcaggcaattcttgtggcagttttggtcccatctttgtgtcgtccgttttttgtttcagctcatacttgctggcataatgtatcgactgaaatcatgcattgtaattctttcattgggtctgcaccttgtatttgaactgggctggtggggctggtcttgcttcttgaaattttgtgaagaattaaattatattcttaaggtttttgagttttggtatacaatgtggagttccactaaaattttct

SEQ ID NO: 9002 - DNA, 3641 bp, Panax ginseng
gccgaagtcattttcaatctctgcaagcaaaccgatcccaactcgctcgttctcaaactcgctcagctcctccagttctcccctcatgttgaagcccgagccatgtccgcaattctactcagaaagcagttgactcgtgatgactcgtacatatggccccggttgtctccttcaactcagtcatcgctcaaatcgatcttccttgcttgcgttcaacgtgaagaagctaagactataattaagaagctttgcgacactgtttcggagctcgcctccgggattttaccggacaatggatggccggagctattgcctttcatgtttcaatgcgtatcgtccgattcgcataagcttcaggaatctgcgtttttgatatttgcccaattgtctcagtacataggtgaaacactaattccccacataaaacacctgcatactgtgtttttacagtgtttgactacttcgtcgagctcggatgtgaggattgcggcgcttagtgctgttattaatttcattcagtgcttgtccagctccagcgaccgtgatcgtttccacgatttattgcctgcgatgatgagtactttgacggaagcattgaattgtgggcaggaggcaacagctcaagaagctttagaattgatgattgaattggctgggacagaaccaaggtttttgaggaggcaattagtggaagtagtggggtctatgttgcaaattgcagaagcggaaactctagaagaagggacaagacatttagctattgagtttgtaattactcttgccgaggccagggagagggcacctggaatgatgaggaaattgccccagtttattagtaggttattcgcaattttgatgaagatgttgttagatcttgaagatgatccagcgtggcatactgcagatactgaggatgaggatgccggagagactagtaattatagtgttgggcaggagtgtttggataggttggccatagctttgggagggaatactattgttcctgttgcatcggagcagttgccagcttatttggctgcccctgaatggcaaaaacatcatgctgcattaattgcacttgcgcaaattgcagaaggatgctcgaaggtgatgataaaaaacttggagcaagtggtaaccatggtattaaattcatttcaagatccccatgctcgagtacgatgggctgctattaatgcgattggacaattatctactgatttgggaccagacttgcaagttcagtaccatcaaagggtgctgccggcactagctgcagctatggatgacttcccgaatccgcgtgtacaggctcacgcggcttcagctgtgctcaatttcagtgagaactgtaccccagatatattaacgccttacttggatggaatagtgagcaagctacttgtgcttctacagaatggcaagcaaatggtgcaagaagggtccttgactgctttagcctctgttgctgattcatctcaggagcatttacaaaaatattatgatgccgttatgccctacttgaaagctatattggtgaatgcaaatgacaaatccaaccgcatgcttcgcgccaaagccatggaatgcattagtttggtaggaatggctgttggaaaggataagttcagggatgatgctaagcaggtaatggaagtgcttatgtcactgcaaggatctcaaatggagactgatgatcctactacaagctacatgctacaagcatgggcaagactttgcaagtgcttggggcaggatttccttccttatatgagtgtagtcatgcctccattgcttcagtctgctcaacttaaacctgatgtgatcattacatctgcagattcagataatgaaattgatgaatccgatgatgaaagcattgagaccatcactttaggtgataaaagaattgggatcaagactagcgtcctagaggagaaagctacagcttgtaacatgctatgttgctatgctgatgagctgaaggagggtttctacccatggattgatcaggttgccccaactttggttccacttcttaaattttattttcatgaagaagtcaggaaagcagctgtttcagccatgccggagctgttgcgttctgccaaattagctgtagagaaaggacttgctcagggtcgaaatgagtcttatattaagcagttgtccgactacataataccagctctggtggaagctttacataaggaacctgatacagaaatctgcgcaagtatgttggatgccttgaatgaatgtgttcagatctctggaccaattttggatgaaggccaggtaagaagcattgtggatgagataaaacaggtgataacagccagttcaagtaggaaaaaggaaagagctgaaagggccaaagctgaagacttcgatgctgaggagggggagttgcttaaagaggaaaatgagcaagaagaagaagtttttgaccaagtcggtgaaattttaggaaccttgatcaaaacattcaaagcctctttcttacctttctttgatgagttatcttcatatctaatgcctatgtggggtaaggacaaaacggcagaagagaggaggattgcaatttgcatctttgatgatgttgcagaacagtgccgtgaagcagctttgaagtattatgatacatatcttccttccttttggaagcatgcaatgatgagaattcggatgtccgacaggcagccgtatatggacttggtgtttgtgcggaatatggcggttctgttttcaaaccacttgttggagaggctctttcaaggctgaatgttgtgataagacacccaaatgctttgcaaccagataatgtaatggcatatgataatgctgtttctgctctggggaaaatatgccagtttcatcgtgacagtattgattcagctcaggttcttcctgcctggttaagctgcttaccaataaaaggtgatctgattgaggccaaagttgttcatgaccaactttgttcaatggttgaaaggtcggatacagagcttttgggtcccaacaatcagtatctctctaaaatagtttcagtatttgcagaggtcctgtttgccggcaaggatcttgcaactgagcaaactgccagccgaatgattaatctgctgagacagctacagcaaacgctaccgccatctaccttggcttcaacatggtcatcactgcagccccagcagcagcttgcattgcaatccatcctctcgtcatagccagctatgtgttgattgagaagagtagagctcgctatcaattgggggaaaactgctttgtccagtccattgcgtcaaatcatatgctggttacccattctttaccataaggtgttccccacattcatttttgcatgatgatgatgtgctgcaacctgtggttggttgcgcggtcgagtgtgaatgtcattgcgagtgaaatgaaacccacagtttttttgtagcatgtgtatatttaaaagaaagaaaggtcagcaattgtgtttgtgaggttcttgttggtccgtccatgcatgaggttttgaggggtttgtgggctttgggcaatttttgttgcagttttggttgtgtcaaattatatactacgattcttttgttacttctctcaatgattaattatatgaatttgttgtt

SEQ ID NO: 9003 - DNA, 3734 bp, Nicotiana benthamiana
tctctcactaactcaattcgccatggctgcggagcaagctcaactggctgcaatcctcgggccagattcagcaccctttgaaacccttatctctcatctcatgtccgcttccaacgagcaacggtcccaagccgagtcgtcggttttcaatctcatcaagcaaaatgatccgaatgcactcgctctcaagctcgccaacgtcctcacctcttccccgcaccaggaagctcgggccatgtcaacaatcctcttacgaaagctcctcacgcgtgacgactcgttcatttggcccaaactcaccgagtcgactcagtcagggattaaaaccgtcctccttacttgcatccagcgcgaagaatcaaaagcgataattaagaagttgtgcgatactgtatcggagctcgcctcttcgattctccccgaaaaccagtggcctgaattgttgccgtttatgtttcagtgtgtcacttctgatttacctaaattgcaggaatccgcgtttttgatattcgcgttgttggcacagtatgttggggaaaagttagttccgtatattaaggatttgcattcggtgtttatgcagacgctgaatcattcgccgcatcctgatgtgaggattgcggggctgagtgctgtgattaattttattcagtgtttatccagctcgaatgatagggataggtttcaggatctgttgcctgcgatgatgaagacgctgacggaggcgttgaacagtgggcaggaggcgactgcgcaggaagcgttggagttgttgattgaattggcgggtactgagcctaggtttttgaggagacaacttgttgatgtggtgggcgcaatgttgcaagtagccgaggcggtgagtttagaagaggggacgaggcatttggcgattgagtttgtgattacgttggctgaggcgagggaaagagcgcctggaatgatgaggaaattgccgcagtttattagtaggttgttcgctattttgatgaagatgttgctcgatatcgaggatgaacccacctggcatagtgctgaagttgagcatgaggatgcaggggagactagtaattacagtgttggtcaggagtgtttggaccgtttggcgattgcattgggcggtagtactattgttcctgttgcgtcggagcagttagctccttacttggctgctcccgagtggcaaaagcaccatgctgcactcattgcacttgctcagattgctgaaggttgcacaaaggtgatgattaagaatttggagcaagtggtaaacatggttttgagctgtttccaagatcctcatcctcgagtgaggtgggcagctattaatgcaattggccagttgtcaactgacttggggccagatttgcaagtgcaataccacagcagagtactgccggcattggcatcagctatggacgatttccaaaatccacgagttcaggcacatgctgcatcagctgtcctcaacttcagtgagaattgcacaccagaaatcttgacaccttacttagatggaattgttagcaaactgcttgtacttctgcagaacggcaaacaaatggtgcaagaaggagcattaactgctttggcttcagtggctgattcatcccaggagaacttccagaaatactatgacgctgtaatgccatatttgaaaagaatcctggtaaatgcgaatgataaatctaaccgcatgcttcgagccaaagccatggagtgcataagcttggttgggatggctgttggcaaggaaaaattcagagatgatgctaagcaggttatggaagtgcttatgtcattacaaggatcgcaaatggagacggatgaccctactactagttatatgttgcaggcatgggccaggctttgcaagtgcttgggacaggatttccttccttacatgagtgtagtcatgcctcctttattacagtctgctcaactaaaacccgatgtgacaatatcatctgcagattcagacaatgaacttgatgaatcagatgatgatagtatggagaccataactcttggggataaaagaataggcatcaagacaagcgtcttagaggagaaggctacagcttgtaatatgctatgctgctatgctgatgagctaaaggaaggtttctacccatggattgatcaggttgctccgacgttagttccacttctcaaattctattttcacgaggaagttaggaaagcggcagtgtcagcaatgccggagctgttacgttctgctaaactggctgtagagaaagggattgctcagggccgaaatgagtcctatgtcaagcaattatccgactacattataccagctttgattgaagctttgcataaggagcctgatacagaaatatgtgcaagtatgttagatgcaattaatgagtgtgtgcagatatctggaccactcctggatgaaggtcaggtccgaagcattgtggaagagataaagcaggtcatcacagccagttcaagtcgaaaacgagaacgtgcagagagggccaaagctgaagactttgatgctgaggaaaatgagttgctaagggaggaaaatgagcaagaagaagaagtttttgaccaagttggtgaaatattgggcacacttatcaagacattcaaggcagccttcctgcctttctttgacgaactttcatcatatctcatgcctatgtggggtaaggataaaacagctgaagaaaggaggatagcaatttgtatctttgatgacgttgcagagcagtgccgtgaagcagctttaaagtactatgacacatatctgcctttccttttggaagcatgcaatgacgaaagtccggatgtccggcaggctgctgtgtacggacttggtgtatgtgcagaatatgggggttctgttttcaaacctcttgttggagaggctctatcaaggctcaatgtcgttattaggcatcctaatgctcttcaacctgagaatgtaatggcatatgataatgctgtttcagcagtggggaagatatgtcaatttcatcgtgaaagtattgactcagcccaggttgttcctgcttggttgaattgccttcccataaaaggtgacctgattgaggccaaggttgttcatgaccaactctgttcaatggttgaaaggtcagaccgagaacttctgggtcctgacaatcagtaccttccaaaaattgtgttggtttttgctgaggttctatgtgccggtaaggaccttgctacagagcaaaccgctagtcggatgatcaatctgttgaggcagcttcagcaaacattaccgccagccacactagcctcaacatggtcttccttgcagcctcagcagcagatagcactgcaatccattttatcatcgtagtggcatggaggatgacaattttctccaatgcaatgaagctgctaggctgtagcttcgcgtgtgtcatatttcattctcgattctttctcataaaacatcatttcattcatttgggctttttgaggtcatgcatcagcctgttgtcacttaggttggaagtgtgtgagcaaaggcggagaacccttctgtttttgtagaatgtgtatattagaaatgttgcattggagtcctcctgcaagggtagaagtgtcggtgattatgttgagaagtttgtttatcaaatgagttttaagctcaagggtcgtcagggagacgacttttgtcacagttttggtcgagtcatcttgttctttacattgtgggatggtacaag

SEQ ID NO: 9004 - DNA, 4077 bp, Mimulus guttatus
cacacctccactgcgtgtgcttctgtgtgagagagagagaggagagagatagagtgagaaagagaagtgtgtcaattatccaaacaatatagaaacaacagcgccaccacggagcgctgaaaaaataataaaaagaaaataaaaaaaccctagtccagaaccgccgcgactcagtgcagatggacgccgagtcaactcagttccagcaggcgcagctgatggcgattctggggccggacccggcgccgttcgagacgctgatatcgcatttgatgtcctccgccaacgagcagcggtctcaggccgagtcgattttcaatttgctcaagcagaacgatcccaactcgctcgccctcaaactcgcgaacctgctctcgtcgtccgtgcacctcgaggcgcgcgccatggccaccatcctcctccggaagcagctgacgcgggacgactcgttcatctggccgcagctcaccgagccgactcgctccgcggtcaaaaacatcctcctctccgccatccagaacgaggaatccaaatccattatcaaaaagctgtgcgacaccgtttcggagctcgcctcctccctcgtcccggagaatcagtggccggagattctgcccttcatgtttcagagcgtcagttccaattcccccaaattgcaggagtccgctttcctgatgttctcccagttggctcaattcatcggagaaacgctcacgccgtacatcaccgatttgcacaccgttttcctgaacgtgttgaacaattccaccaatccggatgtgaaaattgcagccctcagcgcggttatcaattttatccagtgcctgtcgagttcgaacgatcgggataggttccaggatttgttgccttcaatgatgaagacgttgaccgaggcgctgaactctgggcaagaagccactgctcaagaggctctggagttgttgattgagttggccgggaccgagccaagattccttcgcaggcagattgtggatgttgtggggtccatgttgcagatagccgaagcagagagtttagaggaagggactcgtcatttggcgattgaatttgtgattactttggcggaagcgagagagagagcacctggaatgatgcgaaagctgccgcagttcatcagtagggtttttgctattttgatgaagatgcttgtggatgtggaggacgatcctgcgtggcacagtgcggagactaaggatgaggatgcgggggagacgagtaattacagcgttgggcaagagtgtttggataggcttgctatcgcccttggtgggaacactattgtgcccgtggcatcggagcagctgcccgcttatttgtctgctactgagtggcagaagcatcacgcagcactaattgctcttgcgcaaattgcggagggttgctcgaaggtgatgattaagaatttggagcaagtcgtgaccatggttttgaattcctttcaacatccgcatcctcgtgtgagatgggcagctattaatgcaattggtcaactttcaactgatctgggcccagatttacaagttcaataccatcaacatgtgctaccagcactagctggagcaatggatgatttccagaatcctcgagtacaggcacatgctgcttcagctgtgctcaacttcagtgagaattgcactccagaaattttgacaccttacttagatgggattgtgcacaagctacttctcctgctacagaactccaaacaaatggtacaggaaggtgccttaacagctttagcttctgttgctgattcatctcagatacacttccagaaatactatagcgcagtcatgccgtacttgaagaccatcttggtgaatgcaacagacaagtctaaccgcatgcttcgtgccaaggccatggagtgcatcagcttggtaggaatggctgttggaaaagatatattcaaggaagacgccaagcaggtcatggaagtgcttatgtcattgcaaggatcgcaaatggagacagatgatccgactacaagttacatgctacaagcatgggccagactttgcaagtgcttgggacaggatttcctaccttacatgagcgtggtcatgcctcctttgcttcagtctgctcagctgaagcctgacgtgaccatcacatctgctgattcggacaatgaaattgatgaatcagacgatgaaagcatggagaccatcacccttggtgacaaaagaattgggattaagactagtgtcctcgaagagaaggccactgcttgcaatatgttatgttgctatgctgatgaattgaaggaaggtttctatccatggatcgatcaggttgccccaactttggttccccttttgaaattttattttcatgaagaagtaaggaaagctgctgtttcagcaatgccggagctattgaggtctgcaaaattggctgtggagaaagggattgctcagggccgtaacgagacatatgttaaacagttgtctgactacatagttcctgctttagtggaagctctacataaggagcctgatacagagatttgtgcaaatatgttggatgcaataaatgaatgtctgcagatttctggccaacttctagatgaaagtcaagtgagaagcatagtggatgagataaagcaggtgattacagctagctcaagtagaaagagagagagagctgagaggtccaaagctgaagattttgatgctgaagagggagaattgcttaaagaggaaaacgagcaagaagaagaagtgtttgaccaagttggtgaaattttgggaaccatgatcaaaacattcaaggcttctttcttgcccttctttgatgaactgtcatcatacttgatgcctatgtggggaaaagataagacagcagaagagagaagaatcgctatttgcatcttcgatgatgtggctgagcagtgccgtgaatcagctctcaagtattatgatacatatcttcctttcctcttggaagcttgtaatgacgaaaatcaagatgtccgacaggctgctgtttatggacttggggtgtgtgcagaatttggtgcatctgtaattaaaccacttgttggagaggctctttcgaggctcaatgtcgttatcaggcatccaaacgctttgcagccagaaaatgtgatggcatatgataatgctgtttcagcactgggaaagatatgccaatttcatcgtgatagcattgatgcagctcaggtcattcctgcctggttgagttgcttgccaattaaaggcgatctcatcgaagcaaaagttgttcatgagcagctttgttcaatggttgagagatccgatgcagaacttcttggtccgaacaatcagtatcttcccaaaattgtctccgtgtttgctgaggttcttcttgcaggcaatgatcttgcgacagagcaaactaccagtcgaatgataaatttgttgagacatttacagcagacgttgcctccgtcaactctcgcctccacatgggcatccttacaacctcaacaacagcttgcactgcagtcacttctatcctcatagtgctcgctcgtcgagttattacgtctgcttgtgtgccaatcatacatatatttattcctcaattctttcagatacgagagagagagatgtcgcaacaattattcatctgcatacggttcatgcattcgtttggttgggtgtgaatgaattttgagagtaaaatgtagtctatttttctgtataacgtgtacaaaagcattcgctttgagggattggcgggatcgggttcccgtgttgtggtttgtgagattctattttatcggtcaattttgatatccgggatttgtcagagaggcaatataccctgttgtagtttttagattgttatagcaaaaagaattgtgtttacattgttttattttattttattcatcagttttgatcattgtttgaaaagtcatatattaatttgttgcctggatttctattcttgagctattttttgaatgattgtctgtatgatgttttaatccaaattgtaataaaattgaaatgattgtctgaatattattgtttgaataattgatcaatcatttctgctttttga

SEQ ID NO: 9005 - DNA, 3345 bp, Solanum phureja
tgatggattctgagtcaactcagcagcaagtggcggccatactcggagccgacccggcaccattcgaaactctaatctcacatctcatgtcaacctccaacgaacaacgatcccaagcagagtcaatcttcaacctcatcaagcagaatgatcccaattcactcgctatcaagcttgctaaccttctcaccacctccccacatatcgagccccgtgctatgtcagctatactcctccgaaagttgcttactcgggatgacgacttcatctggccaaaactcactcactctacccagtcctctattaagtcactcctactcacatgtatccaacatgaacaatctaaatccattatcaaaaagttatgtgacaccatttccgaactcgcttcatctattctccctgaaaatcaatggcctgaaatattgccattcatgtttcactctgttactagcgattcaccaaagttacaggaatctgctttttttatatttgctcaattagcacagtatataggtgacattttggttccctatacaaaggatttgcattcagttttcctgcaaaacttgaacaattcctccaatcctgatgtcaggatcgctgcattaagtgctgcaatcaatttcatacagtgtttagcaatcgaaagccagagggataggtttcaggatctattgcctgggatgatgagtaccttgactgaggccttgaaccttggtcaagaggccacagcacaagaagcgttggaattgatgattgaattagcagggactgagcctaggttcttgaggagacaactagtagatgttgtaggggcaatgttgcaaatagccgaggcagagagtctagaagaggggaccaggcacttggctattgaatttgtgattacattgactgaggccagggaacgtgccccaggaatgatgaggaagttgccgcagtttattagtaggttgtttgctattttgatgaagatgttgttagatgtggaggatgaagttctttggcatagtgctgaagttgagcacgaggatgcaggggaaacaagtaattatagtgtagggcaggagtgtttggataggttagccattgcactgggcggtaacacaattgttcctgttgcttctgaacagttgccggcttacttggctgcacccgagtggcagaagcaccatgctgctctcattgcccttgctcagattgccgaaggttgctcaaaggtgatgattaagaatttagagcaagtggtcaacatggttctcaattctttccaggatcctcatcctcgagtgaggtgggcagctattaatgcaattggccagctgtcaactgacttgggtccagatttgcaggttcaatatcataaccgtgtattgccagcactagcgacagcgatggataattttcaaagtccacgagtacaggcacatgctgcatcagctgttctcaacttcagtgagaactgcacaccagaaattctgacaccttatctagatggaatagttagcaaacttcttgtacttctgcagaatggaaaacaaatggtgcaagagggagcattaactgctttggcttcagtcgctgattcatcccaggagcacttccaaaagtactatgatgctgtaatgccttatttgaaaactatccttgtaaatgcaacagacaaatctaatcgcatgcttcgagccaaagccatggagtgcataagtttggtagggatggctgttggcaaagataaattcagagatgacgcaaagcaggttatggaagtgcttatgtcattgcaaggatcacaaatggagacggacgacccaactactagttacatgctacaggcttgggccagactttgcaagtgtttgggacaggatttccttccatacatgagtgtagtcatgcctcctttgcttcaatctgctcaacttaagcctgatgtaaccatatcatctgcagattcagacaatgaacttgatgagtcagatgacgatagcatggagaccataactcttggggataaaaggataggcatcaaaacaagtgtcctagaggagaaggctacagcttgtaatatgctatgctgctatgctgacgagctaaaggaaggtttctacccatggattgatcaggtcgctccgacattagtcccgcttctgaaattctatttccatgaggaagtcaggaaagctgcggtttcagctatgccagagctgttacggtctgccaaactagctgtagagaaagggattgctcagggccgaaacgagacctacgtcaagcagttatccgactacataataccagctttggtggaagctttgcataaggagcctgatactgaaatatgtgcaagtatgttggatgcactaaatgagtgcctacagatatctggactactcttggatgaaggtcaagtccgaagcattgtggatgagattaagcaggtcatcacggccagttcaagtcgaacgagcgaacgagcagagagagcaaaagctgaagactttgatgccgaggaaggtgaattgctcagggaggaaaatgagcaagaagaagaagtgtttgaccaagttggtgaaatattgggtacactgatcaaaacattcaaggcagctttcttacccttcttcgatgagctctcatcatatctaatgcctatgtggggtaaggataaaacagctgaagaaaggagaatagcaatttgcatctttgatgatgttgcagagcagtgccgagaagcagctttaaagtattatgacacatatcttcctttccttttggaagcatgcaatgatgagagcccagatgtcagacaggctgctgtttatggacttggtgtatgtgcagaacatggtggctctgctttcaagtctttagtgggagaggttatgtcaaggctctatgttgttttaaggcatccaaatgctatacaacctgagaacataatggcctatgataatgccgtttcagcattagggaagatctgtaattttcatcgtgacagcattgactcagcccaggttattcctgcctggctgaattgcctgcctataaaagatgacctgattgaagccaaggttgttcacgaccaactttgttcaatggtcgaaagatcagacagagaacttctgggtcccaacaatgagtaccttccaaaagttgttcaaatttttgctgaggtcctatgtgccggtagggatctggtaacagagcagactgctagtaggatgattacactgttgaggcagcttcagcaaacactgccaccagccaccttggcttcaatatggtcatccctgcagcctcaacagcagttaacactgcaatcaatgttatcatcataat

SEQ ID NO: 9006 - DNA, 3643 bp, Plantago ovata
caccacaactcgccgctgcccgactcagtgaaaaatacatcatggacgccgagtcgactcagctggcggcgattctcggcccggacccagcgccgttcgagacgctcatctctcacctcatgtcctcagcgaacgagcagcgttctcacgccgagtcgatcttcaatttgctgaaacaaaaggatcctaactcgctctccttgaagctcgctcatctcctctccacctcctccagcgtggaggctcgcgccatggcggcaatcctcctccgcaagcagctgactcacgacgactcgttcatttggccacacctcgccgagtcgactcgttctacggtgaagagtattctcctgcaatcgatccaaaccgaggagacgaaatcgattattaagaaggtctgcgacacaatctcggagctggcttcctcgttgctgccggagaatcagtggccggagattttgccgttcatgtttcagtgcgtgacgtctaattcgccgaagcttcaggaatcggcgtttttgattttctctcaattggctcagtacataggggagactttgagtccttatatcactgatttgcactccgtgtttttgaattgtttgaatagttctactaatccggatgtgaaaattgctgctctgagtgctgttattaattttatccagtgtttgtcgagttcgaatgagcgagataggtttcaggacttgctgcctgcaatgatgaggacgttgaccgagtcgcttaattcggggcaggaggcgactgctcaggaggcgttggagctgttgattgagttggcagggacggaaccgaggtttttaaggaggcagattgtggatgtagtgggggctatgttgcagatagccgaggcggagagtttggaggaaggtacgcggcatttggcggtggagtttgtgattactctggctgaagctagggagagagcgcctggtatgatgaggaagttgcctcagtttattagtaggctttttgccaacttgatgaagatgctgttggatgttgaggatgatcctgcgtggcatagtgctgaggccaaggatgaagatgcgggagaaacgagtaattatagtgttggacaggagtgtttggataggttggctatagctcttggagggacaactattgttccagtagcatcagagcagttgccggtttttctgtctgcccctgagtggcagaagcatcatgcggcccttattgcccttgctcaaatcgccgagggttgcgcgaaggtgatgaccaaaaatttggaacaagttctgagcatggttttgaactcattccaacatcctcatcctcgtgtaagatgggcagctattaatgcaattggtcagctttcaactgacttgggcccagacttacaagttcagtaccatcagcaagtgctgacagcgctagctggggcaatggatgatttccaaaatccacgagtacaggcacatgctgcttctgttgtgctcaacttcagtgaaaattgcaccccggaaattttgacaccttacctagatgggatagttcacaagctgcttctacttttacagaactccaaacaaatggtgcaagagggtgccttgactgctttagcttccgttgctgattcgtctcaggagcacttccagaaatattatgatgccgttatgccatacttgaaagctatcctggtaaatgcaacagacaagtctaatcgtatgctacgtgccaaagctatggagtgcattagcttagttggaatggcagttggaaaggagaaattcaaggacgacgcaaagcaggtcatggaagtgcttatgtcattgcaaggatcacaaatggagacagatgatcccactaccagttacatgctacaagcatgggccagactttgcaagtgcctagggcaggatttccttccttacatgagtgtagttatgccccctttgcttcagtctgcacagttaaagccggatgtgaccatttcatctgccgattccgacaatgagattgatgaagatgatgacagcatggaaaccatcacccttggcgataagagaattgggattaaaaccagcgtcttagaggagaaggcaacagcatgtaacatgctgtgttgctatgctgatgagctgaaggaaggtttctatccgtggattgatcaggtggcccctactttggtacccctcttgaaattctatttccatgaagaagtcaggaaagcttctgttgctgcaatgccggaactattacggtctgcaaagttggctgtggaaaaagggattgctcaaggccgcaatgagacatatgttaagcagttatctgactatatagttcctgctctggtggaagctttacataaggagccagatacggagatatgtgcaaacatgttggatgccctgaatgaatgtatacagattgctggaccaattctagatgagaatcaggtcagaagcattgtggatgagatcaaacaggtgatcacagctagctctagcagaaagactgagcgagctgagagagccaaagctgaagattttgatgctgaggagggagaattgcttaaagaggagaatgagcaagaagaagaagttttcgaccaagttggtgaggtgttggggactttgatcaaaacatttaaggcttcatttttgcctttctttgatcaactgtcatcatatttaatgcctatgtggggaaaggataagacagctgaggagagaagaattgctatctgtatctttgatgatgttgctgagcaatgccgtgaagcagcattgacgtattatgatacatatcttccttttctactggaggcatgcaacgatgaaaaccctgatgttcgacaggctgctgtttatgggcttggggtatgtgcagaatatggcggttctgtgtttaaaccactagttggagaggctctttcaaggctcaatgtggtcatcgggcatcccaatgccaagcagtcagacaatttgatggcatatgataatgctgtttcagctctcggaaagatatgtcagtttcaccgtgacagcattgattctgctcaggtggttcctgcctggttgggttgcttgccactaaagggtgatttgattgaagcaaaagcagtgcatgatcagctctgctcaatggtcgagaggtcggatagagaagttttgggccccaacaatcagtatctccccaagattgttcatgtatttgctgaggttctatgtgcaggcaatgatcttgctactgagcaaactgccagtcgaatggttaacttattgaggcagctacagcagacgctacctccggatacactcgcatccacctggtcatccttgcaacctcagcagcagctgacattgcaatcaattctgtcagcataggtttccatgccagagaaaggtgaatgtgtggagatcatttgtgccagtcatatatttgttcctcaattctttcagatagggtcgactgcattcgtacgcatacatggtgcatgaatctgttgttggtttttggtcaactgtgaccgtctctctggtgcaaatgtacactatttcatagatgtgtataatacaagccaaaatgaagcagggagggtggttcagctgagcccagggatgggccagattgttatttgagttttttttttctt

SEQ ID NO: 9007 - DNA, 3345 bp, Solanum lycopersicum
tgatggattctgagtcaactcagcagcaagtggcggccatactcggagccgacccggcaccattcgaaactctaatctcacatctcatgtcaacctccaacgaacaacgatcccaagcagagtcaatcttcaacctcatcaagcagaatgatcccaattcactcgctatcaagcttgctaaccttctcaccacctccccacatatcgagccccgtgctatgtcagctatactcctccgaaagttgcttactcgggatgacgacttcatctggccaaaactcactcactctacccagtcctctattaagtcactcctactcacatgtatccaacatgaacaatctaaatccattatcaaaaagttatgtgacaccatttccgaactcgcttcatctattctccctgaaaatcaatggcctgaaatattgccattcatgtttcactctgttactagcgattcaccaaagttacaggaatctgctttttttatatttgctcaattagcacagtatataggtgacattttggttccctatacaaaggatttgcattcagttttcctgcaaaacttgaacaattcctccaatcctgatgtcaggatcgctgcattaagtgctgcaatcaatttcatacagtgtttagcaatcgaaagccagagggataggtttcaggatctattgcctgggatgatgagtaccttgactgaggccttgaaccttggtcaagaggccacagcacaagaagcgttggaattgatgattgaattagcagggactgagcctaggttcttgaggagacaactagtagatgttgtaggggcaatgttgcaaatagccgaggcagagagtctagaagaggggaccaggcacttggctattgaatttgtgattacattgactgaggccagggaacgtgccccaggaatgatgaggaagttgccgcagtttattagtaggttgtttgctattttgatgaagatgttgttagatgtggaggatgaagttctttggcatagtgctgaagttgagcacgaggatgcaggggaaacaagtaattatagtgtagggcaggagtgtttggataggttagccattgcactgggcggtaacacaattgttcctgttgcttctgaacagttgccggcttacttggctgcacccgagtggcagaagcaccatgctgctctcattgcccttgctcagattgccgaaggttgctcaaaggtgatgattaagaatttagagcaagtggtcaacatggttctcaattctttccaggatcctcatcctcgagtgaggtgggcagctattaatgcaattggccagctgtcaactgacttgggtccagatttgcaggttcaatatcataaccgtgtattgccagcactagcgacagcgatggataattttcaaagtccacgagtacaggcacatgctgcatcagctgttctcaacttcagtgagaactgcacaccagaaattctgacaccttatctagatggaatagttagcaaacttcttgtacttctgcagaatggaaaacaaatggtgcaagagggagcattaactgctttggcttcagtcgctgattcatcccaggagcacttccaaaagtactatgatgctgtaatgccttatttgaaaactatccttgtaaatgcaacagacaaatctaatcgcatgcttcgagccaaagccatggagtgcataagtttggtagggatggctgttggcaaagataaattcagagatgacgcaaagcaggttatggaagtgcttatgtcattgcaaggatcacaaatggagacggacgacccaactactagttacatgctacaggcttgggccagactttgcaagtgtttgggacaggatttccttccatacatgagtgtagtcatgcctcctttgcttcaatctgctcaacttaagcctgatgtaaccatatcatctgcagattcagacaatgaacttgatgagtcagatgacgatagcatggagaccataactcttggggataaaaggataggcatcaaaacaagtgtcctagaggagaaggctacagcttgtaatatgctatgctgctatgctgacgagctaaaggaaggtttctacccatggattgatcaggtcgctccgacattagtcccgcttctgaaattctatttccatgaggaagtcaggaaagctgcggtttcagctatgccagagctgttacggtctgccaaactagctgtagagaaagggattgctcagggccgaaacgagacctacgtcaagcagttatccgactacataataccagctttggtggaagctttgcataaggagcctgatactgaaatatgtgcaagtatgttggatgcactaaatgagtgcctacagatatctggactactcttggatgaaggtcaagtccgaagcattgtggatgagattaagcaggtcatcacggccagttcaagtcgaacgagcgaacgagcagagagagcaaaagctgaagactttgatgccgaggaaggtgaattgctcagggaggaaaatgagcaagaagaagaagtgtttgaccaagttggtgaaatattgggtacactgatcaaaacattcaaggcagctttcttacccttcttcgatgagctctcatcatatctaatgcctatgtggggtaaggataaaacagctgaagaaaggagaatagcaatttgcatctttgatgatgttgcagagcagtgccgagaagcagctttaaagtattatgacacatatcttcctttccttttggaagcatgcaatgatgagagcccagatgtcagacaggctgctgtttatggacttggtgtatgtgcagaacatggtggctctgctttcaagtctttagtgggagaggttatgtcaaggctctatgttgttttaaggcatccaaatgctatacaacctgagaatataatggcctatgataatgttgtttcagaattagggaagatctccaattttcaccgtgatagtattgactctgcccaggttattcctgcctggctgaattgcctgcctataaaagatgacctgattgaagccaaggttgttcacgaccaactttgttcaatggtcgaaagatcagacagagaacttctgggtcccaacaatgagtaccttccaaaagttgttcaaatttttgctgaggtcctatgtgccggtagggatctggtaacagagcagactgctagtaggatgattacactgttgaggcagcttcagcaaacactgccaccagccaccttggcttcaatatggtcatccctgcagcctcaacagcagttaacactgcaatcaatgttatcatcataat

SEQ ID NO: 9008 - DNA, 4052 bp, Ricinus communis
cccttctctctctctctctctctctctctctctctctctcttactttgccctaatcagtgtttccttatattcccttttctctttcttttctccttcgctctttctctctattctctctttctcgcactaaaaagaaaaaaaaaaacacaaaacacaaaacacaaacaaaaacagaagagagagccaccacctatccaaaccctaaaacactcaaaccctagcctacagccatggacgagtcagctcagcaactccagctccaacaagcacagctcgctgccatcctcggccaagactcagctccattcgaaaccctgatttcatcgcttatgtcatcatcaaacgagcaacgatcacaagcagaagtcttattcaatctctgcaaacaaacagatccaaacactctttcactaaagctctctcacctcttacaattctcccctcacgtcgacgcacgtgccatgtctgccgtcctcctccgtaagcttctcacacgtgacaatcacgtggtcgtcgacaccgattcttcgtcttatctctggccacgcctctctctcgctactcaatcttcgattaaatctatcctcttaacttctattcaacatgaatcgaccaagtctattttgaaaaagctatgcgacaccgtttctgagcttgctgctaatattttacctgataatggttggcctgaattattgccgtttatgtttaattgtgtgtcgtctgattctgcgaaattgcaagaatcagcttttctgatttttgcgcagttgtctcagtatattggtgagagtttgattccttttattaaggacttgcatactgtgtttttacagtgtttgggttcatcgccgagttttgatgttaaaattgctgctttgaatgctgtgattaattttattcagtgtttgactagctccgctgatcgagataggtttcaggatttgttgcctgctatgatgagaaccttgactgaggctttaaataatggtaatgaagctacagctcaagaggctttagagcttttgattgaattagcaggtactgagccgaggtttttgaggaggcaattggtggatgtggttggttccatgttgcagattgccgaagcagagagtttagaagaagggactagacatttggcaatcgagtttgtgattaccttggcggaggcgagggagagagcgcctggaatgatgaggaagttaccacagtttataagtaggttgtttgcgattctaatgaggatgctgttggatattgaggatgatcctgcttggcatagtgcggaaaatgaggatgaagatgctggcgagacaagtaattatagtgttggacaagagtgtttagataggttggcaatttcattgggtgggaataccattgttcctgttgcgtctgaacagttgcctgcttatttggctgctcctgaatggcagaagcaccatgctgctcttattgctcttgctcaaattgctgagggttgttctaaggtaatgataaaaaatctggaacatgtagtgtcaatggttctgaactcattccatgatccccatcctcgtgtgagatgggcagctattaatgcaattggccagctgtctacagatttgggtccagatttgcaaaaccaataccatcaaaggatattgccagcactggcttctgcaatggatgatttccagaatcctcgagtacaggcacatgctgcttcagcagtgctcaacttcagtgagaactgtactccagagattttaacaccctatttagatggaatagtaagcaaattgcttgtactgctacagaatggaaaacaaatggtgcaagagggagctttaactgccttggcttcggttgctgattcatctcaggagcactttcagaaatactatgatgctgttatgccgtacctgaaaactattttagtgaatgcaacagacaagtctaaccgtatgcttcgtgccaaatccatggagtgcatcagtctagttgggatggctgttgggaaggataagtttagagaggatgctaagcaggttatggaggtcctgatgtctttgcaaggatctcaaatggagacagatgatccaacaacaagttacatgctacaaccagatgtaacaattacatcagcagattctgataatgatattgatgattcagatgatgaaagtatggagaccattacccttggagacaaaaggatagggatcaagaccagtgtgttggaagaaaaagcaactgcttgtaacatgttgtgctgctatgcggatgagcttaaggaagggttctttccatggattgatcaggttgccccaaccctcgtcccccttctgaaattttactttcatgaagaagttaggaaagcagctgtttcagccatgccggagctactgcgttctgcaaagttagctgtagagaaggggctgtctcaaggtcgcaatgagtcttatgtaaagcagttgtctgactatattattccagctctggttgaagcattacataaggaacccgatactgagatttgtgcgaatatgttggatgcattaaatgagtgcttacagatatctggaacacttgttgatgaaggtcaggtgcgatcaattgtggatgagataaaacaagtgatcacagctagttctagcaggaaaaaagagagagcagacagagccaaagctgaagattttgatgctgaggagggagagttgattaaagaagaaaacgagcaagaggaagaagtttttgaccaagtgggtgaaatcctgggaactttaatcaaaacatttaaagcctctttcttgcctttctttgatgagctatcgacctatctaactcctatgtggggcaaggataagactgctgaagaaagaaggattgcaatttgcatttttgatgatgttgcagagcaatgtcgtgagacagctcttaaatactatgatacgtatcttccattcctattagaggcttgcaacgatgaaaacccagatgttcgacaggcagctgtatatggacttggagtttgtgccgagtttggtggatcagtatttaaacctcttgttggcgaggccctttcgagactaaatgttgtgattcaacatcccaatgctaagcaatctgaaaatgtcatggcatatgataatgctgtttctgctttagggaaaatttgtcagttccatcgtgaaagtataaattcagctcagattgttccagcatggttaaactgtttgccaataacaggtgatttaattgaagcaaaagttgttcatgaacagctttgttcaatggtggagaggtcggacagtgaacttttgggtcccaacaatcagtatcttccaaaaattgtctcagtatttgctgaggttctttgtggtaaggatctggcaacagaacaaactgcaagccgaatggttaacctgttgaggcaccttcagcagactttacccccagcaacattggcttcaacttggtcattgttgcatccacagcaacaaatggcattacaatcgattctctcctcatagtggctggcagtaggcgtcatactggctctgggaaagatgcaaactccagtctctacgagtgagagtactatttattacccccccattcttttgcataagatggttctcccatcatttgtttttgcacgaaattctgcagcaacctcgcatcaagttttatagagtgtgaaagcccatcatcattgcgattgaagtgaaatcctttttttttttttttttttttgtagaatgtgtatattatttataagtgttaatttatagttgttctccaatcaagtcgatgaggaagaaaagaaaagtgtaggcatttgtggtttggtttcatatttcttatttcatttttgggttggcgcgtgaggtttgagggttgtcagtgaggcaattcttgtcgcagttttggtccattatggttctttttccttttcatacaaacttcctgattgtggttattgtatggattgaaattttgaatgtgattctttcattgtatttgtgattttgagtcattttctattgttgaaaatgattggact

SEQ ID NO: 9009 - DNA, 4054 bp, Mimulus guttatus
agagatagagagagagaggcacatacggacattctagagagagagagaaacaaggggatacatacagaggcgccacccctagcaaaaaccaaaaaccctagtctatcaactcggcgaatggattcggtgtcgactcaggtccagcaagcccaactggcggcggttatgggtcccgacccggcggcgttcgagaatttaatatccaatttgatgtcctcctccaacgaacagcgatcccaggccgagtcaatcttcaatttgctcaaacagaacgatccaaactcgctcgccctcaaactcgcccacgtcctttcatcgtcggtgcacctcgaggcgcgggccatggccacaatcctcctccggaagcagctgactcaggacgactcgtttatatggcccaaactcaacgaatcaacccgtttcacaatcaaaagtattctgttgtcctcaatccagaacgaggagtcgaaatctatcatcaaaaagctctgcgacaccatctcggagcttgcatcttcgctgttacccgaaaatcagtggcctgaactcttgcccttcatgtttcaatgtgtaacctccaattccccaaaattgcaggaatcagcattcttgatgttatcccaattagcccaattcataggagagatgttgattccttatattacagagttacacaacgtgtttttgaatgtgctgactaattcccgcgacccggatgtcaggattgcagctttgagcgccgtcattaattttatccagtgcttgtcaagctcgagcgaccgtgacaggttccaggatttgttgccgtctatgatgagtacgttgactgaagcattgaactcggggcaggaagctacagcacaggaggctttggagttgttgattgagttggccgggactgagccaaggtttctgcgcaggcagattgtagacattgtgggctcaatgttgcagatagccgaggccgagactttggaggaaggcacacgtcacctggccattgaatttgtaatcactctagcagaagcacgagaaagagcgcctgggatgatgcggaagttgcctcagttcattagcaggctttttgcgaatttgatgaagatgcttttggatgtggaagatgatccagattggcatagtgcggaggataaggatgaggatgcaggggagacaagtaattatagtgtagggcaggaatgtttagataggctctctatagcgcttggtgggaatacaattgttccagtggcgtctgagcagttgcctgcttatctgtctgctccagagtggcagaagcctcatgctacccttattgctcttgcgcaaattgcggagggttgttcgaaggtgatgattaagaatttggagcaagtgttgaacatggttttgagttcatttcaacatcctcatccacgtgtgagatgggcagctattaatgcaattggtcagctgtcaactgacttgggtccagatttgcaagtgcaataccatcaacaggtcctgccggcacttgcttcagctatggatgatttccaaaatcctcgagtgcaggcacatgcagcttcagctgtgcttaactttagtgaaaactgcaccccagaaattttgactccttatttggatgggatagtgcacaagttgcttctacttctgcagaactccaagcaaatggtgcaggagggtgccttgactgctttagcttcagttgccgattcgtctcaggaacacttccagaaatactatgatgcagttatgccttacttgaaagctatcttagtgaatgcaacagacaagtctaaccgtatgcttcgtgctaaagctatggagtgcatcagcttggttgggatggctgttggaaaggataaatttaaggaagatgctaaacaagttatggaagtgcttatgtcactacaaggggcgcaaatggaaacagacgatcccactaccagttacatgctacaggcatgggcaagactctgcaagtgcttagggcaggatttccttccttacatgaatgtggttatgcctccattgcttcagtctgctcagcttaagcctgatgtgatcattacatctgctgattcggacgacgaactcgatgaatctgatgatgaaagcatggagaccatcacccttggggataaaagaattgggattaagactagtgttctagaagaaaaggccactgcttgcaatatgctttgctgctatgctgatgagctgaaagaaggtttttacccgtggattgatcaggttgcccaaacgctggttcctttgttgaagttttatttccatgaagaagtcaggaaggctgctgtttcagctatgccggatctattgcggtctgctaaactggctgtggaaaaagggattgctcagggtcgtaatgagacatatattaagcagctgtctgactacatatttcctgctttagtagaagctttacataaggaaccggatacagatatatgcgcaaatatgttggacgcattgagtgaatgtctgcagatttctggaccacttctagatgagagtcaggttagaagtgttgtggatgagataaagctggttatcacagctagctcagatagaaaaaaagagagagctgaaagagccaaagctgaagattttgatgctgaggagggagaattgcttaaagaggaaaatgagcaagaggaagaagtatttgaccaagtgggtgagttgttgggaactttaatcaaaacatttaaggcttcctttctgccgttctttgatgaactgtcatcatacctaatgcctatgtggggaaaggataggacagctgaagagagaagaattgcaatttgcatatttgatgacgtagctgagcaatgccatggagcagctctaaagtactatgatacatatcttcctttcctattggaggcatgcaatgatgaaaatccagatgtccgacaggctgctgtgtatggactaggggtgtgtgcagagtatggaggttctgtatttaaaccacttgttggagagtctctttccaggctcaattttgttataaggcatcccaatgcgttgcagccagacaacgtgatggcatacgataatgccgtttcagctctggggaagatttgtcaatttcatcgtgacagcattgattcagctcaggtggttcctgcctggttgagttgcttgccaataaagggtgacatcatcgaagccaaagttgttcatgacctgctttgctcaatggttgagagttctgatagggaacttttgggtccgaacaatcagtatctccccaaaattgtttccgtatttgctgaggttctgtgctcgggcaatgatctagcctcacagcaaacatttagcaggatggtgaatttgttgaggcagctacagcagacactacctccatccactctggcctctacatggtcttccttgcagcctcagcagcagcttgcgttgcaatctatcctctcatcatagtttgtgccaatcttatatttatttgttcctcatttctttcggatgaggactcttttcagcatttcagtttgcatatggtttatgcgtcaatcaacctgtcgttgcgcgtttggtctcgagtgtgaatgcattttcacaagtcattttgtcgatagagtttgtatattaaaagatctttcttgctttcaaaacataattttgctctttgtcccccttttttggttgagagggttgggacgtttttaacgacattcatcctgggtgaacagatctcatttggcacttgtgaaattgaggtttgagaaagcaaacgatgtctgcagttttgtgaaatcatatgttccttggatgaacatatatggtaattttatatttttaatttgtcgactatgagttgggaataatggttttcgagtgagagaatataatacatggagtttaaggtttcatcttttgcctctagtacatgaattttaagcctcttgttttttctcaaactaaccgtatttggatctttactctgcgttgtcgattgttatacgagcatgaatgtttaatctaatatagttggtctttgatctttaaa

SEQ ID NO: 9010 - DNA, 3348 bp, Panax ginseng
aagcagtggtatcaacgcagagtacatgggggcgtgtgtatgagagagaaagagagagcgccacagccgtcacctcgagttgttgattcgccggccttgtcaacccaaaaaccgtaactcgccttcgcgatggatacttcacagtcgactcagattcagcaagctcaacttgtagcgattttggggcctgatcccgccccatttgaaaccctaatctctcacttgatggcctcttccaacgagcaaagatcgcaagccgaactgattttcaatctctgcaagcaatccgatccgaactcgctggttctgaaactctctcacctcctccagttctcccctcatgttgaagcccgtgccatgtccgctattctacttagaaaactgttgactcgtgatgactcgtacatatggcctcgattatctccttcaactcagtcatccctcaaatcgttcttcctctcttgcgttcaaagggaagaagccaaaacgattatcaaaaagctctgtgacaccatttcggaacttgcttctgggattttacccgacaatggatggccggagctcttacctttcatgttccaatgcgtatcgtcggattcacataagcttcaagaatccgcatttttaatcttcgcacaattgtctcagtacataggtgaaaccctgattccgcacataaagcacctacatactgtatttttacagtgtttgacgtcttcgtctagctcggatgtaagaattgcagcactcagtgcagttattaatttcattcagtgcttgtctagctccagcgaccgtgatcgctttcaggatttgttgcctgcgatgatgaggactttgacagaagcattgaattgtgggcaggaagccacagctcaggaagcattagaattaatgattgaattggctgggacagagccaaggtttttgaggaggcaattagtggaagtagtggggtccatgttgcaaattgcagaggctgaaactttagaagagggtacaagacatctggccattgagtttgtgattactcttgcagaggccagagagagagctcctggaatgatgaggaaattgccccagtttattagcaggttatttgcaattttgatgaagatgctgttagatattgaagatgatccggcgtggcatcttgcggatactgaggatgaggatgccggagagactagtaattacagtgttggacaggaatgtttggatcggttggccattgctttgggagggaatactattgttcctgttgcatcggagcagttgccggcttatttggctgccccagagtggcaaaaccatcatgctgcattaattgcacttgcacagattgctgaaggatgctcgaaggtgatgataaaaaatttggagcaagtggtaacaatggttcttaattcatttcaagacccctatgctcgagtaagatgggctgcaattaatgcaattgggcagttgtctacagatttgggaccggatttgcaagtacagtaccatcaaagggtgttgccagcactagctgctgccatggatgacttccagagtccgcgtgtgcaggcgcatgctgcttcggccgtgctcaatttcagtgagaactgtacaccagatatattaacgccttacttagatggaatagtgagcaagctgcttgtgcttctagagaatggcaaacaaatggtgcaggaaggtgccttgactgctctggcctctgtagctgactcatctcaggagcattttcaaaagtactatgatgcagttatgccctacttgaaagctatattggttaatgcaaatgacaaatctaaccgcatgcttcgtgcaaaagccatggaatgcattagtttggttggaatggctgttggaaaggagaagttcagggatgacgcgaagcaggtaatggaagtgcttatgtcattgcaaggatctcaaatggagaccgatgatcctactacaagctacatgctacaagcatgggcaagactttgcaagtgtttggggcaagatttccttccctatatgagtgtagtcatgcctcccttgcttcagtctgctcaactgaaacctgatgtgatcattacatctgcagattcagataatgaaattgatgaatctgatgatgacagcatggagaccatcactctaggcgataaaagaattgggatcaagactagcgtcctagaagagaaagctacagcttgtaacatgctttgttgctatgctgatgagttgaaggagggtttctatccatggattgatcaggttgccccaactttggttccgcttcttaaattttattttcatgaagaagtcaggaaagcagctgtttcagccatgccggagctgttgcgttctgcaaaattagctgtagagaaaggacttgctcagggtcgaaacgagtcttatattaaacagttgtctgactacataataccagctctggtcgaagctttacataaggaacctgatacagaaatctgtgcaaatatgttggatgccttgaatgaatgtgttcagatctctggaccaattttggatgaaggccaggtaagaagcattgtggatgagataaaacaggtgataacagccagttcaagtaggaaaaaggaaagagctgaaagggccaaagctgaagacttcgatgctgaggagggggagttgcttaaagaggaaaatgagcaagaagaagaagtttttgaccaagtcggtgaaattttgggaactttgatcaaaacattcaaagcctctttcttgcctttcttcgatgaggaagagaggaggattgccatatgtatctttgatgatgttgcagaacagtgccgtgaagcagctttgaagtattatgatacatatcttcctttccttttggaaggaagcaatgatgagaattcggatgtccgacaggcagccgtatatggacttggtgtttgtgcggaatatggcggttctgttttcaaaccacttgttggagaggctctttcaaggctgaatgttgtgataagacacccaaatgctttgcaaccagataatgtaatggcatatgataatgctgtttctgctctggggaaaatatgccagtttcatcgtgacagtattgattcagctcaggttcttcctgcctggttaagctgcttaccgataaaaggtgatctgattgaggccaaagttgttcatgaccaactttgttcaatggttgaaaggtcggatacagagcttttgggtcccaacaatcagtatctctctaaaatagtttcagtatttgcagaggtcctgtttgccggcaaggatcttgcaactgagcaaactgccagccgaatgattaatctgctgagacagctacag

SEQ ID NO: 9011 - DNA, 3509 bp, Trigonella foenum-graecum
aactcgcttctagtattttgccggataacggttggcctgaattgcttccgtttatgtttcagtgcgtttcgtctgattcaccaaagcttcaggaatctgcgtttttgatttttgctcaattgtcgcagtatattggtgattcactcacgccacatatcaaacaccttcacgatatatttcttcagtgtcttactagctctgcagttaatcctgatgtgagaattgctgctttgaatgctgttattaattttattcagtgtttatctggctccgccgatagagataggtttcaggatttgttaccggcgatgatggcgacgttgacagaggcattgaattcaggtcaggaggcaacagctcaagaggcacttgagttgcttattgagcttgcggggacggagcctaggtttttgaggaggcagattgttgatgttgttggggcaatgcttcaaattgcggaggcggagtctttagaagaagggactaggcatttggctattgagtttgtgattactcttgctgaagcgagggagcgtgctcctggtatgatgaggaagatgccacagtttattagtaggttgtttgctattcttatgaagatgcttttggatattgaggatgatccgcagtgtgccacgccggatgccgaggataacgatgctggtgaatctagtaattatagcgtcggacaggagtgtttggataggttatctatatctttgggaggaaatacgattgttcctgttgcttcggaacaattacctgcatatttggctgcacccgagtggcaaaaacgccatgctgcattgactgcgcttgctcagatagccgaaggaagctcaaaggtcatggttaaaaatttggagcaagtggtggctatggtattgaattcctttcctgatcaacatccccgtgtaaggtgggcagccattaatgcaattggacaactgtctactgatttgggtcctgatttgcaagttcaatatcatcaaggggtgatgccagccctagctgctgccatggatgattttcagaacccccgcgtacaggctcatggtgcttcagcagtgctcaacttcagtgagaattgcacacctgaaattttaacgccatacttggatggaatagttagcaaattgcttgtacttcttcagaatggtaaacaaatggtgcaagagggagccttaactgctttggcatcagttgctgattcgtctcaggaacacttccagaaatactatgatgctgtcataccctacctgaaggctatattggtcaatgcaactgacaagtctaaccgcatgcttcgtgccaagtctatggaatgcataagtttggttggaatggctgttgggaaggagaaatttagggctgatgctaagcaggtcatggaagttcttatgtccttgcaagtatcacaaatggagacagatgatccaacaacaagttacatgctacaggcatgggctagactctgcaagtgtttgggacaagattttcttccttatatggaatttgtcatgccaccattgcttcagtctgcttcacttaagcctgacgtaaccatcacatctgctgattcagacaatgatatagatgattctgatgatgaaagtatggagactatcactctcggggataaaagaattggaatcaaaactagtgttcttgaggaaaaagctacggcatgtaacatgctttgttgctatgctgatgagttgaaagaaggattctttccatggattgatcaggtggcaggaactttggttccactccttaaattttatttccacgaggaggttagaaaagctgctgtttcagcaatgccggagcttttgcgatctgcaaagttagccattgagaaagggcaatctcaaggtcgggatgtgagctatttgaagtttctgactgacagtatcatcccagctttggtggaagcgttgcataaggaacctgacacggaggtttgtgcatgtatgttggattcattaaatgaatgcttacagatctccgggatgcttttggatgaaaagcaggttagatcaatcgttgatgaggtaaaagaggtgatcacagctagttcaagtaggaaaaaagagagagcagagagggcccaagctgaagattttgatgctgaagagggggaactgattaaagaggaaaatgagcaggaggaagaagtttttgaccaagtgggtgagatattgggaaccttgatcaaaaccttcaaggcctccttcttgcctttctttgaagaactgtcatcttatttaacacctatgtggggaagggacaagacacctgaagagagaaggatcgcgatttgcatttttgatgatgttgcagagcagtgtcgtgaagcagcaattaagtattatgatacgtatcttccattcttgttggaggcatgtaatgatgaaactccagatgttagacaggcagcggtatatggcctcggtgtttgtgcagagtttgggggctctgtattcaaacctcttgttggagaggctctatcgaggttaaatgccgtgatccaacatcctaatgcgcttcattcagataatgtaatggcatatgacaatgcagtttctgctcttggaaaaatttgccaatttcaccaggacagtattgactctgcccaggtagttccggcatggttgaactgtctgccaataaaaggcgatttgattgaggccaaagttgttcacgatcaactttgttcgatggcggagaggtccgacagctctctgttaggcccaaacaatcaataccttcccaagatagttgcggtatttgcagaggttctatgtgctggtaaagacctcgcaacagaacaaacagctggccgaatggttagtttactcagacaactccagcaaacattaccgcccgctacccttgcttccacctggtcatctttgcagccgcaacaacagcttgctttacaatccatcctttcttcatagtttgatgtttgcaattcatcatttctccatagcatctgggttggcagttggtgtctcgcactttttggggaacaagctttttccagtttggtggtctctatatttgttacccattctttttgccataagatggtttccatcattcattcttgcatatggtgtttttatagcagcatggcttcagttttgagaatgcagagtcaattgtgaatgtgtatattgagtgttcatggtgcgattgagtctaaaaggaggttagacagttgttgcataggagcttcacgtgctattcctctttttatttgttctttattgcgtgagaatatagggttgtctgtggggcaattcttgcagttttggcctgttgtattgttttttttctttcttctttctgatatcagattctgaagtgtatcatatgaattaccgatgctatttatcaaggttgcagacattttgtttattcaattaataatttgtagtcaatcttatgttcctgaatatgtgatttatgtagtgtatatgaatggatcgtgtttggtt

SEQ ID NO: 9012 - DNA, 3806 bp, Solanum phureja
tcttctctacatccatatccacacatccgcctctctttactcattcgccatggctgccgagcaagctcaactggctgcaatccttggacctgattcagcaccattcgaaaccctaatttcacatctcatgtctgcttccaacgagcaacgatctcaagccgagtcaatcttcaatctcatcaagcaaaacgatcctaattcactcgctctcaagcttgctaatcttctctcctcttcacctcaccacgaagcccgtgccatgtccacaatcctcctcagaaagttgcttaccagagatgactctttcatctggccgcgcctcaccgagtctactcagtcaggtatcaaatcagtccttctccgatgtattcaacaggaagaatcaaaatccatcatcaagaagctttgcgacactatttccgaacttgcttcttcaattctccccgaaaacaattggcctgagttgttaccgtttatgtttcagtgtgttacttcagacgtacctaaattacaggaatctgccttcttgatctttgctttattagctcaatatgttggggagatgttagttccttacattaaggacttgcatacagtgtttatgcagacattgaataactcgcctaatcctgatgtgaggattgcgggtttaagtgctgtgattaattttattcagtgtttatcaagctcaaatgacagggatagatttcaggatctattgcctgcaatgatgaagaccttgaccgaggctttgaatagtggacaagaggcaactgcacaagaagccttggagttgttgattgaattggcgggtactgagcctaggtttttgaggaggcagcttgtcgatgtggtgggtgcaatgttgcaaatagccgaggccgagagtttagaagaggggacaagacatttggctattgaatttgttattacgttggccgaggctagggaaagggctcctggaatgatgaggaaattgccgcagtttatcagtaggctgtttgccattttgatgaaaatgttgctggatatcgatgatgaacctgtctggcatagtgctgaagttgagcacgaagatgcaggggaaacaagtaactacagtgttggtcaggagtgtttggatcgtttgtccattgcgttgggtggcagtacaattgttcctgttgcgtcagagcagttgcctccttacttggctgctcccgaatggcaaaagcaccatgctgcgctcattgcgcttgctcagattgccgaaggttgtacaaaggtaatgattaagaatttggagcaagtcgtgaacatggttttgagctgtttccaagatcctcatcctcgagtgagatgggcagctattaatgcaattggccagttgtctactgacttggggcctgatttgcaagtacagtaccacagcagagtactgccagcattggcaacagctatggatgattttcaaaatccacgagtacaggcacatgctgcgtcagctgtcctcaacttcagtgagaactgcacaccagaaattttgacaccttatttggatggaatagttagcaaactacttgttcttttacagaacggaaaacaaatggtgcaagaaggagcattaactgctttggcttcggtggctgattcatcacaggagcacttccagaagtactatgacgctgtaatgccatatttgaaaaccatcctggtaaatgcgaatgataaatctaatcgcatgcttcgagccaaagctatggagtgcataagcttggttgggatggctgttggaaaagacaaattcagagatgatgctaagcaggttatggaagtgcttatgtcactacaaggatcacaaatggagacagatgaccctactactagttatatgttgcaggcatgggccaggctttgcaagtgcttgggacaggatttcctgccttacatgagtgtagtcatgcctcctttacttctgtctgctcaactaaagcctgatgtgaccatatcatccgcagattcagacaatgaacttgatgactcagatgatgacagcatggagaccataactcttggagataaaaggataggcatcaaaacaagcgtcttagaagagaaggctacagcttgtaatatgctatgctgctatgccgatgaactgaaggaaggtttctatccatggattgatcaggttgctccaacgttagttccacttctcaaattctatttccacgaagaagtcaggaaagcagccgtgtctgcaatgccagagctgttacgttctgctaaactggctgtagagaaagggattgctcagggccgaaatgagacctatgtcaagcaattatcagactacatcattccagctttggttgaagcattgcataaggagcctgatacagaaatctgtgcaagtatgttggatgcattgaatgagtgtgttcagatctctggaccactcctggatgaaggtcaggtccgaagcattgtggatgagataaaacaggttatcacagccagttcaagtaggaaacgagaacgtgcagagagggctaaagctgaagacttcgatgcagaggaaagtgagttgctcaaggaggaaaatgagcaagaagaagaagtttttgaccaagttggtgaaatattgggcacattgattaagacgttcaaggcagtcttcttgccattctttgatgaactgtcatcttatctaatgcctatgtggggcaaggataaaacagctgaagaaaggagaattgcaatttgtatttttgatgacattgctgagcagtgccgtgaagcagctcttaagtattatgacacatatcttcctttccttttggaagcatgcaatgacgaaagcccggatgtccggcaggctgctgtttatggacttggggtatgtgcagaatatgggggttctgttatcaaacctcttgttggagaggctctatcaaggctcaacgtagttatagggcatcccaatgctcttcaacctgagaatgttatggcatatgataatgctgtttcagcactggggaagatatgtcagtttcatcgcgacagtattgactcagcccaggttgttcctgcttggttgaattgcctgcctataaaaggtgacctgatcgaggccaaggttgttcatgatcaactctgttcaatggttgaaaggtcagatgtagatcttctgggtcctaacaatcagtaccttccaaaaattgtatcagtttttgctgaggttctatgtactggtaaggaccttgctactgagcaaacagccagtaggatgattaatctgctgaggcagcttcagcaaacattaccaccagccactctggcctcaacatggtcttccttgcagcctcagcagcagatagcactgcaatccattctatcatcataggtgttttggatcatgacaatctccaatgcaatggaagttgctaggctgaagcttggtgggtttcaaatatttgattattaattctttcttgcaaacattattcatttgggcttttgaggtcatgcatcagcctgttgtcactttggatgaaggagtgagcaaaggcgggaaaccctttcctctttttgtagagtgtgtatagtaaaagtgttgcatttgagtcctccttcagtaaggataggactgttggtgatcacggtttgctgagtttttttttgtcatcaaatgagttttaagctcaagggtcgtcagggagacactcttgtcacagttttggtccagtcatattggaattatttacattgtgggatggtacaaggattaaattataaatggtgattatttgttgctttggttgtga

SEQ ID NO: 9013 - DNA, 3533 bp, Flaveria ramosissima
catgttattacatccaacgagcaaccgatcgcaagcagagcttatattcaatctgtacaaacaaactgatccgaactcgctgtttcttcaaactcggttatttgctccagctatcgcctcacatggaagctcgtgcgatgtcagcgattctgctcaggaagcagttgactcaggacgagttgttggtgcggaacaggttgtctccggcgactcagtcgtcgctgaaatctaatctgttaacttgtgtgcagcaagaggaggcgaagacgattatgaagaagttgtgtgatacgatatcggaattggcttcgagtttgttgccggataacggttggccggagttggtgccgtttatgtttcagtgtgtttcgtctgattctgttaagcttcaggagtctgcgttttttatatttgctcaattgtcacagtacattggggagagtttgactccgcatataaagcatcttcatggggtgtttttgcagtgtttgactacttcccccagttctgatgtgaggattgctgctttgaatgcggtgattaattttattcagtgtttggcttctggtgatagagataggtttcaggatctgcttcctgcgatgatgacgacgttgaccgaggcgttgaatggcgggcaagaggctactgctcaagaggcgttggagttgttgattgagttggctgggactgagcccaggttcttgaggaggcagttagttgaggtggttgggtctatgctgcagatagcggaggctgagacgttagaagaggggactagacacttggcaattgagtttgtgataactctagccgaagctcgggagagggcacctggtatgatgaggaaactgccacagtttataagcaggttgtttgggattttgttgcgtatgttgttggatgttgaggatgaacccgcttggcatacggccgaaaatgaggatgaggatgcaggagagtccagtaattattgtgttggtcaggagtgtcttgatcggttggctattgctttaggtgggaatacgattgttccagttgcatccgagcagttaccagcatatcttgccgctcctgaatggcagaaacgtcatgctgctcttatatctcttgcgcaaatagctgaaggatgttcaaaggtgatgatcaagaatttggagcaagtgttgtcaatggttttaaattcgtttcaagatccacacccacgcgtgagatgggctgcaattaatgcaattgggcaattggccacagatttaggcccagacttgcaagtccaataccaccaaagagtgcttccagctctagcaaccgccatggatgactttaataatccacgagttcaggcacatgctgcttcagcagtgctaaatttcagtgaaagctgcacccctgatattttaacaccttacttggatggaatagtgagcaaattgcttgtattgttacagaacggtaaacaaatggtacaagaaggggccttgactgctctagcatcggttgctgattcatcacaggaacacttccaaaaatattatgatgctgttattccttatcttaaagctatattagtgaatgctaatgataaagctaatcgtatgcttcgagctaaagccatggaatgcattagtttggttggaatggctgttgggaaggaaaagtttagagatgatgctaaacaggtgatggaagtgctcatgtcgttgcaaggttctcaaatggagactgatgatcccaccaccagttacatgctacaagcgtgggcccgactatgcaagtgtctaggacaggacttcctcccttatatgagtgttgttatgcctcctttgcttcagtctgctcaactcaaacctgatgtcatcattacatcggcagattcagataatgagattgatgattcagatgatgaaagcatggagacaattactcttggtgataaaagaatagggatcaagactagtgttctagaggagaaagcaactgcttgcaacatgttgtgttgttacgcagatgagttaaaggagggtttttatccatggattgatcaggttgccccaatcttggtgccacttctcaagttctacttccatgaagaagttaggaaagcggctgtttctgccatgcctgagttgttgcggtctgcaaagttagccatagagaaagggcttgcccaaggtcgtaatgaatcttatataaaacagctgtctgactacatagttcctgctctggttgaagctttgcataaggaacctgatacagaaatctgtgcaagtatgttggttgctttaaatgaatgtatacaggtatctgggccactgttagatgaaaaccaagtgagaagcatagtggatgagatcaaacaggtaatcacagcaagttcaagtagaaaaacagaaagagcagaaagggctaaggctgaagattttgatgctgaggaaggagaattgcttaaagaggaaaatgagcaagaagaagaagtctttgatgggatcagtgaaatactgggaacattaataaaaacatttaaagcctcctttctacctttctttgatgagatgtcatcatatttgatgcctatgtggggcaaggacaaaacggctgaagaaaggaggattgctatctgcatctttgatgatgtggcagagcagtgtcgtgaagcagctctaaagtattatgacacatatcttccttttcttcttgaagcgtgcaatgatgagaatccagatgttcgacaggcagctgtatatggacttggagtatgcgcagaatatggtggttctgtaataaaaccacttgttggagaggctctatcaaggctaaatgttgtaattagacaccctaacgcgctccagcctgaaaatgtgatggcatatgataatgctatttctgctttggcgaaaatatgtcaatttcatcgtgatagtatcaacaccactcagattatttcagcatggttaagctgtttgccaatcaaaggggatttaattgaggctaaagttgttcatgagctgctttgttcgatggttgaaaggtcagacatggaacttctgggccccaacaatcaaaatgtgcctaaaattgtttctgtatttgccgagattctttgtggcggtaaggatcttgcaacagaacaaaccattaaccgaataatcaacccactgagacaacttcaacaaacactgccacccgccacctttgcatcaacgtgggcgtctctacagccacagcagcaacttgcaatacaatccgtccttacatcataactcatcatccgtcatatatacatatacacacacaagaagcatctcgaagcacctgcttctcattctctgtggaaatcgctgtttgtttttaaacttgtcacccattctattatgacatatgatcatttttgagcttgatatcacgcaacaaccttggacggttgtgtggttgagtgagcaaaatgtgaagaaaaagatgtatgtttgatatttcttttgtatattgtactactattggttgtaaggttaatggtcggtcggtcggtcaccaag

SEQ ID NO: 9014 - DNA, 3476 bp, Gossypium hirsutum
acgtttccactcattcctctatcaaatctgtgctcttgaatcaaatccaagtcgaaactgctcaatctttgtctaaaaagttatgcgatactgtttcggagcttgcttctagtattttgccggagaacggatggccagagctgttgccgtttatgtttcaatgtgtttcttccgattcccctagattacaggagtctgcttttttgatatttgcgcagttgagtcagtatattggtgatgtgttgactcctttcataaaggatctgcacactgttttcttgaagtgtttgagtggaaattctaatgcggatgtcaaaatcgcggccttgaatgcggttatcaattttattcagtgcttgaccagctcatctgatcgggataggtttcaggatcttttaccagcaatgatgaagaccttgacggaggctttgaataacgggaatgaggctacggctcaggaggcgctagagttgttgattgagttggcagagatggagcctcggtttcttaggaggcagattgttgatgtggtgggttctatgctgcagattgcggaggcagaatcacttgaggaaggaactcgtcacttggcaattgaatttgtagttaccttggcagaggccagggaacgggctcccggaatgatgaggaagctgcctcagtttattagtagattatttgcaatattgatgagattgttgcttgatattgaggatgacgcagcgtggcacactgcagaagttgaggatgaggatgctggagaaactagcaattacgctgtgggacaggaatgtttggatcgtctagcaatttccttaggtggaaatactattgttcctgttgcatctgagcaattttcaacttatttagctgctcctgagtggcaaaagcatcatgctgcgttgattgcccttgcacagattgccgagggttgttccaaggttatggttaaaaatctggaacaagtggtttctatggttttgaactcctttaaccattctcatccccgtgtgaggtgggcagctattaatgcaatcgggcaattgtctaccgacttgggtcctgatttgcagaaccaatatcaccaaagagtattgcctgccttagcagcggctatggatgacttccaaaatcctagagtacaggcccatgctgcttcagctgtgctcaacttcagtgagaattgcactccagaaattttaacaccttacttagatggaattgttagcaaattgcttgtacttttacagaatgggaaacaaatggtgcaagaaggggccttgactgcattggcatcagttgctgactcatctcaggagcacttccaaaaatactatgatgcggttatgccttacctgaaagctatcttggtgaatgcaactgacaaatctaatcgtatgcttcgtgccaaatccatggagtgtattagtcttgttggaatggctgttggaaaggagaagttcagagatgatgctaagcaggttatggaagtgctaatgtcattgcaaggatcccaaatggaaacagatgacccgacaacaagttacatgctgcaagcatgggccagactttgcaagtgtttgggacaagacttcctcccttacatgagtgttgtcatgcctccccttctccagtctgctcaactgaagccagatgtgactattacatctgcagattcagataatgatatcgaggactctgatgatgaaagtatggaaaccattaccctcggggataaaagaattgggatcaagactagcgtcctggaggaaaaggcaacagcatgtaacatgctttgttgctatgctgatgagttgaaggaaggattttttccttggattgatcaggttgccccgactctagttcctcttcttaaattttatttccacgaagaagttagaaaagctgctgtttcagctatgccagagttattgcgttctgcaaaattagctgtggagaagggaatggctcaagggcgtaatgagacctatgtaaagcaattgtctgattacgttattccggctctagtggaggcattgcataaggaacctgatacggaaatatgtgcaagcatgttagatgcattgaatgaatgtgtacagatctctggtcctctgctagatgaaagtcaagttaggtctattgtggatgagataaagcaagtaatcacagctagtgctagcagaaaaagtgagagagctgaaagagccaaagctgaagactttgatgctgaggagggagagttgattaaagaggaaaatgaacaagaggaagaagtttttgaccaagtgggtgaaatcttgggaactttgatcaaaacatttaaagcctctttcctgcctttctttgatgagctatcttcttatcttactcctatgtggggcaaagataagacacctgaagaaagaagaattgcaatatgtatttttgatgatgttgccgaacagtgtcgtgaggcagctttaaaatattatgacacatatcttcctttcatattggaggcttgcaatgatgagaacccagatgtgcgacaggctgcagtatatgggcttggtgtttgtgcagaatttggtggacctgtatttaagccacttgttggagaggctttatcaaggttaaatgctgtaattcgacatcctaatgcttcgcaacctgaaaatgttatggcatatgataatgctgtttctgctttgggaaaaatatgtctgttccaccgagacagtattgatgcaactcaggttgttcctgcatggttaaactgcctgccaataaaaggtgatctgattgaagccaaagttgttcatgaacaactttgttcaatggttgagaggtccgacaatgaagttttgggtcccaaccataatttccttcctaagattgtttcagtttttgctgaggttttatgtggtaaggatttagccacagaacaaaccgcaagtaggatggtgaatctactgaggcaacttcaacagactttaccaccagcagcattggcttcaactttatcatctttgcagccgcaacaacagcttgctttacaatccatcctctcctcctagttaatattggctcaatactcatccgtcttgtgcatcaatatgcatatatttattttatataccaaattcttttcacggagaaggttccctttgtttttgcatcatgttctttttactccctcggtgattgaaatgaactttcctccccagatatataaattttatagaatgtgtatatcatgaaagtatctatttatggaacaagaagcgagagtggtgattcgtgtggttggtgagcatattttttgtgttaaaaaagtgcatttaggtttgagaagtcgatgttcttgtagcagttttggtctcatgtgtgtctcttcgtttcaaattttacagagaatttggattgtaattctttcattatgcttgcaatttggatcataaaaaagaacaataatattatgtgttgtcggtttt

SEQ ID NO: 9015 - DNA, 3213 bp, Nicotiana benthamiana
catgaattccgagtcaactcagtatcaacaagcccagctggccgccatactgggagccgacccggcaccattcgagaccctaatctcccacctcatgtcaacctccaacgagcaacgatcccaagctgagtcaatcttcaacctcatcaagcagaacgatcctaattcactttctctcaaactcgccaatcttctcacttcctccccacacatcaagccccgtgctatgtccgctatcctccttcgtaaactgctaactcgtgacgactccttcatctggcccaaactcaccgagtctactcggtccagtattaagtctgtcctcctcacatgtatccagcgtgaagaatccaaatcgattatcaagaaattatgcgacaccgtttccgagctcgcttcgtccattctgcgggaaaatcaatggcctgaactgctgccgttcatgtttcagtgtgtcaccggcgattcacctaagttacaggagtctgcatttctgatatttgctaaattagcacaatatatcggtgagattttggtcccatatataaaagatttgcattcggtgttcctgcagacactgaataattcccccaatccggatgtgaggattgcggcattaagtgctgtcatcaatttcatacagtgtttatccagctcaagcgagagggatagatttcaggatctattgcctgctatgatgaaaacattgaccgaggccttgaacagtggtcaagaggctacagcacaagaagcattggagttgttgattgaattagcagggactgagcctaggtacttgaggagacagctcgtggatgtagtagcggctatgttgcaggtagctgaggcggagagcctagaggaggggacaaggcatttggcaattgaatttgtgattaccttggccgagtctagggaacgtgctccaggaatgatgaggaaattgccgcagtttattagtaggttgtttgctattttgatgaagatgttattagatgttgaggatgaagctgtttggcatagtgctgaagctgagcatgaggatgcaggggaaacgagtaactatagtgtggggcaggagtgtttggataggttagctattgcattgggtggtaacactattgttcctgttgcttcagaacagttaccttcttacttggctgcacctgaatggcagaagcaccatggtgctctcattgcccttgctcagattgctgaaggttgttccaaggtgatgattaagaatttggagcaagtggtcaacatggttctcaattctttccaggatcctcatcctcgagtgaggtgggcagctattaatgcaattggccagttgtcaaccgacctgggtccagatttgcaagttcaatatcatagccgtgtattgccagcactagctgcagctatggacgatttccaaaatccacgaatacaggcacattctgcatcagctgtcctcaacttcagtgagaactgcacgccagaaattctgacaccttatctagatggaatagttagcaaacttcttgtacttctgcagaatggcaatcaaatggtgcaagagggagcattaactgctttggcttccgtagctgattcatcccaggagcacttccagaagtactatgatgctgtaatgccgtatttgaaaactatccttgtaaatgcaactgataaatctaatcgcatgcttcgagccaaagccatggagtgcataagtctggtagggatggctgtaggaaaagataaattcagagatgacgcaaagcaggttatggaagtgcttatgtcattgcaaggatcacaaatggagacagatgaccctactactagttacatgctacaggcttgggccagactttgcaagtgcttgggacaggatttccttccatacatgagtgtagtcatgcctcctttgcttcaatctgctcaactaaagcctgatgtgaccatatcatctgcagattctgacaatgaacttgatgattcagatgacgatagcatggagaccataactcttggggataaaaggataggcatcaaaacaagtgtcctagaggagaaggctacagcttgtaatatgctatgctgctatgctgatgagctaaaggaagggttctacccgtggattgaccaggtcgctcctacattagttccgcttctgaaattctatttccatgaggaagtcaggaaagctgcagtttcagctatgccggagctgttacggtctgctaaactggctgtagagaaagggattgctcagggccgaaatgagtcctacgtcaagcagttatccgattacatagtaccagctttggtgcaggctttgcataaggagcctgatactgaaatatgtgcaagtatgttggatgcattgaatgagtgcctgcagatatctggaccactcctggatgaagggcaggtccgaagcattgtggatgagataaagcaggtcatcacggccagttcaagtcgaaagagagaacgggcagagagagcaaaagctgaagactttgatgcggaggagagtgaactgctcagggaggaaaatgagcaagaagaagaagtatttgaccaagttggtgaaatattgggtacactaatcaaaacattcaaggcagctttcttgcccttctttgatgagctctcatcatatctaatgcctatgtggggcaaggataaaacagctgaagaacggagaatagcaatttgtatctttgatgatgttgcagagcagtgccatgaagcagctttaaagtattatgacacatatcttcctttccttttggaagcatgcaatgatgagagcccggatgtcagacaggctgctgtatatggacttggtgtatgtgcagaatatggtggctctgttttcaagtctctagtaggagaggctctgtcaaggctcaatgttgttttaaggcatccaaatgctctacattctgagaatgtaatggcatatgacaatgctgtttcagcattagggaagatatgtaattttcatcgtgacagcattgactcggcccaggttattcctgcttggttgaattccctaccgataaaaggtgacctgatcgaagccaaggttgttcacgaccaactttgttcaatggtcgaaaggtattggaccgtttgctgtaacttgtatcctgttcataggttatggatcaaagatgtcaatcaatttgttggtggtgttaagctatagttgtc

SEQ ID NO: 9016 - DNA, 3041 bp, Panax ginseng
agcaaagatcgcaagccgaagtcattttcaatctctgcaagcaaaccgatcccaactcgctcgttctcaaactcgctcagctcctccagttctcccctcatgttgaagcccgagccatgtccgcaattctactcagaaagcagttgactcgtgatgactcgtacatatggccccggttgtctccttcaactcagtcatcgctcaaatcgatcttccttgcttgcgttcaacgcgaagaagctaagactataattaagaagctttgcgatactgtttcggagctcgcctccgggattttaccggacaatggatggacggagctattgccttttatgtttcaatgcgtatcgtccgattcgcataagcttcaggaatctgcatttttgatatttgcccaattgtctcagtacataggtgaaacactaattccccacataaaacacctgcatactgtgtttttacagtgtttgactacttcgtcgagctcggatgtgaggattgcggcgcttagtgctgttattaatttcattcagtgcttgtctagctccagcgaccgtgatcgtttccaggatttattgcctgcgatgatgagtactttgacggaagcattgaattgtgggcaggagccaacagctcaagaagctttagaattgatgattgaattggctgggacagaaccaaggtttttgaggaggcaattagtggaagtagtggggtctatgttgcaaattgcagaggcggaaactctagaagaagggacaagacatttagctattgagtttgtaattactcttgccgaggccagggagagggcacctggaatgatgaggaaattgccccagtttattagtaggttattcgcaattttgatgaagatgttgttagatgttgaagatgatccggcgtggcatactgcagatactgaggatgaggatgccggagagactagtaattatagtgttgggcaggagtgtttggataggttggccatagctttgggagggaatactattgttcctgttgcatcggagcagttgccagcttatttggctgcccctgaatggcaaaaacatcatgctgcattaattgcacttgcgcagattgcagaaggatgctcgaaggtgatgataaaaaacttggagcaagtggtaaccatggtattaaattcatttcaagatccccatgctcgagtacgatgggctgctattaatgcgattggacaattatctactgatttgggaccagacttgcaagttcagtaccatcaaagggtgctgccagcactagctgcagctatggatgacttcccgaatccgcgtgtacaggctcacgcggcttcagctgtgctcaatttcagtgagaactgtaccccagatatattaacgccttacttggatggaatagtgagcaagctacttgtgcttctacagaatggcaagcaaatggtgcaagaaggggccttgactgctttagcctctgttgctgattcatctcaggagcatttccaaaaatattatgatgccgttatgccctacttgaaagctatattggtgaatgcaaatgacaaatccaaccgcatgcttcgcgccaaagccatggaatgcattagtttggtaggaatggctgttggaaaggataagttcagggatgatgctaagcaggtaatggaagtgcttatgtcactgcaaggatctcaaatggagactgatgatcctactacaagctacatgctacaagcatgggcaagactttgcaagtgcttggggcaggatttccttccttatatgagtgtagtcatgcctccattgcttcagtctgctcaacttaaacctgatgtgatcattacatctgcagattcagataatgaaattgatgaatctgatgatgaaagcatggagaccatcactttaggtgataaaagaattgggatcaagactagcgtcctagaggagaaagctacagcttgtaacatgctatgttgctatgctgatgagctgaaggagggtttctacccatggattgatcaggttgccccaactttggttccacttcttaaattttattttcatgaagaagtcaggaaagcagctgtttcagccatgccggagctgttgcgttctgccaaattagctgtagagaaaggacttgctcagggtcgaaatgagtcttatattaagcagttgtccgactacataataccagctctggtggaagctttacataaggaacctgatacagaaatctgcgcaagtatgttggatgccttgaatgaatgcgttcagatctctggaccaattttggatgaaagtcaggtgagaagcattgtggacgagataaaacaggtgataacagccagttctagtaggaaaagagaacgaacagagagggccaaagctgaagactttgatgcggaggagggggagttgcttaaagaggaaaatgagcaagaagaagaagtttttgaccaagtcggtgaaattttaggaaccttgatcaaaacattcaaagcctctttcttacctttctttgatgagctatcttcatatctaatgcctatgtggggtaaggacaaaacggcagaagagaggaggattgcaatttgcatctttgatgatgttgcagaacagtgccatgaagcagctctgaagtattatgatacatatcttcctttccttttggaagcatgcaatgacgaaagcccggatgtccgacaggcagccgtatatggacttggtatttgcgctgagtatggtagttctgtttttaaaccactcgttggagaggctttatcaaggttaaatgttgttataaggcatccaaatgcgttgcaaccagagaatgtaatggcatgtgataatgctgtttctgctttggggaaatatgccaatttcatcgagacagtattgattcagctcaggttcttcctgcctggttaagctgcttgcctataaaaggtgatctgattgaggccaaagttgtccatgaccaactttgttcaatggttgaaaggtcagatgcagagcttttgggtcccaagaatc

SEQ ID NO: 9017 - DNA, 3126 bp, Echinacea purpurea
accaccacattcaccgtcaccggaaaccaccaccgtcaccgcccgctactcctatggatcctcagctccagcaagcacaactggcggcgatactcggagccgatccagcgccgttcgaaaccctaatttctcatcttatgtcctcatcgaacgagcaacgatcgaacgcagagctgttatttaatttatgcaaacaaactgatccgaatacgttgtttctcaaacttggtcacatgctgcaaggctctcctcatatggaagctcgtgccatgtcagcagttctgttacggaagcagttaactcaagatgattcgttgatatggaacaggttatctcccgcgactcattcttcacttaaatctatactgttgagttgtgtgcagcgggaagaagcgaagacgataatgaagaagttgtgtgatacgatatcggaattagcttcgactattttaccggataatggatggccggagctgttgccgtttatgtttcagtgtgtttcgtctgattcgcctaagctgcaggagtctgctttcttgatctttgcacagttgtctcagtcgcagtacgtaggggcgagtttaattccgcatataaaacatcttcatgatgtgtttttgcagtgtttgactacatctggaagtgcagatgtacgaattgctgctttgagtgcggttattaattttatccagtgtttatctagctccggggaccgagatcggtttcaggatttgcttccagcgatgatgaggacgctgactgaatcgttgaatggcggacaagaggctacggctcaggaggcattggagttgttgattgaattggctggaacagaaccaaggtttttgaggaggcagttagtggaggtggttgggtctatgttgcaaatagctgaggcggagacgttagaagaggggacaagacatttagcaattgagtttgtgataactctagcagaagctagggagagggcacctggtatgatgagaaaactgccacagtttataagtagattgtttggcattttgttgcggatgctgttggatattgaggatgaacctgcatggcatacggcggaaaatgaggatgaggatgcgggagagtcgagtaattatagtgttggccaggaatgtttggatcggttagctattgctctaggtgggaatacaattgttcctgttgcatccgaacagttgccggcttacttggctgctcctgaatggcagaaacatcatgctgctcttattgctcttgcacagatagccgagggatgctcaaaggtgatgatcaagaatttggagcaagtggtttcaatggttttaaattcattccaagatcctcatccacgtgtgaggtgggctgcaattaatgcaatcggacaattggctacagatttaggcccagacttgcaagttcaataccaccaaagagtgctaccagctttagctagtgcaatggatgactttaataatccgcgagttcaggcacatgctgcttcagccgtgctaaattttagtgagaactgcacccctgatatcttggccccttacttggatggaatagtgagcaagttgcttgtattgttacagaacggtaagcaaatggtacaagaaggggccttgactgctctagcatctgttgctgattcatcacaggaacaattccagaagtactacgacgcggttatgccttatttaaaaactatattagttagtgcaaatgataaagctaatcgcatgcttcgagctaaagccatggaatgcattagtttggttggaatggctgtcgggaaggaaaaatttagagatgatgctaagcaggtgatggaagtgctgatgtcattgcaagggtctcaaatggagaccgatgatcccaccaccagttacatgcttcaagcgtgggcccggctatgcaagtgcctaggacaagacttcctcccttatatgagtgttgttatgcctcctttgcttcaatctgctcaacttaaacctgatgttgtaatcacctcagcagaatcagataatgagattgacgaatcagatgatgaaagtatggagacgatcacacttggtgataaaaggatagggatcaaaaccagcgttctagaggagaaagcaaccgcatgcaacatgttatgttgttatgctgatgagttaaaagagggtttttacccatggattgatcaggttgcaccaacgttggtaccacttctcaagttttatttccatgaagaagttaggaaagcagctgtttcagccatgccggagttgttgcgatctgcaaaattagccatagaaaaagggcttgctcaaggtcgtaatgaatcatatatcaaacagctgtctgattacatagttccctctttggttgaagctttgcataaggaacccgatacagaaatctgtgcaagtatgctggatgctctaaatgaatgcatacaggtatctggaccgcttctagatgaaaatcaggtgaaaagcattgtggatgagataaaacaggtaataacagcaagttcaagtagaaaaacagaaagagcagaaagggctaaagccgaagattttgatgctgaggaaggagaattgcttaaagaggaaaatgagcaagaagaagaagtctttgaccaggttggtgaaatcttgggaacattgattaaaacattcaaagtctccttcctgcctttctttgatgagatgtcgtcatatttgatgccgatgtggggcaaggataaaacagcggaagagaggaggattgcaatctgcatctttgatgacgtggcagagcagtgtcgtgaagcagctctgaagtattatgatacatatcttccttttcttcttgaagcgtgcaatgacgagaatccagatgttcgacaggcagctgtatatggtcttggagtgtgtgcagaatatggtggttctgctataaagccccttgttggagaggctttatcaaggctaaatgttgtaattagacaccctaacgctctccagcctgaaaatgtgatggcatatgataacgctgtttctgctttggggaaaatatgtcaatttcatcgtgacagcattgattccgctcagattgttcctgcatggttaagttgtttgccaatcaaaggagatcttattg

SEQ ID NO: 9018 - DNA, 731 bp, Glycine max
taaatatgatagatattattatttattgaatttcatggtcctttgtttgcgggtgtctgagagactgagacagtgatatggcgtatctgagattctcacacgcagcaccacagccacacctcacactagggtttccttcaccacctcaatttctctctattgctgctccaaaattctctccctcgtcttctaccatcaggtgcaaaggttttagtagattgatagtgaatcagaggctggtgactgtttttgcaacaaatcccaactctgtaggtgaaaaatcacccacagaaggatcagatgtaaatgaaactagcaatgctgctcaaggacctcctctccttactattctggctggattctttgtcctttttgttgtttgttggagcatttggtccattataacgtggctgataagtttaatagttaatgtacctgctccaaaataaattttattgtaatgtttgtttgtattttaagccactgcactagtccttgtgctcttggtcatagttttctttttatgcatttggacttgatagtatatttgagtggtaaaaattctgaagtgagccaaaagcaggataaaaaacctgagccctgaggaattggcaaagcctaatatatttgttctgggagagcttatggtaaccctccttttattttgggtaactaaagttaacatatatttgcgcttactttgtgtgcatattaacatgggtgtcttttag

SEQ ID NO: 9019 - DNA, 705 bp, Glycine max
tattattatttattgaatttcatggtcctttgtttgcgggtgtctgagagactgagacagtgatatggcgtatctgagattctcacacgcagcaccacagccacacctcacactagggtttccttcaccacctcaatttctctctattgctgctccaaaattctctccctcgtcttctaccatcaggtgcaaaggttttagtagattgatagtgaatcagaggctggtgactgtttttgcaacaaatcccaactctgtaggtgaaaaatcacccacagaaggatcagatgtaaatgaaactagcaatgctgctcaaggacctcctctccttactattctggctggattctttgtcctttttgttgtttgttggagcatttggtccattataacgtggctgataagtttaatagttaatgtacctgctccaaaataaattttattgtaatgtttgtttgtattttaagccactgcactagtccttgtgctcttggtcatagttttctttttatgcatttggacttgatagtatatttgagtggtaaaaattctgaagtgagccaaaagcaggataaaaaacctgagccctgaggaattggcaaagcctaatatatttgttctgggagagcttatggtaaccctccttttattttgggtaactaaagttaacatatatttgcgcttactttgtgtgcatattaacat

SEQ ID NO: 9020 - DNA, 2874 bp, Glycine max
aaaaaatgttaacccttatcagttattatcactgttagaggcttagagcatcctcatttatattttcagatttgtgtttcattacattttgtatgttctgttttgaaaaagtccatgtcatgcaacaagagagagagagattgatgaaaagggaagaaggagaagacgtagccaagggacaagaagagtatcactctagaaggtagccttaaacactccgaacaagtttgtaacgttggcagtactacactacacaccagtgtcccctattattgcccatgattaccctgccaccaacatagagaatccttccccactcactgcaatcacaatcaccgccaccacttctgattctatcaccatgtctagggtttctgcgaattcttctccttcacgcttagtctccatggcttccatcgtcagagcctacacgctccctattcttctcttcgccggagccatgttctaccagctcttccttattcccaatgcctttcctccttctcattacgatgttctgcaaattgagagctatagttcagtcgagaaagtgaaggaggcctacgacaaacttgaatctaaatggaattctgctgtggaagtttttgatattcatgagtttttaaagattcgatatgcttatgagttgctgacaaatcctttatggaaaagagactatgacatatttggtattgatgaacaacttcatattgttgagagtgccagcaagcgttatgcagggaaacatatttcagaattggatttccctttactacaggccccctctggatctatagatcattcttctaaagtcattacagctagtgacttccagtatatatttccagatgcaaagccatggctaattcagttgtattcatcagggagtgaacgttgtgctcaattttccaagtcatggaataagattgcttctttattggatgtttttgccaacattggtatggtggaacttggtgagaaggagctcgccatataccttgctgatagaagatcaacaggaaaaccattttttagaaatggaattccatctcttgttgccattcccgcaggatgtcgatcttctaaatgtattattaggtttgatggtgagcttactgttgacacggttacaaattggtttgcaacaactgtattggctttacctcaaattaactactactctagggaatcactggtgccaaattttcttggtaaaactagccttcataaggtaaaagtaatctttttctcaaattctggtgagcgtgctgctccatttatacgacaagcagctaaagactattgggcttctgcttcatttgctttcattctctggcgagaagaggaatcttcctattggtggggagcatttggggtggaatctgcacctgctattgtatttcttaaagacccaggtgtcaaacctgttgttcaccatggttcagtcaacaattcattttttttgaatttgatggaaaataataaacagcaagagcttcctcaactaaggagtgtgacatcaatggagctaggctgtgatcctcatggctattctcgtgctggttatgatacagtaacatggtattgtgctattgcagtaggaaggccgagtctggagttgaacaaaatgcgtgaaactatgtgcagggtccaagaaacattgtctaagcatagccaggtggatgcatcatctgaaaatcaatccttagctccagctgtggatgcatttaagagaaggcggttgacatttgcttggcttgatggtgaaaagcaaaaggattactgccaattttaccttggtcaagcggctagcgaacacacttgtggccaacgacggggtgtgactgatattcctcggttatttgttattcgatacctgaggaatagtagtgctgttgatttgagaacagaagaaaagacaaagtggaaatcattactggtccaagatctaatcaatgattctgatcagacaggccagtttgtagctgggtacaagggagaagatgatgtttcacagataacccactggcttgcaaatattatttctgatggtgactccagggacttgccattctttacactacgaactcctaagcttgttccggatgacacagaacctatttggtccatgtctgcacaaaatattcctttgcaaaatctgaagcagagtgttctcggtgttcttagtggactctctgcataccgtgaggatccaagagttggtccgtttttgcttctaggtgcattaatttctttgggaactatctggctgcgaaggagccaacaagttcagtcacctgaattaaaccaacctagtttcaatcaaccatctgattcaaaccaaccaagtcaacctagttccatggatgaaagaaaacagaaaccgagcgaccgggttcggagacggccaaataaaaaaccacccccatctatgacagatttggaaccgtcagatgcttaccagatgccactatcagattctgaatctgagtagtttcagtttggtttctccatgaaggaaatgagcttttcaagagataatgttacacggtctgaactctgaaggtgaaactattcaattgtgttattggtttggagccagatatacaagattgccatcatgtcaacatgagattaggaggcacataccccttatgccagagatttcatgaataaaagaatgaaacatgtttatattatatatgggaatttgactgttctaaacgtaaatttgtttaatatttcgattgtaggatatttatttattcatgccagtcaattcattaagccggatactttaaccaaatttgagaggcttacccaatgaagataaaattacgtgacctgtgaaaattttatcattcgtaattcatt

SEQ ID NO: 9021 - DNA, 2787 bp, Glycine max
ctgttttgaaaaagtccatgtcatgcaacaagagagagagagattgatgaaaagggaagaaggagaagacgtagccaagggacaagaagagtatcactctagaaggtagccttaaacactccgaacaagtttgtaacgttggcagtactacactacacaccagtgtcccctattattgcccatgattaccctgccaccaacatagagaatccttccccactcactgcaatcacaatcaccgccaccacttctgattctatcaccatgtctagggtttctgcgaattcttctccttcacgcttagtctccatggcttccatcgtcagagcctacacgctccctattcttctcttcgccggagccatgttctaccagctcttccttattcccaatgcctttcctccttctcattacgatgttctgcaaattgagagctatagttcagtcgagaaagtgaaggaggcctacgacaaacttgaatctaaatggaattctgctgtggaagtttttgatattcatgagtttttaaagattcgatatgcttatgagttgctgacaaatcctttatggaaaagagactatgacatatttggtattgatgaacaacttcatattgttgagagtgccagcaagcgttatgcagggaaacatatttcagaattggatttccctttactacaggccccctctggatctatagatcattcttctaaagtcattacagctagtgacttccagtatatatttccagatgcaaagccatggctaattcagttgtattcatcagggagtgaacgttgtgctcaattttccaagtcatggaataagattgcttctttattggatgtttttgccaacattggtatggtggaacttggtgagaaggagctcgccatataccttgctgatagaagatcaacaggaaaaccattttttagaaatggaattccatctcttgttgccattcccgcaggatgtcgatcttctaaatgtattattaggtttgatggtgagcttactgttgacacggttacaaattggtttgcaacaactgtattggctttacctcaaattaactactactctagggaatcactggtgccaaattttcttggtaaaactagccttcataaggtaaaagtaatctttttctcaaattctggtgagcgtgctgctccatttatacgacaagcagctaaagactattgggcttctgcttcatttgctttcattctctggcgagaagaggaatcttcctattggtggggagcatttggggtggaatctgcacctgctattgtatttcttaaagacccaggtgtcaaacctgttgttcaccatggttcagtcaacaattcattttttttgaatttgatggaaaataataaacagcaagagcttcctcaactaaggagtgtgacatcaatggagctaggctgtgatcctcatggctattctcgtgctggttatgatacagtaacatggtattgtgctattgcagtaggaaggccgagtctggagttgaacaaaatgcgtgaaactatgtgcagggtccaagaaacattgtctaagcatagccaggtggatgcatcatctgaaaatcaatccttagctccagctgtggatgcatttaagagaaggcggttgacatttgcttggcttgatggtgaaaagcaaaaggattactgccaattttaccttggtcaagcggctagcgaacacacttgtggccaacgacggggtgtgactgatattcctcggttatttgttattcgatacctgaggaatagtagtgctgttgatttgagaacagaagaaaagacaaagtggaaatcattactggtccaagatctaatcaatgattctgatcagacaggccagtttgtagctgggtacaagggagaagatgatgtttcacagataacccactggcttgcaaatattatttctgatggtgactccagggacttgccattctttacactacgaactcctaagcttgttccggatgacacagaacctatttggtccatgtctgcacaaaatattcctttgcaaaatctgaagcagagtgttctcggtgttcttagtggactctctgcataccgtgaggatccaagagttggtccgtttttgcttctaggtgcattaatttctttgggaactatctggctgcgaaggagccaacaagttcagtcacctgaattaaaccaacctagtttcaatcaaccatctgattcaaaccaaccaagtcaacctagttccatggatgaaagaaaacagaaaccgagcgaccgggttcggagacggccaaataaaaaaccacccccatctatgacagatttggaaccgtcagatgcttaccagatgccactatcagattctgaatctgagtagtttcagtttggtttctccatgaaggaaatgagcttttcaagagataatgttacacggtctgaactctgaaggtgaaactattcaattgtgttattggtttggagccagatatacaagattgccatcatgtcaacatgagattaggaggcacataccccttatgccagagatttcatgaataaaagaatgaaacatgtttatattatatatgggaatttgactgttctaaacgtaaatttgtttaatatttcgattgtaggatatttatttattcatgccagtcaattcattaagccggatactttaaccaaatttgagaggcttacccaatgaagataaaattacatgacctgtgaaaattttatcattcgtaattcatttgtagaacac

SEQ ID NO: 9022 - DNA, 2519 bp, Glycine max
attttatctatttcagtgttggacaataaacggcagtcgtttaagcgtttgaattgctctccacgcaacgcagtgctttcctcaacctttccattcccgtttaaaccctagcagagggttttagctcgcgccacacgaagcttctccatgatccatttcgaaggcgcattctaagccatggctgcttcaaagttaacctcatgcgtggcggtaacttccgccgcggtggtttccatgtccgccttctccgatcgtgcctacgccgattcttacttccgactccctttcttctcctctaaaccttccaatgaaccctcgccgccgaaccagacctccgactccaagtccgagcctccgccgcccgatgaacctaacaaatcgggtggcttcgacccggaatccttagaaagaggagccaaagcactccgtgaaatcaatagttctccctactccaagcagctgttcgatttaatgcgaaaacaggaggaaactcgcctcgctgaattagatgctgagaaagttcattacgaacttattcaatctcaaggagatattgaaaggcagcgtaaaatggctgaagaacagcgcaatctaatacaagaccaagcccagagacaggcccaggtgttgcgatatgaagatgagttggcaaggaaaagaatgcagacagatcatgaagcccaaaggcaacataatgttgaattggtcaagatgcaagagcagtcttctttcagaaaggagcaggcaagacaggctactgaagaacagattcaatctcagcagcgtcagactgagagagagagagctgaaattgaaagagaaactattagagttaaggcaatggcggaggctgaaggccgagcccatgaagcaaaattgaccgaggatcataacaggagaatgcttatagaacgaatgcaaggtgaaagagataaatggcttgctgcaattaacacaacctttagtcatattgaaggtggtctaagggccttattgactgatagggacaaattgcttatgactgttggaggagctactgcactagctgcaggaatatatacgactagagaaggtagtaaagtcacctggggctatattaatcggattttggggcagccatcgctgatccgggagtcatctatggcaaagtttcctgggtcagagatcatttctcaagccaaaaacaaagtgctgtgtaatagtactttggctggggcagaaaagcctattgggagtaaaaatggtcttggaaatgtaatccttcatccatcattgcagagaagaatagagcatcttgcacgtgcaacatcaaataccaaatcccatcaggcaccatttcgtaacatgcttttttatgggcctcctggcactggtaaaacgatggttgcaaaggaattagctagaagatcgggtttgcattatgccatgatgactggaggagatgttgcacctcttggcgcacaggctgttaccaaaattcatgatatatttgattgggccaagaaatcaagaaaaggcctattgctttttattgatgaggcggatgctttcctttgcgagcgtaacagctcccacatgagtgaagctcaacgaagtgctctaaatgcattgctcttcagaactggtgatcagtctagagacatagtacttgtcctggcgacaaacaggcctggtgatcttgatagtgcagttactgatcgcattgatgaagtaattgaattcccacttccaggagaggaagagcgtctaaagttgttgaagctctatttgaacaaatatttatgtgatgacaataatggctccaaggggggtttcttcctgaagaagcaacctcagaagattaccataaaagatttatctgaagatgttttcagagaggctgccaagaaaacagagggattttctggccgcgagatcgccaaactcatggccagcgtccaagctgctgtttatgggcgcccagactgcatcttggatgcccagttgtttagagaaattgtagattacaaggtcgtggaacatcatcaacgattaaaactagcagctgaaggtggccagccttgccaaatataaatttgagcattttatttgcatccccattttgacctgctatgttagtgtttttgtcatgttatttgggccatgtggccgatgaggcagattcgttgaaaaagctacacctagatgcattttgtgagccaaatttgcaggatacttcggctttattaattattactttgttaggaatataggaggaggggctttagcctttaattacttggaagcagcatatcagaaccttttcacctcatcctatagagcaagaagccaggtttttgagagcatagaagtcaaattacatttattaataaatttatagaatatgctcaaagttgtaattttttttatttttttttgcgaattttatttcttctaaattccaatgaagattctaccaaatttgaatatgctaaatattttttttcttaaatatgattattatcttgttatctatttaa

SEQ ID NO: 9023 - DNA, 2486 bp, Glycine max
aaacggcagtcgtttaagcgtttgaattgctctccacgcaacgcagtgctttcctcaacctttccattcccgtttaaaccctagcagagggttttagctcgcgccacacgaagcttctccatgatccatttcgaaggcgcattctaagccatggctgcttcaaagttaacctcatgcgtggcggtaacttccgccgcggtggtttccatgtccgccttctccgatcgtgcctacgccgattcttacttccgactccctttcttctcctctaaaccttccaatgaaccctcgccgccgaaccagacctccgactccaagtccgagcctccgccgcccgatgaacctaacaaatcgggtggcttcgacccggaatccttagaaagaggagccaaagcactccgtgaaatcaatagttctccctactccaagcagctgttcgatttaatgcgaaaacaggaggaaactcgcctcgctgaattagatgctgagaaagttcattacgaacttattcaatctcaaggagatattgaaaggcagcgtaaaatggctgaagaacagcgcaatctaatacaagaccaagcccagagacaggcccaggtgttgcgatatgaagatgagttggcaaggaaaagaatgcagacagatcatgaagcccaaaggcaacataatgttgaattggtcaagatgcaagagcagtcttctttcagaaaggagcaggcaagacaggctactgaagaacagattcaatctcagcagcgtcagactgagagagagagagctgaaattgaaagagaaactattagagttaaggcaatggcggaggctgaaggccgagcccatgaagcaaaattgaccgaggatcataacaggagaatgcttatagaacgaatgcaaggtgaaagagataaatggcttgctgcaattaacacaacctttagtcatattgaaggtggtctaagggccttattgactgatagggacaaattgcttatgactgttggaggagctactgcactagctgcaggaatatatacgactagagaaggtagtaaagtcacctggggctatattaatcggattttggggcagccatcgctgatccgggagtcatctatggcaaagtttcctgggtcagagatcatttctcaagccaaaaacaaagtgctgtgtaatagtactttggctggggcagaaaagcctattgggagtaaaaatggtcttggaaatgtaatccttcatccatcattgcagagaagaatagagcatcttgcacgtgcaacatcaaataccaaatcccatcaggcaccatttcgtaacatgcttttttatgggcctcctggcactggtaaaacgatggttgcaaaggaattagctagaagatcgggtttgcattatgccatgatgactggaggagatgttgcacctcttggcgcacaggctgttaccaaaattcatgatatatttgattgggccaagaaatcaagaaaaggcctattgctttttattgatgaggcggatgctttcctttgcgagcgtaacagctcccacatgagtgaagctcaacgaagtgctctaaatgcattgctcttcagaactggtgatcagtctagagacatagtacttgtcctggcgacaaacaggcctggtgatcttgatagtgcagttactgatcgcattgatgaagtaattgaattcccacttccaggagaggaagagcgtctaaagttgttgaagctctatttgaacaaatatttatgtgatgacaataatggctccaaggggggtttcttcctgaagaagcaacctcagaagattaccataaaagatttatctgaagatgttttcagagaggctgccaagaaaacagagggattttctggccgcgagatcgccaaactcatggccagcgtccaagctgctgtttatgggcgcccagactgcatcttggatgcccagttgtttagagaaattgtagattacaaggtcgtggaacatcatcaacgattaaaactagcagctgaaggtggccagccttgccaaatataaatttgagcattttatttgcatccccattttgacctgctatgttagtgtttttgtcatgttatttgggccatgtggccgatgaggcagattcgttgaaaaagctacacctagatgcattttgtgagccaaatttgcaggatacttcggctttattaattattactttgttaggaatataggaggaggggctttagcctttaattacttggaagcagcatatcagaaccttttcacctcatcctatagagcaagaagccaggtttttgagagcatagaagtcaaattacatttattaataaatttatagaatatgctcaaagttgtaattttttttatttttttttgcgaattttatttcttctaaattccaatgaagattctaccaaatttgaatatgctaaatattttttttcttaaatatgattattatcttgttatct

SEQ ID NO: 9024 - DNA, 2396 bp, Cajanus cajan
tttccatttccgtttaaaccctagcagagggtttaagctcgcgccacgcagcgaactatagcaaacaacactaaccttcttcatgatccattcggaagccgcattctaagccatggccgcttcaaggttaacctcatgcgtcgccgtaacatccgccgcggtgctttccatgtccaccttctccgatcgcgcctccgccgactcttcctttcgattccctttcttcagttcttcaccttccaatgcgccgccgccgccgccgccgagccaggcctccgacggcaagtccgagcctccgccgcccgacgaacctaacaagtcgggtttcgacccggaatcgttggaaagaggagccaaagctctccgccaaatcaatagttctccctacgccaaacaggtgtttgatttaatgcggaaacaagaggaaactcgccttgctgaaatagatgctgagaaagttcattacgaacttattcagtctcaaggagatattgaaaggcagcggaaaatggctgaagaacaacgcaacctaatacaggagcaagcgcagagacaggcccaggtgatgcgatatgaagatgaattggcaaggaaaagaatgcagacagatcatgaagcccaaaggcgacataatgttgaattggtcaagatgcaagagcagtcttctgtaagaaaggagcaggcaagacaggctactgaagaacagattcaatctcagcagcgtcaaactgagagagagagagctgaaatagaaagagaaactattagagttaaggcaatggcagaggctgaaggccgagcccatgaagcaaaattgactgaggatcataacaggagaatgcttatagaacgaatgcaaggtgaaagggataaatggcttgctgcaattaatacaacttttagtcatattgaaggtggtgtaagggccttgttgacagatagggataaattgcttatgactgttggaggagctactgcactagctgcaggggtatacacgactagagaaggtgctaaagtcacttggggctatattaatcggattttggggcagccatcactgatccgggaatcatccatggcaaaatttccagggtcaaagattatttctcaagccaaaaataaagttctaaataatagtagtttggctggggcagaaaagcctattgggagtagaaatggtcttggaaatgtaatcctacatccatcattgaagagaagaatagagcatcttgcacgtgcaacatcaaataccaaatcccatcaggcaccatttcgtaacatgctcttttatgggcctcctggcaccggtaaaacgatggttgcaagggaaatagctagaagatcgggtttggattatgccatgatgaccggaggagatgttgcacctctgggcgcacaggctgttaccaaaattcatgagatatttgattgggccaagaaatctagaaaaggcctactactttttatagacgaggcagatgctttcctttgcgagcgtaacagctcacacatgagtgaagctcaacgaagtgctctaaatgcattgctcttcagaaccggtgatcagtctagagacatagtacttgtccttgcgacaaacagaccaggtgatctcgatagtgcagttattgatcgtattgatgaagtgattgaattcccgcttccaggagaagaggaacgtctaaagttattgaagctctatttaaacaagtaccttcgcgatgacaacgatggctccaaagggggcttcttgctgaagaagcagccccagagaattaccataaaagatttacccgaagatgttttcagagaggctgccaggaaaacagagggattttctggccgagagatcgccaaactcatggctagcgtccaagctgctgtctatgggcgtccagactgcatcttggattcccagttgtttaaagaaattgtagattacaaggtggtggaacatcatcaacgattaaaactcgcagctgaaggtggccagcctggccaagtataatttgtttgagcatttatttgaatctccattgaagcttgctatgcgagttttttggttcttcgtattatttttgtcagtatttatggcagatgaagcagattcgttaaaaatacttcacctagatggattttgtgagccaaatttacaggatacttcggctttattaattattaggaatataggaggctctaatgacttggaaacagcattcaagcagtaccattccaattcatgctatggaacaagatgccaggtctttttgagagcatgggagtcaaatttccttgattaataaacttatagaatatgctcaacgatgtaacttaaatttgcattttttatgaatttgtttgttatgatttcaaataaagggtatgctaatttt

SEQ ID NO: 9025 - DNA, 2420 bp, Glycine max
gttttatcagtggttggagaataaacgacagtcgtttaagcgtttgatttgttctccaagcaacgccttcctctaccttttctttgccgtttaaaccctagcagagggtttaagctcgcgccacacgaagcttctccatgatccatttggaaggcgcattctaagccatggctgcttcaaggttaacctcatgcgtggcggtaacttccgctgcggtggtttccatgtccaccttctccgatcgtgcctacgccgattcttactttcgactcccgttcttctcttctaaatcttccagtgagccctcgccgccgaatcagccctctgactccaattccgagcctccgccgcccgatgaacctaacaaatcgggtttcgacccggaatcgttagaaagaggagccaaagctctccgcgaaatcaatagttctccctactccaagcagctgtttgatttaatgcgaaaacaggaggaaactcgcctcgctgaattagatgctgagaaagtgcattacgaacttattcaatctcaaggagatattgaaaggcagcgtaaaatggctgaagaacaacgcaatcttatacaggaccaagcccagagacaggcccaggtgttgcgatatgaagatgaattggcaaggaaaagattgcagacagatcatgaagcccaaaggcaacataatgttgaattggtcaagatgcaagagcagtcttctttcagaaaggagcaggcaagacaggctactgaagaacagattcaatctcagcagcgtcagactgagagggagagagctgaaatagaaagagaaactattagagttaaggcaatggcagaggctgaaggccgagcccatgaagcaaaattgactgaggatcataacaggagaatgcttatagaacgaatgcaaggtgaaagagataaatggcttgctgcaattaacacaacttttagtcatattgaagggggcctaagggccttattgactgatagggacaaattgcttatgactgttggaggagctactgcactagctgcaggaatatatatgactagagaaggtagtaaagtcacttggggctatattaatcggattttggggcagccatctctgatccgggaatcatctatggcaaagtttcctgggtcaaagatcatttctcaagccaaaaataaagttctacatgatagtactttggctggggcagaaaagcctattgggagtaaaaatggtcttggaaatgtaatccttcatccatcgttgcagagaagaatagagcatcttgcacgtgcaacatcaaataccaaatcccatcaggcaccatttcgtaacatgcttttttacgggtctcctggcactggtaaaacgatggttgcaagagaaatagctagaagatcgggtttggattatgccatgatgactggaggagatgttgcacctctgggcgcacaggctgttaccaaaattcatgatatatttgattggtccaagaaatcaagaaaaggcctattgctttttattgatgaggcagatgctttcctttgcgagcgtaacagctcccacatgagtgaagctcaacgaagtgctctaaatgcattgctcttcagaactggtgatcagtctagagacatagtacttgtccttgccacaaacaggccaggtgatcttgatagtgcagttactgatcgcattgatgaagtgattgaattcccgctaccaggagaggaagagcgtctaaagttgttgaagctctatttgaacaagtatttatgtgatgacaataatggctccaaggggggtttctttctgaagaagcagcctcagaagatttccataaaagatttatctgaagatgttttcagagaggctgccacgaaaacagagggattttctggtcgtgagatcgccaaactcatggccagcgtccaagctgctgtctatgggcgcccagactgcatcttggattcccagttgtttagagaaagtatagattacaaggtcgtggaacatcatcaacgattaaaactagcagctgatggccaaatataatttgtttgagcattttatttgcatccccattttgacctgctatgtgagtttttttgttcatgttatttgggccattgtggctgatgaagcatatttttgtgagccgaatttgcaggatacttcggctttattaattattactttattaggaataggaagcttttagccttcagttacttggaagcagcattcaatcagaacctttccacttcatgctatagagcaagaagccaggtttttaagagcatagaagtcaaattacacttattaacaaatatatagaatatgctcaaagttgtaatttaaatttttatttttttgtgaattttatttcttctaaattccaatgaagattcaacctgtctctgtaat

SEQ ID NO: 9026 - DNA, 2387 bp, Glycine max
gtttaagcgtttgatttgttctccaagcaacgccttcctctaccttttctttgccgtttaaaccctagcagagggtttaagctcgcgccacacgaagcttctccatgatccatttggaaggcgcattctaagccatggctgcttcaaggttaacctcatgcgtggcggtaacttccgctgcggtggtttccatgtccaccttctccgatcgtgcctacgccgattcttactttcgactcccgttcttctcttctaaatcttccagtgagccctcgccgccgaatcagccctctgactccaattccgagcctccgccgcccgatgaacctaacaaatcgggtttcgacccggaatcgttagaaagaggagccaaagctctccgcgaaatcaatagttctccctactccaagcagctgtttgatttaatgcgaaaacaggaggaaactcgcctcgctgaattagatgctgagaaagtgcattacgaacttattcaatctcaaggagatattgaaaggcagcgtaaaatggctgaagaacaacgcaatcttatacaggaccaagcccagagacaggcccaggtgttgcgatatgaagatgaattggcaaggaaaagattgcagacagatcatgaagcccaaaggcaacataatgttgaattggtcaagatgcaagagcagtcttctttcagaaaggagcaggcaagacaggctactgaagaacagattcaatctcagcagcgtcagactgagagggagagagctgaaatagaaagagaaactattagagttaaggcaatggcagaggctgaaggccgagcccatgaagcaaaattgactgaggatcataacaggagaatgcttatagaacgaatgcaaggtgaaagagataaatggcttgctgcaattaacacaacttttagtcatattgaagggggcctaagggccttattgactgatagggacaaattgcttatgactgttggaggagctactgcactagctgcaggaatatatatgactagagaaggtagtaaagtcacttggggctatattaatcggattttggggcagccatctctgatccgggaatcatctatggcaaagtttcctgggtcaaagatcatttctcaagccaaaaataaagttctacatgatagtactttggctggggcagaaaagcctattgggagtaaaaatggtcttggaaatgtaatccttcatccatcgttgcagagaagaatagagcatcttgcacgtgcaacatcaaataccaaatcccatcaggcaccatttcgtaacatgcttttttacgggtctcctggcactggtaaaacgatggttgcaagagaaatagctagaagatcgggtttggattatgccatgatgactggaggagatgttgcacctctgggcgcacaggctgttaccaaaattcatgatatatttgattggtccaagaaatcaagaaaaggcctattgctttttattgatgaggcagatgctttcctttgcgagcgtaacagctcccacatgagtgaagctcaacgaagtgctctaaatgcattgctcttcagaactggtgatcagtctagagacatagtacttgtccttgccacaaacaggccaggtgatcttgatagtgcagttactgatcgcattgatgaagtgattgaattcccgctaccaggagaggaagagcgtctaaagttgttgaagctctatttgaacaagtatttatgtgatgacaataatggctccaaggggggtttctttctgaagaagcagcctcagaagatttccataaaagatttatctgaagatgttttcagagaggctgccacgaaaacagagggattttctggtcgtgagatcgccaaactcatggccagcgtccaagctgctgtctatgggcgcccagactgcatcttggattcccagttgtttagagaaagtatagattacaaggtcgtggaacatcatcaacgattaaaactagcagctgatggccaaatataatttgtttgagcattttatttgcatccccattttgacctgctatgtgagtttttttgttcatgttatttgggccattgtggctgatgaagcatatttttgtgagccgaatttgcaggatacttcggctttattaattattactttattaggaataggaagcttttagccttcagttacttggaagcagcattcaatcagaacctttccacttcatgctatagagcaagaagccaggtttttaagagcatagaagtcaaattacacttattaacaaatatatagaatatgctcaaagttgtaatttaaatttttatttttttgtgaattttatttcttctaaattccaatgaagattcaacctgtctctgtaat

SEQ ID NO: 9027 - DNA, 2543 bp, Cicer arietinum
gtcgtttcaagtatttgaattgctctccacgctacgacacaaatttctcttccatttccgttaaaccctagctgagggtttaagctcgcgccacatcgtaaaccaccaaacttcttcatgatccattttcaaagcgcattatagtttctaattccaaatccatggccgccgctagattaacctcatgcgtggccgtgacagctgctgcggtggcttctatatccacatcatccgatcgtgcttacgccgaatcctactttcgtttcccttttttctcttcctcaccttccggttcgccgtcgtcgacggacccagcatctgactccaagtcggagtctccgccgccggaggattctaagaagtcggggtttgatcctgaatcgttagaaagaggtgcaaaagctctccgtgaaatcaataattctacccacgctaaaaaggtgtttgatttaatgcataaacaggaaaaaactcgccttgctgagctagaagctgaaaaagtttattatgaacttattcaggctcaaggagatattgacaggctgcgtaaagtgattgaagaacaacggaatctagaacaagagaaggcccagaggcaggctcaggtgttgcgatatgaagatgaattggcaaggaaaagaatgcagacagttcatgaagatcaaaggcgacataatgttgagttggtcaagatgcaagaggaatcttccgtaagaaaggagcaggcaagacaggctactgaagaacaaattcaatctcagaagcgtcagactgagagagagagagctgaaattgaaagagaaaccattagagttaagaaaatggcagaggctgaagcccgagcccatgaggcaaaattgaccgaggatcataaccggagaatgcttatagaacgaatgcagggtgaaagagataaatggcttgctgcaattaacacaacttttagtcatattgaaggtggtctaagggtcttgttgaccgatagggacaaattgctaatgaccgttggaggagctactgcattagctgcaggagtatatacgacaagagaaggtgcaaaagttacatggggctatattaatcggattttggggcagccatcattgatccgggaatcatccatggcaaagtttccaggagcaaggatcatgtctctagccaaaaataaactttcaaattatagtaccttggccagggcagaaaagcctgctgggagtcaaaatggtcttggaaatgttatcttgcatccatcattgcagagaagaatacagcatctagcacgggcaacatcaaatactaaggcccatcaggcaccatttcgcaacatgcttttttatgggcctcctgggactggtaaaaccatggttgcaagggaaatagcgaggaaatcgggtttggattatgcaatgatgactggaggagatgttgcacctctgggcccacaggctgttaccaaaattcatgagatatttgattgggccaagaaatctagaagaggcttattgctttttatcgatgaggccgatgcttttctgtgcgagcgaaacagctcacacatgagtgaagctcaacgaagtgctctaaatgcattgcttttcagaactggtgatcagtctagagacatagtacttgtccttgccacaaacagaccgggagatcttgatagcgcaattaccgatcgtattgatgaagtgattgaattcccgcttccaggagaggaggaacgtcttaagttattgaacctctatttgaacaagtatctatgtgatgaaactaatggatccaagggtggtttatttcttaagaagcaggcccagaagattaccataaaagatttatccgaagatgtgctaagagaggctgccaagaaaatagagggattttctggccgtgagattgccaaactcgtggccagcatccaagctgctgtttatgggcgccccgactgcaccttggattctcagttgtttaaagaaattgtagattacaaggtggtggaacatcatcaacggataaaactggcagctgaaggcgttctccctgcctgatcaaatgtaacctgttccagcttgttacttctgaattcccattaacatctgctcttggagtttacttctggatacctttgttaatcttgttatttgtgccatcatttgtggcccgaagcgtattccttttaaaatttcgctgagatgcattttgtgatccaaatttatagcatattttagctatattaattgctaggagtgagaggctttaattacatggaagtagcattccagcagaacctgttgccttcatgctatatatggagcaagaagccaggtcctgagagcggagaagtcaattatgaaattaaatttataaaatatgctcgaaattgtaatttaaatttgcattttgtttttaatgagtttcgttgaattccaataatctgtatgaatggatatgctgaataattctttattttttgctagaatatatttgttatctatatggtcactcttcttacattttaaactactacgcaattatctgtgttc

SEQ ID NO: 9028 - DNA, 2512 bp, Lupinus angustifolius
tggtgtcattgttcgggtaataaaacgacgccgttttactttccggtttaaaccctagcaagaggttttacttgatgcaacgcaaaacaaagaagctaactacgtttcttccgtcattgatgatccgttttgaaggcgaattctaatccatggtctccgctaagttatcatcatgcgttgcggtggcggcggccgccgttgcttccgtctcacccccctctgatactgcacacgccgccggcttccgtatccctttcttctcttcttcaccttccccttccgcgccggaccaggcttccgacaataagacggaccctactccgtccgatgaaccaaacaagtcgggttttgacccggaatcgttggaaagagctgccaaagctctccgtaaaatcaatagttctccatatgccaaacaggtgtttgacgtaatgcgaaagcaggagcaaactcgtcttgctgagttagatgctgagaaaattcattatgaacttattcagtcccaacaagatattgataggacgcgtaaaattgctgaagaacaacgtaacctaatacaagagcaagcacaaagacaggctcaggtgcagcggtatgaagatgaattggcaaggaaaagaatgcagacggatcatgaagctcaaaggcatcataatgttgaattggtcaagttgcaagaggagtcttctgtaagaaaggagcaggcaagacgggctactgaagaacaggttcagtctcagcagcgtcaaactgaaagagagagagctgaaatagaaagagaaaccattagagttaaggcaatggcagaggctgaggcccgagcccacgaagcaaaattgactgaggatcataaaaggagaatgcttttcgagcgaatgcaaggtgaaagagataaatggcttgcagcaattaacacaacttttagtcatatcgaaggtggtttaagggtcttgttgacagatagagataaattgattatgactgttggaggagctactgcattagctgcaggagtatatacaactagagaaggtgctaaagttacatggggctacattaatcggattttggggcagccatcattgatcagggaatcatcaatggcgaagtttccaggatcaaggatcgtatccgaagccacaaataaaattttaaattatagctcttcgtctagggtagacacatctgtcttgaatcaaaatggtcttggaaatgtaatcctccacccgttattgaagaaaagaatagagcatcttgcacgagcaacatcaaataccaaggcccatcaagcaccattccggaacatgcttttttatgggcctcctgggactggcaaaaccatggttgcaagggagatagctagaaaatcgggtttggattatgccatgatgactggaggagatgttgcacctcttggcccacaagctgttaccaaaattcatgatatatttgattgggccaagaaatctagaaaagggctgttgctttttattgacgaggcagatgctttcctttgcgagcgtaacagcatccatatgagcgaagctcaacgcagtgctctaaatgcattactcttcagaactggtgatcagtctagagatatagtacttgtccttgccacaaacagaccaggtgatcttgatagtgcaattactgatcgcattgatgaagcgattgaatttccacttccaggagaggaggaacgactaaaattattgaagctctatttggataaatatctccatgatgacaatagtagctccaaaggagtcttcttgctgaagaagcaaccccagaagattaccataaaagatatatctgaagatgttctcggagaagctgccaagcaaacagagggattttctggccgtgagatcgccaaactcatggccagtgtccaagctgctgtgtatggccgcccagattgcatcttggattcccagttgctcaaagaaattgtagattacaaagtggtggaacatcatcaacgattaaaacttgcagctgacggtggcttgcctgacccaatgtaataacttgctagagcttctctactagttctcttcatatgatcatttttgtgagaatcgtgccaatttttgtgtctcagatgaagcagattcattaaaaaatcagctagacgtattttgtaagccaaatttatatgatatttcggcttatgttgggaatgggaggttttaatcacccaaagcattccagctgaacctgttgtattcatgctatggagcaagaaaccaggtctcgagagcatagaagtcacattaccttcttttctctttcatttggttattaaatttatgagctatactgaaagttataacttcaattttcgtagttgtgttgtgaatttgatttctgttgaattcctacatgattcaacaaagatgagtatgttaaataataattgttttgtgcttcacatgtaacacttcttatcattatacattgtaactatgaattgttagatattttctgtttggaggaaaaaatt

SEQ ID NO: 9029 - DNA, 2180 bp, Lotus japonicus
ccatgaccgccgctaggttaacctcatgcgtggtcgccaccacagctgcggcggcggcttcctattccgcgcgctccgatcgtgcatacgccgactctcgctttcgcttcccctttttctcatcttcaccgccttcaaattccccttcgtcgtctgaccaggcttctgacaccaaatccgaaaccccgccacccgatgaatccagcaagtcgggtttcgattctccggaattgttagaaagagctgctcgagctctccgtaaaatcaataattctcggttggccaaagaggtgtttgctataatgcgtgcacaggaaaaaactcgcctcgctgaattagatgctgaaaaagttcactatgaactcattcaggctcataatgatattgaaaggcagcggaaaattgttgaagagcaacgaaatctattacaagaccaagcccagagagaggcccaggcgcgccgacaggaagacgatctggcaaggaaaagaatgcaggcagatcatgaagttcaaaggcaaaataatgttgaattggtcaagaggcaagaggagtctgctgtaagaaaggagaggtcaagacaggctacagaagaacagatccaatctcagcaacgtcagactgagaaagagagagctgaaatggaaagagaaaccatcagagttaaggcaatggcagaggctgaaggtcgagcccatgaagcaaaattgactgaggatcagaaaaggagaatgcttgttgatcgaattcaaggtgaaagagataaatggcttgctgcaattaacacaacttttagtcatatcgaaggtggtctaagggtcttattgactgatagggacagattgcttatgactgttggaggagtcactgcattagctgcaggtgtatatacaactagagaaggtgcaaaagttacatggggctatattaatcggattttggggcagccatcattgatccgggaatcatccatggcaaagtttccaggggcaaggatcgtttctcaagccaagaataaagtttatagtactttgggcggggcagaaaagcctattgggagtcaaaatggtcttggaaatgtgatcctccatccatcgttgctaaaaagaatacagcatcttgcacgggcaacatcaaacactaaggcccatcaggcaccatttcgtaatatgcttttttatgggcctcccgggactggtaaaaccatggttgcaagggaaatagctagaagatcgggtttggattatgccatgatgaccggaggagatgttgcgcctcttggcgctcaggcagtcaccaaaattcatgagatatttgattgggccaagaaatcaagaaaaggcctgttgctttttattgatgaggcagatgctttcctttgcgagcgaaatagcacatatatgagcgaagctcagcgaagtgctctaaacgcattgctcttcagaactggtgatcagtctagagacatagtacttgttcttgccacaaacagaccaggagatcttgacagcgcagttactgatcgcattgatgaagtgattgaattcccacttccgggagaagaggagcgtctaaaattattgaagctctatctgaacaagtatctatgtcatgacaacaatggctccaagggaggcttgttgctgaagaagcaacccaaacagattactataaaagatttatctgaagatgtgctcaaagaggctgccaagaaaaccgagggcttttctggccgtgagatagccaaacttatggccagtgtccaagctgctgtttatggtcgcccagattgcgtcttggattcccagttgcttaaagaaattgtggattacaaggtggtggaacatcatcaacggttacaacttgcatctgaaggcggcattttcagcttttaaatctgaatccccattttgacctgctcttctgggatttttcttctgcatattattcttcatcttgttatctttgtcagtatttgtggccgatgaagtagattcatttataaattaatctagatgcatctcgtctgcaaaattttcaggatactgtggctttatttgttaggaatgagagatgctttattacattctatgaaacaagaagctgggccttgactcttgagagcagaagtcaatttaccttgattatttaatttaaaatataaagttgtaatttacatt

SEQ ID NO: 9030 - DNA, 1058 bp, Glycine max
caacatagtcactccacacccacccatgaccttttcttaaacagcctctacattttcctttccaccctcgtcacaagaaaaaaagaaaactccccttaaacccccccccttcatgttcttttcttttctctttttgctctaagcaaaaaccaccactccgcaccacaccaccaccatggcagcaagagcaaaaactccccttaacactctctcctctttcacattcacactctttctctcattctctctcctccaactttctctctcctcccccaccaccatccacgaccttctccgctccaaaggcttaccaccggggctcctcccggaggaggtgaaatcctacaccttctctgaaactgggcacttggaagtgttcctggacgcaccatgcctcacaaaatacgagaacagagtcctcttcgaacaagtcgtcactgctaacctcacctacggaagcctcataggagtggagggtctccagcaagaagaactcttcgtgtggctacctgtcaaggacattatcgtaaatgacccctcttccgggttgatactctttgacattggcctcgcccacaaacagctctcgctgtccctctttgaagatccacctcactgcaaaaatcaaggtgggttgaggaatcatgtgaggaaggaaaaaggtttcttcgaggccctgaggtagaaaaagatgccaccttatttttttcaggcttcacttgttgtctttttctttggtcatgtttatataaattttagccttgcaatattattgcaactatatagtagtcatatgaattaatggaagtaggtgcttgtagcgtagaggttgagcattgtaaaaatgtgaggagagagagaggagaacaaaagaagaaaaaaaactatggaatctgataatgtcgtaatcaaatttaacttttgttcattgtgttgttctgttttgagataaaaagatatgataattgtcaaagcaaaggatcaaatctaggtttatgaattcgcaaagcaatgactaggaaacttgccaacgaaaatggggaagaagaggtattagg

SEQ ID NO: 9031 - DNA, 988 bp, Glycine max
gtcacaagaaaaaaagaaaactccccttaaacccccccccttcatgttcttttcttttctctttttgctctaagcaaaaaccaccactccgcaccacaccaccaccatggcagcaagagcaaaaactccccttaacactctctcctctttcacattcacactctttctctcattctctctcctccaactttctctctcctcccccaccaccatccacgaccttctccgctccaaaggcttaccaccggggctcctcccggaggaggtgaaatcctacaccttctctgaaactgggcacttggaagtgttcctggacgcaccatgcctcacaaaatacgagaacagagtcctcttcgaacaagtcgtcactgctaacctcacctacggaagcctcataggagtggagggtctccagcaagaagaactcttcgtgtggctacctgtcaaggacattatcgtaaatgacccctcttccgggttgatactctttgacattggcctcgcccacaaacagctctcgctgtccctctttgaagatccacctcactgcaaaaatcaaggtgggttgaggaatcatgtgaggaaggaaaaaggtttcttcgaggccctgaggtagaaaaagatgccaccttatttttttcaggcttcacttgttgtctttttctttggtcatgtttatataaattttagccttgcaatattattgcaactatatagtagtcatatgaattaatggaagtaggtgcttgtagcgtagaggttgagcattgtaaaaatgtgaggagagagagaggagaacaaaagaagaaaaaaaactatggaatctgataatgtcgtaatcaaatttaacttttgttcattgtgttgttctgttttgagataaaaagatatgataattgtcaaagcaaaggatcaaatctaggtttatgaattcgcaaagcaatgactaggaaacttgccaacgaaaatggggaagaagaggtattag

SEQ ID NO: 9032 - DNA, 962 bp, Vigna unguiculata
ggcttcgcaacccatccacaatcataaccctttcttctttctctctctctctatctctctctctgtctctctttctccgatcgcaaaaacctaactccgttttctcttcctccatggctcagaaaaccgagaacgaagaaaccgagttcaaggttcccgaaaccattactctatgcgtcaacaactgcggggtcacagggaaccctgccaccaacaacatgtgccagaactgcttcaccgccttcaccgcctccacagccacaacgtcatccgctaccgccgccaccgccggagtctcctcgctctccgctagatccgctgcgtccgcgcgtcctcagaagagatccttccccgaagagccttcctcggctgcagatcctccctcctccgaccaaaacacgccgtccgaggccaaacgcgtcgtcaaccgctgctccggttgcaggcggaaggtcggactcacgggattccggtgccggtgtggcgaactcttctgcgcggagcatcggtactccgatcgccacgactgcagttacgactacaaagccgccggtagagaagccatcgccagggagaatccggtggtcagagccgcgaagatcgtcaaagtctgaagaaaaagaaaacaaaaaaggaagagaaacccgaaacggaatctcgtcgttgacccggcttcacgcgatcggttcgggtcacgggtctccgcttttgtttttttcagattatatatatagagaagcaaaagaaagtagctgatgacaggtttaagagagagcgtgtgtgaggtttagagagagattgttgccgaaaagatgaagaagaatttatctgaatttctcttgtgttcttcgatcaagctcagatcgtttcatttttttttcctcttatttttacgtttgttttcttcccgatttgatcttgaaatgataaattattgtgatttaccaaaaaaaaaaaaaaaa

SEQ ID NO: 9033 - DNA, 1198 bp, Glycine max
caatttggtaatttccgctgccacaccaccaccaaagaaggaaataaaatttgatacgcgtctctatgaggcccatatttcattcctattaccgaccttacagcacatcaatacatcttcaaatccacctctcatctctctcgccctctctctcacatcatcaccatttcacctatttttctctctctctctctctctctctcgcatcacaatttcatcaaaaccttttaagtcttcatagttttccttctttctttctttgtgaaaaaacaaaaagtccaaaccatggctcagaaaaccgagaaagaagaaaccgacttcaaggttcccgaaacgattacgctttgcgttaacaactgcggcgtcaccggaaaccctgctacgaataacatgtgtcagaagtgcttcaccgccttcaccacctctaccgccaccacgtccggcgccggaggtgccggaatagcttctccggctaccagatccggcatctccgcgcgtccactgaagagatcttttcccgaggagccctcgccgccggcggatcctccgtcttcagaccagacgaccccgtcggaggcgaagcgcgtggtgaaccgctgctccggctgcaggaggaaggtcggactcaccggatttcggtgccgatgcggcgagctcttctgcgccgagcaccggtactccgaccgccacgactgcagctacgactacaaagccgccggaagagaagccatcgcgagggagaatccggtgattagagccgcgaagatcgtcaaagtctgaaaaaaaacaaaaaagaaggaaaaaacccgaacggaacggaatctcaaaacgacgtcgttgacggttgacctttcgcgcgatcgggttcaggtcacgggtttcgctttttttcttttcagatttatatatagagagaagaaaaaaaaagtagcagataacaggtttgagagagagagagagagagtgtgaggttttagattgagagagagagcgagagagagagattgttgctgaaaagaagatgaagaagaatttatctgaatttctcttgtgttcatcgatcaaactctgatcgtttaatttttttttaaattttctcttctaattttatgtttaatttcttcctgatttgatcttgaaatgataaattattgttgtttaccataattgttatcatattctcacatcgtggatctga

SEQ ID NO: 9034 - DNA, 1116 bp, Glycine max
aggcccatatttcattcctattaccgaccttacagcacatcaatacatcttcaaatccacctctcatctctctcgccctctctctcacatcatcaccatttcacctatttttctctctctctctctctctctctcgcatcacaatttcatcaaaaccttttaagtcttcatagttttccttctttctttctttgtgaaaaaacaaaaagtccaaaccatggctcagaaaaccgagaaagaagaaaccgacttcaaggttcccgaaacgattacgctttgcgttaacaactgcggcgtcaccggaaaccctgctacgaataacatgtgtcagaagtgcttcaccgccttcaccacctctaccgccaccacgtccggcgccggaggtgccggaatagcttctccggctaccagatccggcatctccgcgcgtccactgaagagatcttttcccgaggagccctcgccgccggcggatcctccgtcttcagaccagacgaccccgtcggaggcgaagcgcgtggtgaaccgctgctccggctgcaggaggaaggtcggactcaccggatttcggtgccgatgcggcgagctcttctgcgccgagcaccggtactccgaccgccacgactgcagctacgactacaaagccgccggaagagaagccatcgcgagggagaatccggtgattagagccgcgaagatcgtcaaagtctgaaaaaaaacaaaaaagaaggaaaaaacccgaacggaacggaatctcaaaacgacgtcgttgacggttgacctttcgcgcgatcgggttcaggtcacgggtttcgctttttttcttttcagatttatatatagagagaagaaaaaaaaagtagcagataacaggtttgagagagagagagagagagtgtgaggttttagattgagagagagagcgagagagagagattgttgctgaaaagaagatgaagaagaatttatctgaatttctcttgtgttcatcgatcaaactctgatcgtttaatttttttttaaattttctcttctaattttatgtttaatttcttcctgatttgatcttgaaatgataaattattgttgtttaccataattgttatcatattctca

SEQ ID NO: 9035 - DNA, 1361 bp, Glycine max
ggcaacaacaaccataataatagcaataataataataataataataataaaagcaaaaagacagagacatatgatttggatgatgcactgacacgaacacgtcagaaacctctgagacaagaaaaggggggcagcagaggcaaattgcaacgcaaagttgcaagcaaaacgaacccacttggacaatttggtaatttcccccgccacacaaccacgaaggcaaaaaaaaaaaagtaaagaaagaaatgtttgatacgcgtctctatgaggcccatattccattccctttaccgacctcacagcacatcaatacatcttcaaattcccctcttctctctctcacatctcttcgtcctctctctcacatcacaatttcataaaaaacctctttttaagtttcttgcttctttctctctgaaagaaaattgaagtcctaaccagttggctcttttgttttatcgttctccatggctcagaaaaccgagaaagaagaaaccgacttcaaagttccggaaacgattacgctttgcgtcaacaactgcggcgtcaccggaaaccctgccacgaataacatgtgccagaagtgcttcactgcctctaccgccaccacttccggcgccggaggtgccggaatagcttctccggcgaccagatccggcgtctccgcgcgtcctcagaagagatcttttcctgaagagccctcgccggtggcggatcctccttcttcggaccagacgacgccgtcggaggcgaagcgcgtggtcaaccgctgctccggatgccggcggaaggtcggactcaccggattccggtgccggtgcggcgagctcttctgcgccgagcaccggtactccgaccgccacgactgcagctatgactacaaagccgccggaagagaagccatcgcgagggagaatccggtgatcagagctgcgaagatcgtcaaagtctgaaaaaagaaaaaagaaaaaaaaaaaaaggaaaaacccgaacggaacggaatctcaaaacgacgtcgttgacggttgacgcggtttcgtgtttttttttttctcagatttatatatatagagaagaaggaaaaaaaaaagtagcagatgacagatttaagagagagagagagcgtgtgtgaggttttagattgagagagagagagagagagagagagagagagagagattgttgctgataaaagatgaagaagaatttatctgaatttctcttgtgtttcatcgatcaaactctgatcgttttttttatttatttaatttctcttctaatttttatgtttgatttcttcctgatttgatcttgaaatgataaattattgtgatttaccattattatcataatcccacttc

SEQ ID NO: 9036 - DNA, 1302 bp, Glycine max
aagacagagacatatgatttggatgatgcactgacacgaacacgtcagaaacctctgagacaagaaaaggggggcagcagaggcaaattgcaacgcaaagttgcaagcaaaacgaacccacttggacaatttggtaatttcccccgccacacaaccacgaaggcaaaaaaaaaaaagtaaagaaagaaatgtttgatacgcgtctctatgaggcccatattccattccctttaccgacctcacagcacatcaatacatcttcaaattcccctcttctctctctcacatctcttcgtcctctctctcacatcacaatttcataaaaaacctctttttaagtttcttgcttctttctctctgaaagaaaattgaagtcctaaccagttggctcttttgttttatcgttctccatggctcagaaaaccgagaaagaagaaaccgacttcaaagttccggaaacgattacgctttgcgtcaacaactgcggcgtcaccggaaaccctgccacgaataacatgtgccagaagtgcttcactgcctctaccgccaccacttccggcgccggaggtgccggaatagcttctccggcgaccagatccggcgtctccgcgcgtcctcagaagagatcttttcctgaagagccctcgccggtggcggatcctccttcttcggaccagacgacgccgtcggaggcgaagcgcgtggtcaaccgctgctccggatgccggcggaaggtcggactcaccggattccggtgccggtgcggcgagctcttctgcgccgagcaccggtactccgaccgccacgactgcagctatgactacaaagccgccggaagagaagccatcgcgagggagaatccggtgatcagagctgcgaagatcgtcaaagtctgaaaaaagaaaaaagaaaaaaaaaaaaaggaaaaacccgaacggaacggaatctcaaaacgacgtcgttgacggttgacgcggtttcgtgtttttttttttctcagatttatatatatagagaagaaggaaaaaaaaaagtagcagatgacagatttaagagagagagagcgtgtgtgaggttttagattgagagagagagagagagagagagagagagagagagattgttgctgataaaagatgaagaagaatttatctgaatttctcttgtgtttcatcgatcaaactctgatcgttttttttatttatttaatttctcttctaatttttatgtttgatttcttcctgatttgatcttgaaatgataaattattgtgatttaccattattatcataatcccacttc

SEQ ID NO: 9037 - DNA, 873 bp, Cajanus cajan
gcattaccgacctcacaacaacaccttcaaatccccctctcctctctctcaacgctcttggccctctctcgcgaaacgcaccaaccaaacaccgttttctcttattctctcccaaacagccccttaccgttcctcccttcccatggctcacaaaaccgagaaagaagaaaccgacttcaaggtccccgaaaccatcacgctctgcgttaacaactgcggcgtaacgggaaacccagccaccaacaacatgtgccagaactgcttcgccgccttcacagcctccacctccgccacctccgccacctccgccgccgccggagccagatccggggcgtccgcgcgcccgcagaagagatccttcccagacgaggccgcgacggccgcggatccgccgtgctccgagcaaacgacgccgtccgaggcgaagcgcgtggtcaaccgctgctccggctgccggaggaaggtcggactcaccggattccggtgccggtgcggcgagcttttctgcgccgagcatcggtactccgaccgccacgactgcagctacgactacaaagccgccggaagagaagccatcgccagggagaatccggtgatcagagccgcgaagatcgtcaaagtctgaaacagcaaaaaaagaaaaagaaaaaaagaaaaaagaaaaaagaaaaaaggaaaaaggaaaaatctcgcagcagcgcaacgacgtcgtttactcggtttctgtcgaaacacgggttttcgctttttttttttaatataaatatagagaaagaagaagaagaagaaaaagaaaaaaaaaatggtagcagatgacaggtttaagagagagcgtgtgtgaggtttagagagagagagagagagagagagaga

SEQ ID NO: 9038 - DNA, 886 bp, Glycyrrhiza uralensis
attgggaagaaggagaacaacttgagagagagagagggagagagagagagagacccacttggacaaattggagttgaaagaaatgttttgatatacgcgtctctacgaggcccatattccattgccattaccgacctcacaacaccaccacctctctctctcttcatattcccctttcctttcctctctctcaccctccttcgccatctccttcttttttcctctctgtaaaaaagaaaaagaaaaaaaatcatcaattcatggctcagaaaacagagaaagaggaaaccgatttcaaggttcccgaaaccatcaccccttgcatcaacaactgcggcgttaccggaaaccccgctatgaacaatatgtgccagaagtgcttcaccgcctccaccgctacaacctcctccgccggaatctcaactccgtcttccagatccgccgctcgttcctccaagagatcgtttccggaagaagaagagaccgtgcaggccgcagatcctccggcgtccgagcaaacaacaccgtccgaggcgaagcgcgtcgtgagccggtgctcaggatgtcggcggaaggtcggtctcaccggcttccggtgccggtgtggcgagctcttctgcgccgagcaccggtactccgatcgccacgattgtacctacgactacaaagccgccggaagagaagccatcgccaaggagaacccggtgatcagagccgcgaagatcgtcaaggtctgaactctgaaatccgaagaggagaaaacggaagaacggaacgaaacgagaaaaaggaatctcaaaacgacgtcgttgacctgcctattcctcgatcgggttcgggtcacgtgtttgtgtcctcttttccagtttccagattatatatatag

SEQ ID NO: 9039 - DNA, 1509 bp, Glycine max
tttctcttcatctttatccattttatatacttttcccttccaaaagttctgttttatgaaaagagtcccaaaaaacagaaagaaaaattgaaaatccaaccaattacattttttcccggcttaataactcaataactccaattatccacatcataatctcatctcctctctctccactcctagaaatttccacgctcttattttcccggaaaatgaaattttctcgttagattttccttttccccaattcacagttccgtgggacgaaaaaaaataaaatatccaaaacattttccatggctcttctaatccactccctggaaatgtccgttgccccccaaatttctcaaaaccctaaccctaagctgagcaaactccacagcttcaaaccctaccccaagggcaaagcgattgggtcaacgcgcggtgtgagaatttcctgcaaggtgaaagattgtgtggttttggatgagaacgtgaattcgtacggtcaattttcggttccggtgaagcaagggtcgaagcagagcaaagaggaggaggaagagaagcagaattactatgtgaatgtgggatatgctatccgaactctgagggaggaattccctgatcttttctacaaggaacttagctttgacatctacagggatgatattgtgttcaaggatcctatgaacacattcattggtattgagaattacaaatctatcttctgggcactacgatttcatggcatgatgtttttcaaagctctgtgggtggaaataagtagtgtatggcagcctgttgagaatgtcattatggttcgctggactgttcacgggatcccacgagttctatgggaaagtcgtggtaggtttgatggaacctctgagtataaacttgacaagcaaggcaagatttttgagcaccgggttgacaacattgctatgaattcacctcctcggttcaaagtgttgggtgtggaagaattaattcgatctattggctgcccctcaattgcaagaccaacctattttgaaatttcttcacctcccaagagaacgtagtgttgttcaggttcttcaaaaaagttttggtgtaaattgtggtaagcaaaacatgaagctagatatatttatcttgattatcacataaagctgtgagaaaatggtcttttgccatagacttggctatatggttctattggcaccagttatagggtcagtgttggctattgtgactagttgagttttagccttgtatataatgcaattgctacttatggcttacgtcttacttcatctatagattcatataaggaacttgtgtactggtgccctattcatatgcattttaatccatgtttctcacatctctccctatttgacattcaactaaacatcagaagttagatttgactctttgagctcttgctcgtaactgtaaatagcagcgctatgtataactgtaaatagtgtgattttcagtgatcattaatgttaaactaatgtgacttttattctttaa

SEQ ID NO: 9040 - DNA, 1445 bp, Glycine max
gtcccaaaaaacagaaagaaaaattgaaaatccaaccaattacattttttcccggcttaataactcaataactccaattatccacatcataatctcatctcctctctctccactcctagaaatttccacgctcttattttcccggaaaatgaaattttctcgttagattttccttttccccaattcacagttccgtgggacgaaaaaaaataaaatatccaaaacattttccatggctcttctaatccactccctggaaatgtccgttgccccccaaatttctcaaaaccctaaccctaagctgagcaaactccacagcttcaaaccctaccccaagggcaaagcgattgggtcaacgcgcggtgtgagaatttcctgcaaggtgaaagattgtgtggttttggatgagaacgtgaattcgtacggtcaattttcggttccggtgaagcaagggtcgaagcagagcaaagaggaggaggaagagaagcagaattactatgtgaatgtgggatatgctatccgaactctgagggaggaattccctgatcttttctacaaggaacttagctttgacatctacagggatgatattgtgttcaaggatcctatgaacacattcattggtattgagaattacaaatctatcttctgggcactacgatttcatggcatgatgtttttcaaagctctgtgggtggaaataagtagtgtatggcagcctgttgagaatgtcattatggttcgctggactgttcacgggatcccacgagttctatgggaaagtcgtggtaggtttgatggaacctctgagtataaacttgacaagcaaggcaagatttttgagcaccgggttgacaacattgctatgaattcacctcctcggttcaaagtgttgggtgtggaagaattaattcgatctattggctgcccctcaattgcaagaccaacctattttgaaatttcttcacctcccaagagaacgtagtgttgttcaggttcttcaaaaaagttttggtgtaaattgtggtaagcaaaacatgaagctagatatatttatcttgattatcacataaagctgtgagaaaatggtcttttgccatagacttggctatatggttctattggcaccagttatagggtcagtgttggctattgtgactagttgagttttagccttgtatataatgcaattgctacttatggcttacgtcttacttcatctatagattcatataaggaacttgtgtactggtgccctattcatatgcattttaatccatgtttctcacatctctccctatttgacattcaactaaacatcagaagttagatttgactctttgagctcttgctcgtaactgtaaatagcagcgctatgtataactgtaaatagtgtgattttcagtgatcattaatgttaaactaatgtgacttttattctttaa

SEQ ID NO: 9041 - DNA, 1356 bp, Glycine max
atttttccgcgcttaataattcaattaactccaattatccacattataatctcgttcccacccattttcccgggaaatgattttttctcgttagattttccttttcccgaattcacagttccgtgcgacgaaaacaaaaaaatccaaaacattttccatggcccttctaatccactccctggaaatgtccgttactccccaaattgccccaaaccctaaccttaagctgcgcaaattcaacagcttcaaaccccacacaaagggcaaagcgattgggtcaacgcgtggtgtgagaattttctgcaaggtgaaggattgtgcggttttggatgagaacgtgaattcgtatggtcaattttcggttccggtgaagcaagggtcgaagcagagcaaagaggaggaggaagagaagcagaattactatgtgaatgtgggatatgctatccgaactctgagggaggaattccctgatctcttctacagggaacttagctttgacatctacagggatgatattgtgttcaaggatcctatgaacacgttcattggtattgagaattacaaatctatcttctgggcactacgatttcatggcaggatgtttttcaaagctttgtgggtggaaataagcagtgtatggcagcctgttgagaacatcattatggttcgctggactgttcatgggatcccacgagttttatgggaaagtcgtggtaggtttgatggaacctctgagtataaacttgacaagcaaggcaagatttttgagcatcgggttgacaacattgctatgaattcacctcctcggttcaaagtgttgggtgtggaagaattaattcgatctattggctgcccctcgactgcaagaccaacctattttgaaatatcttcacctccttaagagaacgtagtgttgttcaggttcttcaaaaaagttttggtgtaaattgtgcatattatggtaaacaaaacatggagctagatatattttatcttgcttgtcacataaagctgtgagaaaatggtattttgccgtggacttggttatatggtgcttgactctattggctccagttatagatagggtcagtgttcgctattgtaaccagtggagttttaaaagccctgtatataatgcaattgctacttatagcttacgtcttacttcatttatagattcatacaagcaatttatgtactggtgccatattaatatacattttaatccatgtttctcacatctctccctgtttaacattcaactaaacatcagaagttagatttcagctgttgctcctaagtcccaactgtaaatagcaacgccgtgaatgactgtaaatagtgttgattttcagt

SEQ ID NO: 9042 - DNA, 1512 bp, Glycine max
tttctttttccatgttttgtttttctattcatctttatccattttatatactttccccttccaaaagttctttttatcatgaaaaggaaaaaaaaaaacagaaaatccaaccaatcatatttttccgcgcttaataattcaattaactccaattatccacattataatctcgttcccacccattttcccgggaaatgattttttctcgttagattttccttttcccgaattcacagttccgtgcgacgaaaacaaaaaaatccaaaacattttccatggcccttctaatccactccctggaaatgtccgttactccccaaattgccccaaaccctaaccttaagctgcgcaaattcaacagcttcaaaccccacacaaagggcaaagcgattgggtcaacgcgtggtgtgagaattttctgcaaggtgaaggattgtgcggttttggatgagaacgtgaattcgtatggtcaattttcggttccggtgaagcaagggtcgaagcagagcaaagaggaggaggaagagaagcagaattactatgtgaatgtgggatatgctatccgaactctgagggaggaattccctgatctcttctacagggaacttagctttgacatctacagggatgatattgtgttcaaggatcctatgaacacgttcattggtattgagaattacaaatctatcttctgggcactacgatttcatggcaggatgtttttcaaagctttgtgggtggaaataagcagtgtatggcagcctgttgagaacatcattatggttcgctggactgttcatgggatcccacgagttttatgggaaagtcgtggtaggtttgatggaacctctgagtataaacttgacaagcaaggcaagatttttgagcatcgggttgacaacattgctatgaattcacctcctcggttcaaagtgttgggtgtggaagaattaattcgatctattggctgcccctcgactgcaagaccaacctattttgaaatatcttcacctccttaagagaacgtagtgttgttcaggttcttcaaaaaagttttggtgtaaattgtgcatattatggtaaacaaaacatggagctagatatattttatcttgcttgtcacataaagctgtgagaaaatggtattttgccgtggacttggttatatggtgcttgactctattggctccagttatagatagggtcagtgttcgctattgtaaccagtggagttttaaaagccctgtatataatgcaattgctacttatagcttacgtcttacttcatttatagattcatacaagcaatttatgtactggtgccatattaatatacattttaatccatgtttctcacatctctccctgtttaacattcaactaaacatcagaagttagatttcagctgttgctcctaagtcccaactgtaaatagcaacgccgtgaatgactgtaaatagtgttgattttcagtgatcagtaatgttaaactaatgtcacttttattcttta

SEQ ID NO: 9043 - DNA, 1244 bp, Cajanus cajan
atcgtaatctcctttcctatcagaaatttcttggaaaatgaaaatttgtcgttagattttccggaattcacagttccgtgagacaaaagaaaatatcgaaacatttccatggcccttctaatccactccccggaagtgtccgttgcaccccaaattgcccataaccctaaccctaaccttcccaaactccacagcttcagaccccacacaaaggccaaagcgattgggccaaagcgtggggtcagaatttcttgcaaagtgaaagactttgcggttgtgaatccgtacggtcagttttcggttccagtgaagcgagggtcgaagcagagcaaagaggaggaagaagagaagcagaattactatgttaatgttgggtatgctatccgaagtttgagggaagaattccctgatctcttctacagggaacttagctttgacatctacagggatgatattgtgtttaaggatcctatgaacacattcgttggtattgagaattacaaatcaatcttctgggcactacgatttcatggcaagatgtttttcaaagctttgtgggtggacataagtactgtatggcagcctgttgagaacgtcattatggtgcgctggactgttcatgggatcccacgagttctatgggaaagtcgtggtaggtttgatggaacttctgagtataaacttgacaggcaaggcaagatttttgagcaccgggttgacaacattgctctgaattcacctcctcggttcaaagtgctgggtgtggaagaattaattcaatctcttggctgcccctcgactgcaagaccaacctattttgaaatatcttcacctcctaagagaatgtaatttgctcaggttcttcaaaaagttttggtgtaaattgtgcatagtatggtaaacaaaacatggagctagatatattttatcttgcttgtcacataaagctgtgagaaaaaaggtgttgtcagacttggttatatggtgctcaactctgttggcagcagttataacttttagggtcattgctggctactgtaactagttgagttttaaaagccctgtatataatttaattgctacgtatctcttatgtcttactccatctatagatttatataaaagcaaattgtgccctgatgccatattcatatacattttaatccttgtttctcagttctcacaagtcgcatctctccctgtttaacatttgattaaacgtgagaaattggatttgagctctt

SEQ ID NO: 9044 - DNA, 1583 bp, Cajanus cajan
ggacctgaaagccttataactaaaaccctggttgttatgaggcacgcgacgctcttcttctaacctatagaaaatggaaaccagtgcggccatggatgtcgaggagcaaccttcgcccaaccccactaacgttaaatgcttcggcctcaaaaattcgattcaaactaacttcggtgatgactatgttttccaaattgtcccaaaggatgattggagtgcaatggcggtgtcactgtcaacgaacgcggtgaaactgtattcgcctgtggcgggtcaatattatggagagtgcaagggtcactctgcaaccatcaatcagatttctttttcgggtccttcaaatccccatgttttgtgttcgtgttcttctgatggcactattagagcttgggacacacggacatttcagcaggtttcttccatcattgctggttcttctcaggaggttttcagcttctgtcttggagggactagtggaaatttagttgccgccgggtgtaaatcgcagatactgttctgggattggagaaatatgaagcaaattgcatgcctggaggactctcatgttgatgatgtcactcaggttcattttgtccctaatgaccaaggcaagcttatttctgcttcagaagatgggttgatctgtacatttgatactgccggagatatcaatgatgatgatcatctagaatcagtgattaatatggggacttcaattgcaaaggtggggatttttggagagaattaccagaagctttggtgtttaacacatattgaaaccctgggtatctggaactggaaagatggtagaaatgaaggaaacttctcagatgctcgtactttagcttcagaaagttggaatttggatcacgttgactatttcattgattgtcaatactccagagaagctgataaactatgggtgattggtggcactaatgctggtactatgggctacttccctgtaaattacgaaggagtggcaacaattggagctgcagaagcaattcttgaaggtggccatacaagtgttattaggagtattttacccatgtcaaaatttcatagtgggccaactaatagtcctagccaaggcatttttggatggacgggtggggaagatggtcggttatgttgttggctctctgatgattcctctgaatcaaatcaatcttggatttcaagcacattggttatgaagccagaaagaactcgcaagaaaaatcgtcatcacccctattagcaaatagcatgcagagccattaacttcattagttcaatgacgaaggagctttttttttgttttatttgccaatagtttaatttttcaccacaacatgggtcgaggtgttggattttgataaacattatttgtttgtagtcagatatgtcctcaccacttgtaatatttgtacgtggccatttttatatagctcttttttgtttttactaaaatatacagaacacttgatttgttttgtaatattgtatctgtgtgtagtgtcgtttttatatgatggcattctaggttaccagtaacttgattctcatttactagattcctctgacgattatgtactcta

SEQ ID NO: 9045 - DNA, 1676 bp, Glycine max
tcgcaggtgattgaagccctaaaaccctggaagttatgaaggacctttttcctctgcaactctaacttatagaaacccaatttcatatggaaaccagtgcggccatggatgtcgaggagcaaccttcacccaacgcaagcgacgttaaacgcttcggccttaaaaactctattcaaaccaacttcggcgacgactatgttttccaaatcgtcccaaacgatgattggagtgcaatggcggtgtcactgtcaacgaacgcagtgaaactgtattcacctgtggcgggtcagtattatggagaatgcaagggtcactctgaaaccatcaatcagattttgttttcgggtccttcaaatccccatgttttgtgttcctgttcttctgatggcaccattagagcttgggacataaggacttttcagcaggtttcttccatcaatgccggtccttctcaagaggttttcagcttctgtattggagggactggtggaaatttagtagccgccgggtgtaaatcgcagatactgttctgggattggagaaatatgaagcaagttgcatgcctggaggactctcatgtggatgatgtcactcaggttcattttgtccctaatgaacaaggcaagctgatttctgcttcagtagatgggttgatctgcacatttgatgctactggagatatcaatgatgatgatcatctagaatcagtgattaacatggggacttcaattgcaaaggtggggatttttggagagaattatcagaagctttggtgcttaacacatattgaaaccctgggtatctggaactggaaagatggtagaaatgaaggaaacttctcagatgctcgtactatagcttctgaaagttggaacttggatcatgttgactatttcattgattgccactattccagagaagctgaaaaactatgggtgattggtggcactaatactggtactatgggctactttcctgtaaattacgaaggagtggctacaattggagctgcagaagcaattcttgaaggaggccacgcaagtgttattaggagtgttttacccatgtcaacaattcctagtggacctactaatagtcctagccaaggcattttcggatggtcgggtggagaagatggtcggctgtgttgttggctctctgatgattcctctgaatcaaatcaatcttggatttcaagcactttgactatgaagccagaaagaacatgtaagaaacaccgtcatcacccctactagcaaatagcatgccgagccattaacttagatggttcaaagcccgaggagcattttttgttttatttgccaatagtttgttttatttttcatcacaacatgggttgagatgtgttggatttttattataaaaaaaaattgtatttgtacgtgagcatttttcatagccctttttgtttttccaaaatataggacacttgagtcattttgtaatcttgtatttgtatggagtgtcaatattatgtgatgattttctaggtaatcagtaactttctagaccgctttgacaattatgtaatcagtttaggaaaattaagtctagtactacttttaccaattatctcaaatttgagctttaggtatctaataatgttaaatattcaaaaggacaattatgttattgatttcgtgtgtcttcaatat

SEQ ID NO: 9046 - DNA, 2009 bp, Glycine max
tcgcaggtgattgaagccctaaaaccctggaagttatgaaggacctttttcctctgcaactctaacttatagaaacccaatttcatatggaaaccagtgcggccatggatgtcgaggagcaaccttcacccaacgcaagcgacgttaaacgcttcggccttaaaaactctattcaaaccaacttcggcgacgactatgttttccaaatcgtcccaaacgatgattggagtgcaatggcggtgtcactgtcaacgaacgcagtgaaactgtattcacctgtggcgggtcagtattatggagaatgcaagggtcactctgaaaccatcaatcagattttgttttcgggtccttcaaatccccatgttttgtgttcctgttcttctgatggcaccattagagcttgggacataaggacttttcagcaggtttcttccatcaatgccggtccttctcaagaggttttcagcttctgtattggagggactggtggaaatttagtagccgccgggtgtaaatcgcagatactgttctgggattggagaaatatgaagcaagttgcatgcctggaggactctcatgtggatgatgtcactcaggttcattttgtccctaatgaacaaggcaagctgatttctgcttcagtagatgggttgatctgcacatttgatgctactggagatatcaatgatgatgatcatctagaatcagtgattaacatggggacttcaattgcaaaggtggggatttttggagagaattatcagaagctttggtgcttaacacatattgaaaccctgggtatctggaactggaaagatggtagaaatgaaggaaacttctcagatgctcgtactatagcttctgaaagttggaacttggatcatgttgactatttcattgattgccactattccagagaagctgaaaaactatgggtgattggtggcactaatactggtactatgggctactttcctgtaaattacgaaggagtggctacaattggagctgcagaagcaattcttgaaggaggccacgcaagtgttattaggagtgttttacccatgtcaacaattcctagtggacctactaatagtcctagccaaggcattttcggatggtcgggtggagaagatggtcggctgtgttgttggctctctgatgattcctctgaatcaaatcaatcttggatttcaagcactttgactatgaagccagaaagaacatgtaagaaacaccgtcatcacccctactagcaaatagcatgccgagccattaacttagatggttcaaagcccgaggagcattttttgttttatttgccaatagtttgttttatttttcatcacaacatgggttgagatgtgttggatttttattataaaaaaaaattgtatttgtacgtgagcatttttcatagccctttttgtttttccaaaatataggacacttgagtcattttgtaatcttgtatttgtatggagtgtcaatattatgtgatgattttctaggtaatcagtaactttctagaccgctttgacaattatgtaatcagtttaggaaaattaagtctagtactacttttaccaattatctcaaatttgagctttaggtatctaataatgttaaatattcaaaaggacaattatgttattgatttcgtgtgtcttcaatatataattacattacatatttcgaagacatttatctataatgatcctatttgtcttacaaaattatctccaataataaaaaatatattgactttaaagaagaaaaaaaagttaatgacattggcatgcgatccctttagtggtggatttaagtataatttctttcaaaacccaattccaatcgacccaaacagggaaaagaaaaaacaatcggaaaaacaaaatcgacaagtcaactttgtcaaatactgtatgcttggtgccaaatatgtaattgtcaaattaacatctctaaatatatcaaggttgtgtatttcacgcattgcgccgtcatta

SEQ ID NO: 9047 - DNA, 1621 bp, Glycine max
ccatcccaggagattgaagccctaaacccctgggagttatgaaaagagcgatggatggtcttcttctcttcctccgcaactctaacctacagaaacccaacttctgttcatatggaaaccagtgcggccatggatgtcgaggaccaaccttcacccaactccaacaacgttaaacgcttcggccttaaaaactctatccaaaccaatttcggtgatgactatgttttccaaatcgtcccaaaggaagattggagtgcaatggcggtgtcactgtcaacgaacgcagtgaaactctattcacctgtggcgggtcagtattttggagagttcaagggtcactctgaaaccgtcaatcagatttcgttttcgggtccttcaaatccccatattttgtgttcgtgttcttctgatggcaccattagagcttgggacgctcggacatttcagcaggtttcttctatcaatgctggtccttctcaggaggttttcagcttctgtatgggagggactagtggaaatttagttgccgccgggtgtaaatcgcaggtactgttctgggattggagaaatatgaagcaagttgcatgcctggtggactctcatgtggatgatgtcactcaggttcattttgtccctaatgaacgaggcaagctgatttctgcttccgtagatggtttgatctgcacatttgatactactggagatatcaatgatgatgatcatctagaatcagtgattaatatggggacttcaattgcaaaggtggggatttttggagagactttccagaagctttggtgtttaacacatattgaaaccctgggtatctggaactggaaagatggtagcaatgaaggaaacttcttagatgctcgtactttagcttctgaaagttggaatttggatcatgttgactacttcattgattgccactactccagagaagctgaaaaactatgggtgattggaggcactaatgctggtactatgggctactttcctgtaaattacaaaggagtggcaacgattggagctgcagaagcaattcttgaaggtggccacacaagtgttattaggagtgttttacccatgtcaacaattcctagtggacctactaatagtcctagccaaggcattttcggttggacgggtggggaagatggtcggctatgttgttggctctctgatgattcctctgaatcaaatcaatcttggatttcaagcacattgactatgaaggcagaaagaactcacaagaaaaaccgtcatcacccctactaacaaagagcacactgagtcgataacttagatggctcaatgccggaggagcattttttgtttagttagttttatttttcaccacggcatgggttgagatgtgttggatttagatggctcataaccctttttgtttatccaaaatacacaacacttgattcatttgtatggagtatcaatattatgtgatgattttctaggtaatcagtacaactttctagattgctttgataatttatgtaatcactttaggaaaatcaagttttgtactgctttaaccaatcatctcaagtttgagctttaaagctttaagtatataacaatgctgaatattcaaaaggag

SEQ ID NO: 9048 - DNA, 1607 bp, Glycine max
ccatcccaggagattgaagccctaaacccctgggagttatgaaaagagcgatggatggtcttcttctcttcctccgcaactctaacctacagaaacccaacttctgttcatatggaaaccagtgcggccatggatgtcgaggaccaaccttcacccaactccaacaacgttaaacgcttcggccttaaaaactctatccaaaccaatttcggtgatgactatgttttccaaatcgtcccaaaggaagattggagtgcaatggcggtgtcactgtcaacgaacgcagtgaaactctattcacctgtggcgggtcagtattttggagagttcaagggtcactctgaaaccgtcaatcagatttcgttttcgggtccttcaaatccccatattttgtgttcgtgttcttctgatggcaccattagagcttgggacgctcggacatttcagcaggtttcttctatcaatgctggtccttctcaggaggttttcagcttctgtatgggagggactagtggaaatttagttgccgccgggtgtaaatcgcaggtactgttctgggattggagaaatatgaagcaagttgcatgcctggtggactctcatgtggatgatgtcactcaggttcattttgtccctaatgaacgaggcaagctgatttctgcttccgtagatggtttgatctgcacatttgatactactggagatatcaatgatgatgatcatctagaatcagtgattaatatggggacttcaattgcaaaggtggggatttttggagagactttccagaagctttggtgtttaacacatattgaaaccctgggtatctggaactggaaagatggtagcaatgaaggaaacttcttagatgctcgtactttagcttctgaaagttggaatttggatcatgttgactacttcattgattgccactactccagagaagctgaaaaactatgggtgattggaggcactaatgctggtactatgggctactttcctgtaaattacaaaggagtggcaacgattggagctgcagaagcaattcttgaaggtggccacacaagtgttattaggagtgttttacccatgtcaacaattcctagtggacctactaatagtcctagccaaggcattttcggttggacgggtggggaagatggtcggctatgttgttggctctctgatgattcctctgaatcaaatcaatcttggatttcaagcacattgactatgaaggcagaaagaactcacaagaaaaaccgtcatcacccctactaacaaagagcacactgagtcgataacttagatggctcaatgccggaggagcattttttgtttagttagttttatttttcaccacggcatgggttgagatgtgttggatttagatggctcataaccctttttgtttatccaaaatacacaacacttgattcatttgtatggagtatcaatattatgtgatgattttctaggtaatcagtacaactttctagattgctttgataatttatgtaatcactttaggaaaatcaagttttgtactgctttaaccaatcatctcaagtttgagctttaaagctttaagtatataacaatgctga

SEQ ID NO: 9049 - DNA, 1459 bp, Medicago truncatula
gtgaggttattgagctttgcttaactggacctcgtcttagttagctgatcagagccctaaaacccttttcttcctccgcaattgcaccttcatagaaacagtcacaaacaacggccatggatgtcgaggaacaacgaccttttcccatacccaacaacgttaaacgcttcggtcttaaaaactctatccaaactaatttcggtgacgattatgttttccaaatcatcccaaaggatgattggagttcaatggcggtttcactttcaacgaacgcagtgaaattgtattcaccagtgatgggtcaatattatggagagtgcaagggtcacactgcaactatcaatcagattttgttttcgggtcattctaatcccaatattctaagctcttgttcttcagatggtactatcaggacttgggacactagaacatttcagcaggtttctattatcaatgctggtccgtctcaagaaatcttcagcttctctattggaggacctagtggaaatttagttgctgcgggttgtgattcacaggtactcttgtgggattggagaaataacaagcaaattgcatgcctagaagattctcatgtggatgatgtcactcaggttcattttatccctgaagaacgaggcaagctcatttctgcttcagttgatggattggtctgcatatttgataccactggagatattaacgacgatgatcatctagagtcggtgattaatgtgggaacatcaattgcaaaggtgggtttttttggagagagttatcagaagctttggtgtttaactcatattgaaactctcggcatttgggactggaaagaaggaagaaatgaagtaaacttctcagacacgcgtactttagcttctgaaagttggaatttggatcatgttgactacttcgttgattgccactactcaagagaagctgaaaaactatggttgatcggtggcacaaatgcgggtactttgggtttctttcctgtaaattacagtgaaacgacaacaattggaggtgcagaagcaattctcgaaggtggccatacagatgttgttagaagtgttctacctatgtccagagttcatagttcaggcatttttggatggacaggtggggaagatggtaggctatgttgttggctgtctgatgatgattcccctcaaaaaaaccaatcttggatttcaagttcattggttatgaaaccggaaagaacttgcaagaaaaatcgccatcacccgtactaatactagtagtcctatgctgcttaactaaacagtttgattatttttttttggtttatttatttagttttttattaaacttgggttaggatgtgatggattttgggttaaaaattttacttttatgtttattgcgtgtaatatttgtaatggggcgttttgcacaagccccttttatattttaaataagaaatatagatcatttgatt

SEQ ID NO: 9050 - DNA, 1455 bp, Medicago truncatula
ggttattgagctttgcttaactggacctcgtcttagttagctgatcagagccctaaaacccttttcttcctccgcaattgcaccttcatagaaacagtcacaaacaacggccatggatgtcgaggaacaacgaccttttcccatacccaacaacgttaaacgcttcggtcttaaaaactctatccaaactaatttcggtgacgattatgttttccaaatcatcccaaaggatgattggagttcaatggcggtttcactttcaacgaacgcagtgaaattgtattcaccagtgatgggtcaatattatggagagtgcaagggtcacactgcaactatcaatcagattttgttttcgggtcattctaatcccaatattctaagctcttgttcttcagatggtactatcaggacttgggacactagaacatttcagcaggtttctattatcaatgctggtccgtctcaagaaatcttcagcttctctattggaggacctagtggaaatttagttgctgcgggttgtgattcacaggtactcttgtgggattggagaaataacaagcaaattgcatgcctagaagattctcatgtggatgatgtcactcaggttcattttatccctgaagaacgaggcaagctcatttctgcttcagttgatggattggtctgcatatttgataccactggagatattaacgacgatgatcatctagagtcggtgattaatgtgggaacatcaattgcaaaggtgggtttttttggagagagttatcagaagctttggtgtttaactcatattgaaactctcggcatttgggactggaaagaaggaagaaatgaagtaaacttctcagacacgcgtactttagcttctgaaagttggaatttggatcatgttgactacttcgttgattgccactactcaagagaagctgaaaaactatggttgatcggtggcacaaatgcgggtactttgggtttctttcctgtaaattacagtgaaacgacaacaattggaggtgcagaagcaattctcgaaggtggccatacagatgttgttagaagtgttctacctatgtccagagttcatagttcaggcatttttggatggacaggtggggaagatggtaggctatgttgttggctgtctgatgatgattcccctcaaaaaaaccaatcttggatttcaagttcattggttatgaaaccggaaagaacttgcaagaaaaatcgccatcacccgtactaatactagtagtcctatgctgcttaactaaacagtttgattatttttttttggtttatttatttagttttttattaaacttgggttaggatgtgatggattttgggttaaaaattttacttttatgtttattgcgtgtaatatttgtaatggggcgttttgcacaagccccttttatattttaaataagaaatatagatcatttgatt

SEQ ID NO: 9051 - DNA, 1670 bp, Lupinus angustifolius
atatcatgaagtggcctcactgcacttcgtcccactggattaaaacccaaaaaccctccatgtcgtgatgctcttatttctctgcttgttcatcagcaacataaccaaacaataatcttaactatggaaacaagtgcagccatggatattgaggaacaaccttcacccaacaacaacaacaacaaccttaaacgctttggtctgaaaaactctattcaaaccaactttggtgatgactatgttttccaaatcatcccaaaggatgattggagttcaatggcggtgtcactttcaacgaacacagtgaaactgtattcaccagagaagggtcaatattatggagagtgcaagggtcactatgcaactatcaatcagattatgttttctgatgcttccaattctcatgttttaagctcttgttcttcagatggaactattagagcttgggacacaagaacatttcagcaggtttcttccatcaatgccggtccttctcaagaggtcttcagcttctcttttggagggcctggtgggaatttaattgctgccgggtgtaaatcacagatactcttttgggattggagaaataagaagcaaattgcatgccttgaagaatctcacgtggatgatgttactcaggttcattttgtccatgaagaacaaagcaagcttatttctacttcagtagatgggttgatatgcacgtttgataccaccggagatatcaatgatgatgatcatctagaatcagtgattaatgtggggacttcaattgcgaaagtggggatttttggagataactgtcagaagctttggtgtttaacacatatcgaaaccttgggtatctgggactggaaaaacggtacaaatgaagtaaacttctcggatgctcgtggtttagcttctgaaagctggaatttggatcaggtcgattattttgttgattgtcactactcgaaagaagctgaaaaactatgggtgattggtggaactaatgccggtgcattgggctactttcctgtaaatgacaagggacaggcaacaatcggaggcgcagaagcaatcctcgagggtggccatacagacgtcgttaggagtgttttacccatgtcgagatttcacggtggatctgctcctagtagtgttagctctggcatttttggatggacaggtggggaagatggtcgtttatgttgttggttatctgatgattccactcaaataaatcaatcatggattgcgagctcgatgattatgaagccagaaaaaactcgcaagaaaaaacgacatcacccgtattagcaacaccatgcattaacaacctttatagttcaatgccgaaggagtatttttgtaagttggttttggctttagttttaatctctatgatatggatcaatgaagggaacgactttatttgcctatgtcagctttatgtaatatttgattatattggatgtcaaatttttagtgttatactttattttataggaaatgaacagttttgtgctcatttacaaggtttcttgatgcatgatgcatgtcaagtaagcaaacatttacgtgaagtatttaagggttttatttggtaaaaactaatgacaatttgtatactagcaccagcacgtaatccttttgaccgaaaatgtatcttactttgaattagttgt

SEQ ID NO: 9052 - DNA, 1576 bp, Lupinus angustifolius
gacttcactgcacttaatcacagccgattaaaaccctaaaaccctagatagtttcgattggtaatactcttcttccctttcatcttcttcaacaccaacatcaatattaatatcaatggacatggatgttgaggaacaaccttcacccaacaaccttaaacgctttggtcttaaaaactctattcaaaccaacttcggcgacgactatgttttccaaatcatctcaaaggatgattggagttcaatggcagtgtcactttcaacgaatacagttaaactgtattcaccagagaggggtgaatattatggagaatgcaagggtcatcatgcaactattaaccagattctgttttcagatgcttccaatgctcatgttttaagctcttgttcttcagatggaactattagagcttgggacacaagaacatttcagcaggtttcttccattagtgccggtccttctcaagaggttttcagcttctctttcggagggcctggtggaaatttaattgctgccgggtgtaaatcacagatactcttttgggatttgagaaataggaagcaaattgcatgccttgaagaatctcatgtggatgatgttactcaggttcattttgtccatgaagaacaaggcaagcttatttctgcttcagtagatgggttgatatgcacatttgataccaccggagatatcaatgatgaagatcatctggaatcagtgattaatgtggggacttcaattgcaaaagtggggatttttggagataactatcaaaggctctggtgtctaacacatattgaaaccttaggtatctgggactggaaaaatggtagaaatgaagtaaacttctcggatgctcgtggtttagcttctgaaagttggaatttggatcaagttgactattttgttgattgccactattctaaagaagctgaaaaactatggctgatcggtggcactaatgccggtgcattgggctactttcctgtaaatcacaagggagtggcaacaattggaggtgcagaggcaattctcgagggcggccatacaggcgttgttaggagtgttttacccatgtcaagatttcatggtgcacctgctcctattagtggtagctctggcatttttggatggacaggtggggaagatggccgtctatgttgttggttgtccgatgattctcctcaaataaatcgatcgtggatttcgagcacactggttatgaagccagaaaagaccggcaagaaaaatcgtcaccacccctattagaagtaacatgccgatgcaatgcaatgcattaaacttcaatagttcaatgccaaaggagcatttatgtaagttagttttggtttaatttttaatcactataagctgggttgcttttgattaaagaaatactacacttatgcagatatgtgaacatattgtatctttattttatttgaaattttacagattattttataagttaagctctgctggtgccttatcaactttctgcaatatttataaaggatgtaaaaaatttggtgttatatttttataggtaatcaataactttgtgctcatttacaa

SEQ ID NO: 9053 - DNA, 1854 bp, Glycine max
gcctcataccttgatgccaagaaatcttctataattaattttgcttattctacattagcccgttatgcaaataaagagaggaaaataaggaatcaaatattcaactcgttttcccatccttttgtgtctctctttttccgtttcatacactttttctttacctttattgttccaatcttatcctatcctttaaatatacacacacaaaaatacattaacacttcaatcccacgctttcaatagatagatagagcattcattcatcaccaacatggctcttctaggcttaatgagttttgctgccttgacccttttcttggtcctaacaactgtgcctcgtcaagcacacgcttcaagccgtggcaacttaggcagaaacatcaacccttcagtgtatggcatatgtgcctcttctgtcattgtgcatggatacaagtgtcaagaacacgaggttacaactgatgatggttacattctgagcctgcaaaggatcccagaaggtcgaggtaaaagcagtgggagtgggacaaggaagcaaccagtggttatacaacatggagttcttgtagatggtatgacatggcttctaaacccaccagagcaagatctgccgttgattttagctgataatggatttgacgtgtggattgcaaacacaagaggaaccagatatagtcgccgacacatctcattggacccctctagccaggcctattggaattggtcttgggatgaacttgtctcctatgatttccctgcggtgtttaattatgtgttcagccaaacggggcagaagatcaattacgttggccattcattgggaactttggtagctttggcatccttctcggaaggaaaattggttaaccagctgaaatcagcagccttgttgagccctatagcctatttaagccacatgaatacagcacttggtgttgttgcagccaagtcctttgttggtgagatcactaccctcttcggtctagcagaatttaatccaaaagggttagctgttgatgcctttctcaagtctctctgtgctcaccctgggatagactgctatgacttgttgactgcactaactggtaaaaattgctgcctcaattcttcaactgttgatctattcttgatgaatgagcctcagtcaacatcaacaaagaacatggtgcacttggctcagactgttagacttggggcgttgacaaaattcaattatgtgagaccagactataacattatgcactatggagaaatatttcctccaatctataacctttccaacatcccccacgatctccctctcttcattagctatggtggaagagatgcactttcagatgtccgtgatgttgagaatttgcttgataaactcaagttccatgatgagaacaagcgcagcgttcagttcatccaggaatatgctcatgctgactacattatggggttcaatgccaaggacttggtgtataatgctgttctttcatttttcaatcatcaagtttaacactggatagaatgaatcaagttgtatgaaaagagtgccttcatgtattaggtagctatcattgagatcaatctaagttatctagtggagattaagtaacggctaattacaaaagtaatgaagtattatcactagtgatttgctttggtgttgcaaatggctattgcatctatctattgtgttgcattgtaatgcagaggaaagtggcttttggcttcagttatctaagatgaaaaacgtggatgagatcatttatcaaaagaattataaaaactatgtttccaaaccatgatgaagcatatgtatatgtatgtgtgcaaagtgctcaccactgtttacattatacgtag

SEQ ID NO: 9054 - DNA, 1785 bp, Cajanus cajan
atggctcttctaggcttagcgtgtttttctgctttgacccttttcttggtcctgcctcatgaagcacacgcttcaaaccgtggctcctttaggcagaaacatcgtcatccctccatcgtttggcatatgtgcctcttctgtcatcgtgcatggatacaagtgccaagaacatgaggttacaaccaatgatgggtacattctgagcctgcaaaggatcccagaaggtcgaggtggtggtggtggtgccagtggcactaggaagcaaccagtgatcatacagcatggtgttcttgtggatggtatgacatggcttctgaaccctccagagcaagacctgcctttgattttagctgataatgggtttgatgtttggattgctaacacaagaggaacaagatatagccgacgccacatctcattggacccctctagcccggccttttggaattggtcctgggatgaacttgtttcctatgatctccctgctgtgtttgattatgtcttcagccaaacggggcataagatcaattacgttggccattccctgggaactttgatagctttggcttccttctcagaagggaaattggttaaccagctgaaatcagcagccctgttgagccctatagcctatttaagccacatgcacaccgcacttggtgttattgcagctaggtcctttattggtgagatcactaccctctttggtttggctgaatttaatccaaaagggttacctgttgaagcctttctcaagtctctctgcaatcaccctgggatagactgctataacttgttgacggcattaactggtaaaaattgctgtcttaattcttcaactgttgatctattcttgatgaatgagcctcagtcaacatcaacaaagaacatggtgcacttggctcagactgtgagacatggggtgttggcaaaatttaattatgtgagaccagactataacatcatgcattatggagaaatattccctccaatctacaacctttccaatatccctcatgacctccctctcttcattagctatggtggcagagatgcactttcagatgttcgtgatgttgagaatttgcttgatatactcaagaaccatgatgaggataagcgtagtgttcagttcatccaggaatatgctcatgctgactacattatggggttcaatgccaaggacttggtgtataatgatgttgtttcgtttttcaatcgtcaagttaacgcttgatgggaagtgaactaaactacatcttacaaagaatcaagttgtaacaaacgagtgccttcatgtcactgagatcaatcttagttatctagtgatgattaactatgattaactaatactaatggccaattacaaaagtaatgaagttttactcgtgatttgctttggtgttgcaaatggctatatatatgcatcaatcaatatgtaaaatcataacaagtggttgctgggattcgtgggattcgtgcagaaacagacacggagtttaaaagaaaaagttcgaaaacatgtctattttgatttagaaggtgaaatgcattggaatactgatatataccatgcatcagaatttagatatagtaatatccatattttaccaaaaacaagtcatttatggacattatcaggaaaatcataaaggtctggatcaatctctttttcactcctttgtgttgcattgtaatgcagaggcaacttgtctctttaatagctatgttcaaacatctggtactaattatggccattggtcacttataattcaattcgttctg

SEQ ID NO: 9055 - DNA, 1285 bp, Vigna unguiculata
gtattatgataattttttacatcagtgtaaatgtaagggggaagaaaagaagcaccttgctcattcttgattccttttgctgcaatgagaatatatgatttatgttcctagaaaactcagaccttgaattttttatgcgtgtacaaggcttgaaaagttgacgcctttaggaaattcgagggatgagtttctcagtggcagcttccttgggtactcatattgcactgagaaacactcatgaagcaagaatcaagtgccactttttgtacagaagagaagagaacagtaaaattggtttcaagttctcaaagcacaaggccgttcaaagaaaaatttctctaagcaagcaagatttcagtgagttggatgagaggaagagcccagatgaggttagagaagagattaaaaaatgttatgaactcataaacagattagggagaggagctgtgtatctgggttcttcaaggatgggacccagccattcacattatgtgcaggcacaagagctggctaaagagatagcaaatcttttggactgcactacttggtcaggggctggacctgggctaatggatgcagttactcagggtgctatgctagcaggaaaaccggttggtgggttcaagataggaaaagaagctggtgaatggacagcatctaactttcatgcatacttaccatcagaaaattacctcacttgcaggtttttctctgcaaggaagcatgggctggtggatgctgtagtgaggaacaactcatttgataagactgctgtagtcacccttcccggtgggattggtactttagatgagttgtttgagatgctggcattgatccagctggaacggattggatcaaagcttcctgttcccttgctcttgatgaactatgattcgttttattcaaagctgcttgactttttgaatgattgtgagggttggggaacggtctctaaaggagaggttgcatcattgtggaaggtttgtaacagcaactcagaagctttggcgtacctagaagaattctatggaatttcttctattgacataagtaagaaagtaattcaatttcacagcacgtatggatctccctcctcataagatttttttactttccttttcttgctgaaatattgcaatattaccagttttttgttgacatttgacatgtgcacttgcaagttctgattgtacatgaaaggtatgctatgtttcatgcataatcacatttgggatttgaataaagtattaaaaggaaacaagttttctctaaaaaaagaaaaaaa

SEQ ID NO: 9056 - DNA, 1386 bp, Glycine max
gtgagtttccttttttgttatcttgtaaccgaccaaaaaaaaaaaaaacaactgtgtcttgttcacactgattctgtttcatggaatgagcatatattgtttgtgttcctagaaaactcagaccttgaattgttggtttgcttcttataaggcttgtagttgacgcctttaggaatctctcaaggatgggtttctcagtggcagcttcgttgggtacctatgttgtgctgagagacactcatgaaacaagaatcaagtgccaatttttgtgcagaaaagaacagaatagtagaattggtttcaagttttcaaagcacaaggccattcaaagtgcaattttttttagcaagcatgagttcactgatttggatgagaggaagagctcagatgaggttaaagaagagattaaaaaatgttatgaactcataaacagattagggagaggagttgtgtatctgggttcttcaaggatgggacctagccattcacattatgtgcaagcacaagagctggctaaagagatagcaaatcttttggactgcacttcttggtcaggggctggaccagggctaatggacgctgttactcaaggttctatgctagcaggaaaaccagttggtggattcaagataggaagagaagctggggaatggactgcgtctaactttcatccatacttaccgtcagaaaattatctcaccttccggtttttctcagcaaggaagcatgggctagtggacgctgtagtgaggaacaattcgtttgataaaactgctgttgttgcccttcctggtgggattggtactttagatgaggtgtttgagatattggcattgattcagctagaacggattggatcaaagtttcctgttcccttcctgttgatgaactatgattcattttattcaaagctgcttgaatttttaaatgattgtgagggttggggaactgtctctaaaggagaggttgcatcattgtggaaggtttgtaacagcaactcagaagctttggcatacctagaagaattctatggcatttcttctagtgacaaaagtaagaatgtaactaaactgtatagcacgtatgaatcaccgtcctcataagaatttttcttttgttttttcttcttcttaataattgttttctttctttaaaaggcttgaactgtagaatattctcctgaattattgcaatattagcaagtttgatggtagccatgtgcagtatcaagttctaattgcaccaaaaatgtatcttaggattcatctgtaatcacatttgtgatttggataaagtagcaaaaggaaatgagttttctctaattgttatctttcaacttttgagaagtttatttaatgactccccttagttatttttatcctcaag

SEQ ID NO: 9057 - DNA, 1370 bp, Glycine max
gtgagtttccttttttgttatcttgtaaccgaccaaaaaaaaaaaaaacaactgtgtcttgttcacactgattctgtttcatggaatgagcatatattgtttgtgttcctagaaaactcagaccttgaattgttggtttgcttcttataaggcttgtagttgacgcctttaggaatctctcaaggatgggtttctcagtggcagcttcgttgggtacctatgttgtgctgagagacactcatgaaacaagaatcaagtgccaatttttgtgcagaaaagaacagaatagtagaattggtttcaagttttcaaagcacaaggccattcaaagtgcaattttttttagcaagcatgagttcactgatttggatgagaggaagagctcagatgaggttaaagaagagattaaaaaatgttatgaactcataaacagattagggagaggagttgtgtatctgggttcttcaaggatgggacctagccattcacattatgtgcaagcacaagagctggctaaagagatagcaaatcttttggactgcacttcttggtcaggggctggaccagggctaatggacgctgttactcaaggttctatgctagcaggaaaaccagttggtggattcaagataggaagagaagctggggaatggactgcgtctaactttcatccatacttaccgtcagaaaattatctcaccttccggtttttctcagcaaggaagcatgggctagtggacgctgtagtgaggaacaattcgtttgataaaactgctgttgttgcccttcctggtgggattggtactttagatgaggtgtttgagatattggcattgattcagctagaacggattggatcaaagtttcctgttcccttcctgttgatgaactatgattcattttattcaaagctgcttgaatttttaaatgattgtgagggttggggaactgtctctaaaggagaggttgcatcattgtggaaggtttgtaacagcaactcagaagctttggcatacctagaagaattctatggcatttcttctagtgacaaaagtaagaatgtaactaaactgtatagcacgtatgaatcaccgtcctcataagaatttttcttttgttttttcttcttcttaataattgttttctttctttaaaaggcttgaactgtagaatattctcctgaattattgcaatattagcaagtttgatggtagccatgtgcagtatcaagttctaattgcaccaaaaatgtatcttaggattcatctgtaatcacatttgtgatttggataaagtagcaaaaggaaatgagttttctctaattgttatctttcaacttttgagaagtttatttaatgactccccttagt

SEQ ID NO: 9058 - DNA, 1379 bp, Cajanus cajan
taatatggctgtcttgtgtccgaccaaaaaaaagaataaaaaaaactgtgttgttcacactgattctgattccgttttctgcaacgattttgtgttcttcctagaaaactcagaccttgaattgtgggtgcttacaagacttgtaattgtcgtctttaggaatctcaatgatgggtttctcagtggcagcttcgttgggtacccatgttgtgcttagagacactcatcaaacaaaattcaagtgccaatttttgtgcggaacagaacagaataatagaattggttttgaattttcaaagcacaagggcatccatagagcaatttttgttagcaagcaagagttcactgagttggatgagaggaagagccctgacgaggttaaagaagagattaaaaaatgttatgaactcataaacagattagggagaggagctctgtatctgggttcttcaaggttgggaccaagccatgcacattacgtgcaagcacaagggctggctaaagagatagcaaatcttttggactgcacttcttggtcaggggctggaccagggctaatggacgctgttactcaaggtggcatgctagcaggaaaaccagttggtgggttcaagataggaaaagaagctggggagtggacagcatctaattttcatccatacttaccatcagaaaattacctcacgtgcagatttttctctgcacggaagcatgggctggtggatgctgtagtgaggaacaattcatttgataagactgctgttgttgcccttcctggtgggattggtactctagatgagatgtttgagatactggcactgattcagctggaacggattggatcagagcttcccgttcccttcctgttgatgaactatgattcattttattcaaagctgcttgactttttaaatgattgtgagaattggggaactgtctctagaggagaggttgcatcattgtggaagatttgtaacagcaactcagaagctttggcttacctggcagatttctatggcatttcctcaagtgaccgtaagaatgtaactaaattgtgtagcacgcatgagtcaccctcctcataagaatttttctttcctattttttccccggaataattgcctgctatttctaaaaggcatgagctgtagaatactctcctgaaccattgtactattaccaagttttatggttgacatttttggcttgtgtagtagcatgttctgactgcatataaagtgtatcttaggattcatctgtaatcatattcgtgatttggataaagttgtaaaagtaaaggagttttctctaattgtcatatcccaactgttgtgaggttattttccaacttcctttctttggttgattttgtcttcaag

SEQ ID NO: 9059 - DNA, 1223 bp, Glycine max
tcatcttcatctacatacatgcatcatcagtcatcaactgataactatctctgagtgttgagtggacaacactgacacgcatcatctctctcacattctcaaaatgctaaccttcaatctcaatgctatctcttcttcgttctcagttgttccatttcatgccaattatccactgtctactcaaacccaattgttagttccttccaatcttagttactcctttgctacaacaggaaccagaaagttcaagtctttccagctcaaggctggattttgggaatcaattaaatctgggttgatgaagaataactccatgcaagtcattgatccaccctctgcagatgaagaagacgaagaacctctgcctcaagagtttgttcttgtggaaaagacagaacccgatggtacaattgagcaaataatattctcttcaggtggagatgttgatgtttatgatcttcaagccctctgtgacaaggtagggtggccacgtagaccattgtcaaaattagctgccgctttgaaaaatagctatatagtggcctcactgcattctataagaaagtcacctgggtcagaggggaatgaacagaagagattaattggcatggcccgtgctacgtctgaccatgccttcaatgccacaatttgggatgtcctagttgatcctggctaccagggccaaggtcttggtaaagctcttatagagaaactgattcgaactcttctgcaaagggacattggcaatataactctgtttgcagatagtcaagttgtggaattttatcgcaatttaggctttgaagctgacccagagggcataaaaggcatgttttggtacccgaatcactaattgcaaccctaccaaagcttgtttttggattatgttaacattgcaatttgcaaccatgaaatatacaacgacagaagcagtgacaaatttatctatcacttgtaatacgaaagtataaagattgtacgtcaatcctgtaattattgtgttttaggtgtttgtaagttattcacttcttaaaaaagttttgcaacttttcgaacagatgatcatgagtctttgattatgcctgcttgatatttgtctgaaatccgtcagtgactacttactgattttttaatgttttttttcagttttggatgaattgttgtactatataaattagtggttttcttctgtcgtttctatgttgaatttaatatacatgaat

SEQ ID NO: 9060 - DNA, 1174 bp, Glycine max
gcatcatcagtcatcaactgataactatctctgagtgttgggtggacaacactgacacgcatcatctctctcacattctcaaaatgctaaccttcaatctcaatgctatctcttcttcgttctcagttgttccatttcatgccaattatccactgtctactcaaacccaattgttagttccttccaatcttagttactcctttgctacaacaggaaccagaaagttcaagtctttccagctcaaggctggattttgggaatcaattaaatctgggttgatgaagaataactccatgcaagtcattgatccaccctctgcagatgaagaagacgaagaacctctgcctcaagagtttgttcttgtggaaaagacagaacccgatggtacaattgagcaaataatattctcttcaggtggagatgttgatgtttatgatcttcaagccctctgtgacaaggtagggtggccacgtagaccattgtcaaaattagctgccgctttgaaaaatagctatatagtggcctcactgcattctataagaaagtcacctgggtcagaggggaatgaacagaagagattaattggcatggcccgtgctacgtctgaccatgccttcaatgccacaatttgggatgtcctagttgatcctggctaccagggccaaggtcttggtaaagctcttatagagaaactgattcgaactcttctgcaaagggacattggcaatataactctgtttgcagatagtcaagttgtggaattttatcgcaatttaggctttgaagctgacccagagggcataaaaggcatgttttggtacccgaatcactaattgcaaccctaccaaagcttgtttttggattatgttaacattgcaatttgcaaccatgaaatatacaacgacagaagcagtgacaaatttatctatcacttgtaatacgaaagtataaagattgtacgtcaatcctgtaattattgtgttttaggtgtttgtaagttattcacttcttaaaaaagttttgcaacttttcgaacagatgatcatgagtctttgattatgcctgcttgatatttgtctgaaatccgtcagtgactacttactgattttttaatgttttttttcagttttggatgaattgttgtactatataaattagtggttttcttctgtcg

SEQ ID NO: 9061 - DNA, 1154 bp, Cajanus cajan
acgcatagcatcatcatcatcagcatcacatacatgcatcatcagtcatcaactactatctgggtggacaagagtgacacgcatcatctctctcacattctcacaatgctaaccctcaatctcaatgctatttcttcttcgttctcggttgttccatttcatgccaattatccactgtctactcaaactcaattattagttccttccaatctcaattactcctttgctacaacagcaaccagaaagttcaagtcttttcagctcaaggctggattctgggaatcaattaaatctgggttgaagaagaataatacaacacaagtcattgatccaccctccacggatgaagaagatgaagagcctctgcctcaagagtttgtccttgtggaaaagacagaacctgatgggacaattgagcaaataatattttcttcaggtggagatattgatgtttacgaccttcaagccctctgtgacaaggtagggtggcctcggagaccattgtcaaaattagctgccgcattgaaaaatagctatatagtggcctcactgcattctataagaaagtcacctgggtcagttatttaacagaggggaatgaacagaagagattaattggcatggcccgcgctacatctgaccatgccttcaacgccaccatttgggatgtcctagttgatcctggctaccagggccaaggccttggtaaagctcttgtagaaaaactgatacgagctcttctgcaaagggacatcggcaatataactctgtttgcagatagtcaagttgtggaattttatcgcaatttaggctttgaagctgacccagagggcataaaaggcatgttttggtacccgaatcactaattggaaccccagaaagcttgcttttggttatgttaacattgcaatttgcaaccatgaagtatactagagagaagcagtggcaaatttacctattacttgtaatacgtcattcctgtaattattatgttcattaggtgttagtaagttattcttttttccaaagttttgctacttttcaaacacggctttgattagtatgtctgctttatatttgataaacctgaaaatggtcagttataaacttactgattgtgatttattatatatatacactagcagagaaaaaaa

SEQ ID NO: 9062 - DNA, 1296 bp, Glycine max
ggacaatactgacacgcatcatctctctcacactctcaaaatgctaatcttcaatgtcaatgctatctcttcttcgtgagttatctttgtttatctcctatcttgtaccactcttttttttatgcttacttttagtattgattattacttatacatgtgtttatgttgtttcaggttctcagttgttcaatttcatgccaattatccactgtctactcaaactcaattgttagttccttccaatcttaattactcctttgctacaacagcaaccagaaagttcaagtcttttcagctcaaggctggattctgggaatcaattaaatctgggttgatgaagaataactcaatgcaagtcattgatccaccctccacagatgaagaaaatgtagagcctttgtctcaagattttgtccttgtggaaaagacagaacccgatggtacaattgagcaaataatattctcttcaggtggagatgttgatgtttatgatcttcaagctctttgtgacaaggtagggtggccgcgtagaccgttgtcaaaattagctgccgctttgaaaaatagttatatagtagcctcactacattctataagaaagtcacatgggtcagaggggaatgaacagaagagattaattggcatggcccgtgctacgtctgaccatgccttcaatgccacaatttgggatgtcctagttgatccaggctaccagggccaaggtcttggtaaagctcttatagagaaactgattcgaactcttctgcaaagggacattggcaatataactctgtttgcagatagtcaagttgtggaattttatcgcaatttaggctttgaagctgacccagagggcataaaaggcatgttttggtacccgaaccactaattgcaaccctaccaaagctttttttgcttaggtcaacaatgcaatttgcaaccatgaagtatacaagagagaagcagtgacaaatttatctatcactcataatatgaaagtagaaaggttcaatccagtaattattgtgttttaggttttataagttattcatttttccaaagttttgctacttttcaaacagatgatcatgatgaggctttgattagtaggcctgctttatatttgaaaaacataaaatccaccacttactgactgtggtttttttttttttcttcatttttggatgaattattgtactatataaggttagtggttttcttcgggcgtttctatgttgagtcttaataggcatgaattgtcaatgtaaaagtttcaaaattattatttgatagaga

SEQ ID NO: 9063 - DNA, 1365 bp, Cicer arietinum
cattcattcattcattcgttaattcgtgcaccagtcatcaagtaatttgtatagtcacatttaaatcatccaatccaatccaaaacaaaccaaaccaaaccaatattcagaaaaatgctaaccctcaatctcaatcctctttcttcttcgttctcaattcatgccaattatccactctttactcaaattcagttattagctcctactaatcttaattacccttttgctaatacagctaccagaaagtttaggacttttcagctcaaggctggattttgggactcaattaaatctgggttgatgaagaataacaccactcaagtcatcgacccacagtcagcagaggaagaagacgaagaacctctacctcaagaatttgtgcttgttgaaaagactgaatctgatggaacaattgagcaaataatattctcttcgggtggagatattgatgtttatgatcttcaagccctttgtgacaaggtagggtggccacggaggccactgtcaaaattagctgctgctttgaaaaatagctatatagtggcctctctgtattctataagaaagtcaccagggtcagaggggaatgaacagaagagattaattggcatggctcgtgctacatcagaccatgccttcaatgccacaatttgggatgtcctagttgatcctggctaccagggccaaggtcttggtaaagctcttgtagagaaacttattcgaactcttttgcaaagggacattggtaatataactttgtttgcagatagtaaagttgtggaattttatcgcaatctaggttttgaagctgacccagagggcattaaaggcatgttttggtacccaactcactagttgcaaccctgcaaaaagttttctttatactcttgttacattgtttaacattgcaacctgaagtatacaaggttacagcagtgccaaatttgtaatatcaaaatataaatcttggacaccaatcctgtaattattctgttaggtggtagcaagataatattttcccccaaagttttactactttttcaaacagataattttgaggctttggttaatgaatcagtatgttattgtcttttatatagaaaaatgggagagcaactttacccccacgttatatgattccagaaatacacatcctggaaaaatccatgttttttttcagaattacacatctgaactgcagaaaaactttttttagatgtgtatttctgaagtgcttttggggtgcgggaaaagatcctcccaaaaattttcttcttgaatcaatggttgtatcactgtgtaaggagtatggatctgcccatttcagaatctagtagtctctgattaagagttgaaagttatttt

SEQ ID NO: 9064 - DNA, 1199 bp, Glycine max
ctatcttgtaccactcttttttttatgcttacttttagtattgattattacttatacatgtgtttatgttgtttcaggttctcagttgttcaatttcatgccaattatccactgtctactcaaactcaattcaaccagaaagttcaagtcttttcagctcaaggctggattctgggaatcaattaaatctgggttgatgaagaataactcaatgcaagtcattgatccaccctccacagatgaagaaaatgtagagcctttgtctcaagattttgtccttgtggaaaagacagaacccgatggtacaattgagcaaataatattctcttcaggtggagatgttgatgtttatgatcttcaagctctttgtgacaaggtagggtggccgcgtagaccgttgtcaaaattagctgccgctttgaaaaatagttatatagtagcctcactacattctataagaaagtcacatgggtcagaggggaatgaacagaagagattaattggcatggcccgtgctacgtctgaccatgccttcaatgccacaatttgggatgtcctagttgatccaggctaccagggccaaggtcttggtaaagctcttatagagaaactgattcgaactcttctgcaaagggacattggcaatataactctgtttgcagatagtcaagttgtggaattttatcgcaatttaggctttgaagctgacccagagggcataaaaggcatgttttggtacccgaaccactaattgcaaccctaccaaagctttttttgcttaggtcaacaatgcaatttgcaaccatgaagtatacaagagagaagcagtgacaaatttatctatcactcataatatgaaagtagaaaggttcaatccagtaattattgtgttttaggttttataagttattcatttttccaaagttttgctacttttcaaacagatgatcatgatgaggctttgattagtaggcctgctttatatttgaaaaacataaaatccaccacttactgactgtggtttttttttttttcttcatttttggatgaattattgtactatataaggttagtggttttcttcgggcgtttctatgttgagtcttaataggcatgaattgtcaatgtaaaagtttcaaaattattatttgatagagattatttttggcataaattttaaaggtttaaatatgttttta

SEQ ID NO: 9065 - DNA, 2436 bp, Glycine max
ttaagtgaaataaatgatgttattttccccctgaaggctgaaggaggatgagtccagcgaatctggaggaggagtgcttgaaacttctgaaaggagagcgagacgaacagcgtctggctgggcttcttctggtaaccaagttctgcaaagctgaggatcagtcctcagtccgtagggtctacgatgcggttggacctcactttctctatcgcctcctcagaaccggtatggcaagcggaggaggaggcctcaacgataaccggaatgcctacttaagcttatccatcacggttctcgccacattttgtcgtgttccagatattgcttcctcggaggacatgcttttctatatcccccttgtcttggaagtaatatccaccgggtctgtcttatctgttcttgaagaatgctatgagtttctatacttggtgtcagctgcttctgaaagtggaatcgcgagatttttcgaatccggaggcatcaagatactagcttctcaaatgcgttctcttcacgatggttcacatctgatggaattatcttttaaacttttgcaattgattctgggtaggacgtcctcggacataattcagaataatgacttatctgaaatctcagttattgtggcagcaatagcaaggcagtttgctgtcttgcacaattccttgaaatttgaagctctccacctactaaatgccattctttcctcaaaagattcatcacaacttcgtgatgccttccgattacttcctcaagatagctggtcacccaatatacgcattggtataatggctattttgcagaatcgtgttgcacctgctgaaaggttgcaggctctcattttagccgagtctatggtttccatgtatggagaagattggttgattggccaagtaagcacaaatgatgcactagatccagctccagctgacatgtgcttgttgcttgtcttggagcagtcaagggttgaaattgctgttcttctgaatgagttggcgtacttaaaatatgaagcacctcaggatacttctgccacagctgaagcaattttttcaaagcgacataatgtggctgttgcttactccttggttgagaggataataaaattaatatcaaatgttgaaggaaatgatggaaacctccttgatgaaggcacattgacaaagctgattcaccaactgaatgagacaattgctgttgtactagagtatttagaagatgcaaaggaacatgggcaaaagaaaggagatgatttacttgcttcagtgcgaattattgggagctatcttgcagaagcacctgtagcatgcaaggagaaggttcaagatcttttagggtatatgctttctcttgaaggtgaagatgaacaaaggcccttctacgctgtttgctttctgctacctatgttgtctcaaattactatggagattgaaggatgcaaagctttggcttcatgtaaaggacttgaggctgttttagattgcttcagtaaattagttgggtcacatgcttttctggttgaggataatggttgcatctttatggcatgtgatacaataatgaatcttttattaaagaaagacaaagttcagataaagttggatgtatcagctattgttgatcttcttaaagtgttggctcattggtcagaaaacactgatgaaatgtcaagtatgatgatggcttcaagcatttgtacactgatatttgattatacatcagaagaggctcttttaaactgtccagatttcgactatagaactcttagcagtctttatcttctcattgcaagatgtctggcatcatcagaacaggatactaaagtggatatggatctttctgagattgtctcttctggcttctctcgatgggctcatcggtacccccacatcagagacgctgtcaagaactaattttgatcctctcgatctggattagttagagatggatactttcaacttccaaggtattatcattgttgaagtgaactaatgatgtgccaaatacatggaattggaaaaagactacctatcagaggattgaagctcatggttacaaatcaatgcctttagatcgcatccctccttgcccataaccggttaaaaagggacacagaccttttgttacaagtaggaaaaaccatggtctccacatattgtgaacatactatgagaaatttgaatacggagacttgtgacgcttgttaaaaaaaaagaatttgttcgttttagcacaggatagaaaaataaatagtcgtctgtatatccaaactgtttgtaccattattttccgttaggagatataggttttagataacattttaatccatgtttttcttattagattttggtccctaatttcttttttcttttggtattgatttataatctttatgcattcacattttttctattgattttggtcccctattcttag

SEQ ID NO: 9066 - DNA, 2392 bp, Glycine max
ttttccccctgaagctgaggtgaggatgagtccagcgaatctggaggaggagtgcttgaaacttctgaaaggagagcgagacgaacagcgtctggctgggcttcttctggtaaccaagttctgcaaagctgaggatcagtcctcagtccgtagggtctacgatgcggttggacctcactttctctatcgcctcctcagaaccggtatggcaagcggaggaggaggcctcaacgataaccggaatgcctacttaagcttatccatcacggttctcgccacattttgtcgtgttccagatattgcttcctcggaggacatgcttttctatatcccccttgtcttggaagtaatatccaccgggtctgtcttatctgttcttgaagaatgctatgagtttctatacttggtgtcagctgcttctgaaagtggaatcgcgagatttttcgaatccggaggcatcaagatactagcttctcaaatgcgttctcttcacgatggttcacatctgatggaattatcttttaaacttttgcaattgattctgggtaggacgtcctcggacataattcagaataatgacttatctgaaatctcagttattgtggcagcaatagcaaggcagtttgctgtcttgcacaattccttgaaatttgaagctctccacctactaaatgccattctttcctcaaaagattcatcacaacttcgtgatgccttccgattacttcctcaagatagctggtcacccaatatacgcattggtataatggctattttgcagaatcgtgttgcacctgctgaaaggttgcaggctctcattttagccgagtctatggtttccatgtatggagaagattggttgattggccaagtaagcacaaatgatgcactagatccagctccagctgacatgtgcttgttgcttgtcttggagcagtcaagggttgaaattgctgttcttctgaatgagttggcgtacttaaaatatgaagcacctcaggatacttctgccacagctgaagcaattttttcaaagcgacataatgtggctgttgcttactccttggttgagaggataataaaattaatatcaaatgttgaaggaaatgatggaaacctccttgatgaaggcacattgacaaagctgattcaccaactgaatgagacaattgctgttgtactagagtatttagaagatgcaaaggaacatgggcaaaagaaaggagatgatttacttgcttcagtgcgaattattgggagctatcttgcagaagcacctgtagcatgcaaggagaaggttcaagatcttttagggtatatgctttctcttgaaggtgaagatgaacaaaggcccttctacgctgtttgctttctgctacctatgttgtctcaaattactatggagattgaaggatgcaaagctttggcttcatgtaaaggacttgaggctgttttagattgcttcagtaaattagttgggtcacatgcttttctggttgaggataatggttgcatctttatggcatgtgatacaataatgaatcttttattaaagaaagacaaagttcagataaagttggatgtatcagctattgttgatcttcttaaagtgttggctcattggtcagaaaacactgatgaaatgtcaagtatgatgatggcttcaagcatttgtacactgatatttgattatacatcagaagaggctcttttaaactgtccagatttcgactatagaactcttagcagtctttatcttctcattgcaagatgtctggcatcatcagaacaggatactaaagtggatatggatctttctgagattgtctcttctggcttctctcgatgggctcatcggtacccccacatcagagacgctgtcaagaactaattttgatcctctcgatctggattagttagagatggatactttcaacttccaaggtattatcattgttgaagtgaactaatgatgtgccaaatacatggaattggaaaaagactacctatcagaggattgaagctcatggttacaaatcaatgcctttagatcgcatccctccttgcccataaccggttaaaaagggacacagaccttttgttacaagtaggaaaaaccatggtctccacatattgtgaacatactatgagaaatttgaatacggagacttgtgacgcttgttaaaaaaaaagaatttgttcgttttagcacaggatagaaaaataaatagtcgtctgtatatccaaactgtttgtaccattattttccgttaggagatataggttttagataacattttaatccatgtttttcttattagattttggtccctaatttcttttttcttttggtattgatttataatctttatgcattcacattttttctatt

SEQ ID NO: 9067 - DNA, 2429 bp, Cajanus cajan
aaatggtgttcatgaatgaagggaacacagagtccgaatctggaggactgcttgaaacttctcaaaggagagagagacgaacagcgtctcgccgggcttcttctggtcaccaagttctgcaaagctgatgatcacgcctcacttcgaagggtgtatgatgcggttggccctcgttttctgtatcggctactcagaactggtatgggaagtggaaccaacgataatcgggatgcatatttgagcttatccatcacggttcttgctgtgttttgccgtgttccggagattgcttccactgaagacatggttttgaatatcccacttgtgttggaagcaatatccacccagtctggcttgtctgttcttgaagaatgctatgagtttttgtacttggtatcagctgcttctggagatggaatcacaagattttgtgaatctgggggaatgaaaatgctagcttctcaaatgtgttccatggaagatggttcacatctgatggaattatctttcaaactgttgcaattgattctgagtaggaagtccttggacataatccagaatgatgtcttatctgagatctcagttattgtggcagcaatagcaaggcagtttgctgtcttgcacaattccttgaaatttgaagctctccatctactaaatgccattctttcctcaaaagattcatcacaactccgtgatgccttccggttgcttcctcaagatagctggtcatccaatatccgcattggtataatggctattttgcagaatcgtgttgctcctgctgaaaggctgcaggctctcattttagctgagtctatggtttccatgtatggagaacattggttggtgagccaagtaagcaaaaatgatgcaaaaaatccagctccagctgacatgtgcctgttgcttgtcttggagcagtcaagggtagaaattgctgttcttctgaatgagttggcctatttaaaatacgaagcacctcaagatacttcagctactgccgaggcaattttttctaagcaacataatgtggctgttgctttctctttggttgagaagataataaaattaatatctaatgttgatgatggaaacccgcttgatgaaggcacactgacaaagctgattctccaactcaatgagacaattgctgtcgtactagagtatttagaagatgcaaaggaacacaggcaaaataaaggggatgatttactggcttctgtgcggattattgggagttatcttgcagaagcgcctgtagcatgcaaggagaaggttcaagatcttttagggtatatgctttctgttgaaggtgaagatgaacagaggcccttctctgctgtttgctttctgctacctatgttgtgtcaaattactatggagattgaaggatgcaaaactttggcttcgtgcaaaggacttgaagccgtttcagattgcttcagtaaattagttgggtcacatgcttttctggttgaagataacggttgcatctttttggcatgtgatacaataatgaatcttctattaaagaaagacaaagtgcagataatgttggatgaattagccattgttggtcttcttaaaacgttggcttattggtcagaaaatactgatgaaatgtcatgtttgatgatggcttcaagcatttgcgcactgatatttgattatacatcagaagaggctcttttaaaccgtcctgatttcaactatagaactcttagcagtctttataagctcattggaagatgtctggcttcatcagaacaggattctaaagcggatatggatctttctgagattatatcttcgggcttctctcgatgggctcatcggtatccccacatcagagaggctgtcaagaactgattctgatcctcttgatctggattggttataggtggatgctttcaacttccaaggttcattgttaaagtcaactaatgatgtgccaatacattgaattgtaaaatagctactagtggagatggggtgtaagggtcttcagatcagatgatttaagctcatggttacaaatcccttaaaaaagggaacagacctattacagggtaggaaaatcatggtcaggctacaaaagtttcctgtcttcacatattgtgaataatctgacgagatcatccaaactggagaaatttgagcagagactagtgacccttgtttaatggggaaaaaatttgttggttttaggacaggatagaaaaataacattacatagttagtctgtatatccgaaccttttgtaccattattttctatcaggagttataggtttggataacattttagttcatgtggtttttgcccattagattttggatcctaattgtttcctttggtattgagctgtaatttatatgcattcactctctttttttattggtagctagatttgatcgtagttttaa

SEQ ID NO: 9068 - DNA, 2420 bp, Glycine max
ataaaaaatgttatttcccccctgaaggctgaaggagcgaatatggaggaggagtggttgaaacttgtgaaaggagagcgagacgaacagcgtctggctgggcttcttctggtaaccaagttctgcaaagctgaggatcagtcctcagtccgtagggtctacgatgcgcttggacctcactttctctatcgcctcctcagaaccgctatggcaagtggaggaggaggcctcaacgataaccgcaacgcctacttaagcttatccatcacgcttcttgccgcattttgtcgtgttcccgatattgcttcctcggaggacatgcttttccatatcccccttgtcttggaagtaatatccaccaggtctgtcttatctgttctcgaagaatgctatgagtttctatacttggtgtctgctgcttctgaaagtggattcgcgagatttttcgaatccggaggcatcaagatgctagcttctcaaatgcgttctctgcaagatggttcacatctgatggaattatcttttaaacttttgcaattgattctgggtaggacgtcctcggacataattcagaataatgacttatctgaaatctcagttattgtggcagcactagcaaggcagtttgctgtcttgcacaattccttgaaatttgaagctctccacctactaaatgccattctttcctcaaaagattcatcacaacttcgtgatgccttccgattacttcctcaagatagctggtcacccaatatccgcattggtataatggctattttgcagaatcgtgttgcacctgctgaaaggttgcaggctctcattttagctgagtctatggtttccatgtatggagaagattggttgattggccaagtaagcacaaatgatgcactagatccagctccagctgacatgtgcctgttgcttgtcttggagcagtcaagggttgaaattgctgttcttctgaatgagttggcttacttaaaatatgaagcacctctggatacttctgccactgctgaagcaatttttttgaagcgacataatgtggctgatgcttactccttggttgagaggataataaaattaatatcaaatgttgaaggaaatgatggaaacctccttgatgaaggcacattgacaaagctgattcaccaactgaatgagacaattgctgttgtactagagtatttagaagatgcaaaggaacatgggcaaaagaaaggagatgatttacttgcttcagtgcgaattattgggagctatcttgcagaagcacctgtagcatgcaaggagaaggttcaagatcttttagggtatatgctttctctcgaaggtgaagatgaacaaaggcccttctacgctgtttgctttctgctacctatgttgtctcaaattactatggagattgaaggatgcaaagctttggcttcatgtaaaggacttgaggccgttttagattgcttcagtaaattagttgggtcacatgcttttctggttgaggataatggttgcatctttatggcatgtgatacaataatgaatcttttattaaagaaagacaaagttcagataatgttggatgtatcagctattgttgatcttcttaaagcgttggctcattggtcagaaaacactgatgaaatgtcaagtatgatgatggcttcaagcatttgtacactgatatttgattatacatcagaagaggctcttttaaactgtccagatttcgactatagaactcttagcagtctttatcttctcattgcaagatgtctggcatcatcagaacaggatactaaagcgtatatggatctttctgagattgtctcttctggcttctctcgatgggctcatcggtacccccacatcagagacgctgtcaagaactaattttgatcctctcgatctggattagttagagatggatgctttcaacttccaaggtattatcattgttgaagtgatctaatgatgtgccaaataatacatggaattggaaaaaggctacctatcagaggattgaagctcatggttacaaatcaatgcctttagatcggatccctacttgcccataaccggttaaaaagggacacagaccttttgttacaagtaggaaaaaccatggtctccacatattgtgaacatactatgagaaatttgaatacggagacttgtgacgctcgttaaaaaaaaaaagaatttgttcgttttagcacaggatagaaaaataaatagtcgtctgtattccaaactgtttgtaccattattttccgttaggagatataggttttagataacattttaatccatgtttttcttattagattttggtccctaatttcttttttcttttggtattgatttataatctttatgcattcacattttttctattgattttggtcccctattcttag

SEQ ID NO: 9069 - DNA, 2402 bp, Glycine max
cccctgaaggctgaaggagcgaatatggaggaggagtggttgaaacttgtgaaaggagagcgagacgaacagcgtctggctgggcttcttctggtaaccaagttctgcaaagctgaggatcagtcctcagtccgtagggtctacgatgcgcttggacctcactttctctatcgcctcctcagaaccgctatggcaagtggaggaggaggcctcaacgataaccgcaacgcctacttaagcttatccatcacgcttcttgccgcattttgtcgtgttcccgatattgcttcctcggaggacatgcttttccatatcccccttgtcttggaagtaatatccaccaggtctgtcttatctgttctcgaagaatgctatgagtttctatacttggtgtctgctgcttctgaaagtggattcgcgagatttttcgaatccggaggcatcaagatgctagcttctcaaatgcgttctctgcaagatggttcacatctgatggaattatcttttaaacttttgcaattgattctgggtaggacgtcctcggacataattcagaataatgacttatctgaaatctcagttattgtggcagcactagcaaggcagtttgctgtcttgcacaattccttgaaatttgaagctctccacctactaaatgccattctttcctcaaaagattcatcacaacttcgtgatgccttccgattacttcctcaagatagctggtcacccaatatccgcattggtataatggctattttgcagaatcgtgttgcacctgctgaaaggttgcaggctctcattttagctgagtctatggtttccatgtatggagaagattggttgattggccaagtaagcacaaatgatgcactagatccagctccagctgacatgtgcctgttgcttgtcttggagcagtcaagggttgaaattgctgttcttctgaatgagttggcttacttaaaatatgaagcacctctggatacttctgccactgctgaagcaatttttttgaagcgacataatgtggctgatgcttactccttggttgagaggataataaaattaatatcaaatgttgaaggaaatgatggaaacctccttgatgaaggcacattgacaaagctgattcaccaactgaatgagacaattgctgttgtactagagtatttagaagatgcaaaggaacatgggcaaaagaaaggagatgatttacttgcttcagtgcgaattattgggagctatcttgcagaagcacctgtagcatgcaaggagaaggttcaagatcttttagggtatatgctttctctcgaaggtgaagatgaacaaaggcccttctacgctgtttgctttctgctacctatgttgtctcaaattactatggagattgaaggatgcaaagctttggcttcatgtaaaggacttgaggccgttttagattgcttcagtaaattagttgggtcacatgcttttctggttgaggataatggttgcatctttatggcatgtgatacaataatgaatcttttattaaagaaagacaaagttcagataatgttggatgtatcagctattgttgatcttcttaaagcgttggctcattggtcagaaaacactgatgaaatgtcaagtatgatgatggcttcaagcatttgtacactgatatttgattatacatcagaagaggctcttttaaactgtccagatttcgactatagaactcttagcagtctttatcttctcattgcaagatgtctggcatcatcagaacaggatactaaagcgtatatggatctttctgagattgtctcttctggcttctctcgatgggctcatcggtacccccacatcagagacgctgtcaagaactaattttgatcctctcgatctggattagttagagatggatgctttcaacttccaaggtattatcattgttgaagtgatctaatgatgtgccaaataatacatggaattggaaaaaggctacctatcagaggattgaagctcatggttacaaatcaatgcctttagatcggatccctacttgcccataaccggttaaaaagggacacagaccttttgttacaagtaggaaaaaccatggtctccacatattgtgaacatactatgagaaatttgaatacggagacttgtgacgctcgttaaaaaaaaaaagaatttgttcgttttagcacaggatagaaaaataaatagtcgtctgtattccaaactgtttgtaccattattttccgttaggagatataggttttagataacattttaatccatgtttttcttattagattttggtccctaatttcttttttcttttggtattgatttataatctttatgcattcacattttttctattgattttggtcccctattcttag

SEQ ID NO: 9070 - DNA, 3936 bp, Cajanus cajan
ggaatgttgaattacgatattttaattcttgattggtagccggttttggctggatttgggttgttggtttttatatcagaagcagaaaggaataccttgaaagttgaaagtgaaagtacatttctgattcaatggccgcttccggtgaaaggtggattgaccgtcttcagttttcctcattgttctggcctcccccaccagatgaacaacaaagaaaggatcaaattgctgcgtatgttgaatacattggtcaatttacatcagaacagtttcctgatgatattgctgagttgatccgcaaccgatatccatcaaaagaaatgctcctcttcgacgatgttttggctgtacttgttcttcatcatccagagcatgggcatgcagttgtgcttccaatcatttcatgtattattgatggtacgctggtctatgataagactagtcctccatttgcttctttcatttctttagtctgcccaaaaagtgagaatgaatattcagaacagtgggctctggcatgtggtgaaattttgcgtattttaactcattacaatcgtcccatatacaaaaatgaaagacaatattgtgaagctgaaggaagcagtggcaaaagccctgcaactactaagggttctgtagatggggagtctggccataattctttgatgcaacaggagaagaaacctataagacccttatccccttggattactgatatattattggctgcacctttaggcattagaagtgactattttcggtggtgcagtggtgttatgggtaaatatgctgcaggagaactcaagccacctacaattgtttctgcacgtggttctgggaagcatcctcaactcatgccatcaaccccaagatgggcagttgctaatggtgctggtgttatattaagtgtttgtgatgatgaagttgctcgatatgagactgctactttaacagcagctgctgtccctgcactactgcttcctcctccaacaacagctttggatgagcatcttgttgccggattaccagctctagaaccatatgcacgtttatttcacagatattatgccattgcaactcctagtgcaactcaaagacttcttcttggacttttagaagcacccccgtcatgggctccagatgcacttgatgctgctgtgcagcttgtagaacttcttagagctgctgaagattatgcttgtggtataaggcttccaagaaattggatacattttcatttcttacgtgccatagggactgcaatgtccttgagatctggtgtagctgctgatgctgcagctgcattgcttttccggatactttctcagcctgctttactttttcctccattaaggcaagttgatggagtcgaagttcaacatgaacctttgggtggctatatttcttctaacagaaagcagattgaaactgctgcaactgaagccactattgatgcaactgcccaaggcattgcctcaatgctttgtgctcatggttcagaagttgagtggagaatttgtaccatttgggaagctgcttatggtttgattccattaaattcctcagctgttgatcttccagagattgtggttgcaacaccacttcaacctcccatactctcatggaatttgtacatacccctactcaaggttctggaatatcttcctcgtggaagtccatctgaagcatgtctcatgaaaatatttgttgctacagtcgaagctattcttcagaggacatttccagttagtgatcaaaaacgaaacccaagatactattgcgtggggtctgcctccaaaaaccttgctgttgcagaacttcgtaccatggtgcattcacttttcttagaatcatgtgcatctgttgagcttgcttcacgccttctatttgttgtcttaactgtttgtgttagtcatgaggtccaattcaatggaagcaagaaaccaagaggtgaagatagttattcggtggaggaaattactgaggatttacaagcagtaactaaaagccagaaaaaaacgaaaaataggaaaatgaagaagcaaggtcctgtagcagcatttgattcttatgttctggctgctgtttgtgctcttgcgtgtgagcttcagttgttccctgtggtttcacgaggagacaatcaagcagttcccaacaatgtacaaaatatagccaagcctgtcaaaatagatgtatcttctcatgagttgcagaatggcatagattcagcaatacgccatactcgcagaattttatcaattttagaggccctattttcattgaagccatcttctgttggtacctcatggagttacagctcaaatgaaatagttgcagcagctatggttgctgcacatatttctgagctatttagacggtcaaaagcttgcatgcgtgctctgtctgttttgatgcattgcaaatgggataatgaaattcattttagggcttcatcattgtacaatctcatagatattcacagcaaagctgttgcatccatagttaacaaggcagagccattgggagcaaccttaattcatacccctatttgtaaagacccctgtggtagttgtaaaagacaaaatcagtgtgaaaataatagctgccttgactctggacagagatctatttcaacttctgaggattcacctccctcagaactcagtcaaaaatgcaagagaacttcatattcaaatgaaccatcaagatttagctttgcaaaagttgccacaagtctcctatttgatgcttctgatctagccaacttccttactaatgataggcacataggattcaattgcagtgcccaaatttttctgagatctaggcttaccgagaagcaagagttatgtttctctgtagtatcattactatggcagaagttgattgcatctcctgagactcaaccttgtgcagaaagcacttctgctcaacaggggtggagacaggtggttgatgcattatgcaaggttgtatctgcatcacctgtgaaagcagctacagcaattgttcttcaggctgagaaggaattgcagccatggattactaaagatgacagtctaagccagaagatgtggagaatcaatcagcgtattacaaaattgataattgaactaatgaggaatcatgatagtttagaatcattagtaattgtggcaagtgcatcagatttactactgcgagccacagatggaatgctagtagatggagaagcttgcacattaccacaactaaagctattggaagctactgctaaagcagttcagccagtcatcgagttgggagaatctggatttgcagtggcagatagcctttcaaacctgttaaagtgtcgccttccagctacaatcagatgcctttctcatccaagtgcacatgtccgtgctctcagcacttcagttttgcgtgacatttggcaaactagttcaattagatcgagtcctaagccacagcaaaagaatggcacccataatcagtacttcaatttggatctcattgaccagcaaactcacatagaaaaatgtttgacatgggaagctcacagccggctttcaaatggattgtctattgaatatcttaacactgctgcgaaggatttgggcttttctatttctatctgatacgaaaccatgtgtaaaatccatcttagcctttaacaaatttcatctctaggtttgtagaaaacttgacttttttatgtttaggagcttaatggtttgcaattaaagtaaaccttctcattctgccagtttctgttattaagtcagaaacttgattgttattccatctttctttcctaaacacgagttcaagcaatgattaccgtgtatagaaataggcgggtatagctaacaggcacatataatatttaaatcttgaagcacgaactatgtcattaacgatttaatttaattctttcttgtcacgtcaccattt

SEQ ID NO: 9071 - DNA, 1267 bp, Vigna unguiculata
aggttttgaaattattaggctttcatctcagacagagtgttgtgaaaaatgatagatctaagcacactcaatcccgcacagattaccgtgctgggatccgcgttttgtgttatgctttccatgcatttcacgtcgcagttattgtctcagcatctcttctattggaagaatccaaaagagcaaaaggctattatcatcatcattcttatggctcccctttatgcaactgtctcctttgtgggtctcttggatattagaggaagcaaagagtttttcacctttttggagtcagtcaaagaatgttatgaagctttggtcattgccaagtttttggctttgatgtatagttacttgaacatatcaatcagtggaaacactgtgcccgatgaaattaaaggcagggaaattcaccactcttttcccatgacactttttcagccacgtattgttcacctgaactaccgtaatttgaagcttctaaaatattggacatggcaatttgttgttatccgtccagtatgttccattctgatgatagcattacagttacttgggctgtatccaacttggttgagctggacattcaccgccatcctcaacgtatctgtgtcgttagctttgtattctctggtggtcttttaccatgtgtttgctaaagaactggcaccacacacgcctctagcgaaattcttgtgtatcaaaggaattgttttcttctgcttttggcagggaatgttgctggaccttttagcaaaatttggcgtcattcaatctcgtcatttgcggttagatgtggagcacattgaggaagcaatgcagaatattttggtatgtgtagagatggttatcttttctgttctgcaacagtatgcttatcatcctgcaccatatagtggagaagttgagaagatgcttagacaaaacaagaaaaatgactaaatatgataagctaaaaaacccagtctacagagatgtatttaagagttcttcattgtggcgctagaaacatgaaaacatttatgccaagtggatttgttattttttaatgttagtttactgtacaaggctgcccatccaccacctgtgtaatgttttccttttagttgtaatttcccagccatactaaaaaagatttaatttttattatcattattcgctatcttgatcaagatgatatatatttctgattactgtattacagtcagagatacttccatggtctggatcgagggaatagctgatcaatacattaacagaaacttgaatt

SEQ ID NO: 9072 - DNA, 1415 bp, Glycine max
catcgcttcggctgccattgaaagaaactgttgaatcgcgtcgattaaggttttgagatttctaggctttcatctcagacagtgaaaaaatgatagatataagtacacttaatgctgcacagattactgtgctgggatctgccttttgtgctatgctttccatgcatttcacgtcgcagttactgtctcagcatctcttttattggaagaatccgaaagagcaaaaggctattatcattatcatcctcatggctccaatctatgcagctgtctcctttgtgggtctcttggatatcagaggaagcaaggagtttttcacctttttggagtcagttaaagaatgttatgaagctttggtcattgccaagtttttggctttgatgtatagttaccttaacatatccattagtagaaacattgtgccagatgaaatcaaaggcagggaaattcaccactcttttccaatgacactttttcagcctcgtactgttcggctgaaccaccataatttgaagcttctaaaatattggacatggcagtttgttgttgtccgtccagtatgttctgttctgatgattgcattacagctagtcgggctgtatccaacttggttgagctgggcattcaccatcgttctcaacatatctgtgtcgttagccttgtattctctggtggtcttttaccatgtgtttgctaaagaactggcaccacacaaacctctagctaaattcttgtgcatcaaaggaattgttttcttctgcttttggcagggaatgttgctggagcttttagcggcaactggtgtcattcaatctcgccatttgcggttagatgtggagcacattgaggaagcaatgcagaatattttggtatgtctagagatggttatcttttctgttcttcaacagtatgcttatcatcctgcaccatatagtggagaagttgagaaaatgcttaaacaaaacaagaaaaatgaatgatatgataaggtcaaaagaaaaattcagggtacagtcgtacagagatgtatttaagagctgtttattgtggcgctagtagatacttgaaagcattgatgcaaagtggatgtgttcttttaataatgttattgtgctgtacaagattccccatccaccacctctgtatcgtttcctttttggttgctgtaatttccaagcctactaaaagagattagtctttattatattattatttgctatctagtatatctactatctagcgtatggtcatttgcttaggatgatagttgtttctggttactgtctcagatacttttatggtttggattgctcaatatacataaactcaaacttgaattcctttgtccatccaacattggtttggattgctccatgtctcatgctaattttgcatgactccagtgttgatataca

SEQ ID NO: 9073 - DNA, 1432 bp, Glycine max
gatgccacgtgtctcagttattaacttatactattataaaaataactttctttcatcgcttcggctgccattgaaagaaactgttgaatcgcgtcgattaaggttttgagatttctaggctttcatctcagacagtgaaaaaatgatagatataagtacacttaatgctgcacagattactgtgctgggatctgccttttgtgctatgctttccatgcatttcacgtcgcagttactgtctcagcatctcttttattggaagaatccgaaagagcaaaaggctattatcattatcatcctcatggctccaatctatgcagctgtctcctttgtgggtctcttggatatcagaggaagcaaggagtttttcacctttttggagtcagttaaagaatgttatgaagctttggtcattgccaagtttttggctttgatgtatagttaccttaacatatccattagtagaaacattgtgccagatgaaatcaaaggcagggaaattcaccactcttttccaatgacactttttcagcctcgtactgttcggctgaaccaccataatttgaagcttctaaaatattggacatggcagtttgttgttgtccgtccagtatgttctgttctgatgattgcattacagctagtcgggctgtatccaacttggttgagctgggcattcaccatcgttctcaacatatctgtgtcgttagccttgtattctctggtggtcttttaccatgtgtttgctaaagaactggcaccacacaaacctctagctaaattcttgtgcatcaaaggaattgttttcttctgcttttggcagggaatgttgctggagcttttagcggcaactggtgtcattcaatctcgccatttgcggttagatgtggagcacattgaggaagcaatgcagaatattttggtatgtctagagatggttatcttttctgttcttcaacagtatgcttatcatcctgcaccatatagtggagaagttgagaaaatgcttaaacaaaacaagaaaaatgaatgatatgataaggtcaaaagaaaaattcagggtacagtcgtacagagatgtatttaagagctgtttattgtggcgctagtagatacttgaaagcattgatgcaaagtggatgtgttcttttaataatgttattgtgctgtacaagattccccatccaccacctctgtatcgtttcctttttggttgctgtaatttccaagcctactaaaagagattagtctttattatattattatttgctatctagatgatagttgtttctggttactgtctcagatacttttatggtttggattgctcaatatacataaactcaaacttgaattcctttgtccatccaacattggtttggattgctccatgtctcatgctaattttgcatgactccagtgttgatataca

SEQ ID NO: 9074 - DNA, 1423 bp, Cajanus cajan
atgagacaataaacaatgcagcggtggtgccacgtgtgtctcaattattaacttagtcaaaatcatgaaccctttgtgtacatcacttccgctgccattgttgaatcgcgtcgattaaggttccgagatttttaggctttcatctcagtcagggtttagtgagtaatgatagatctaagtacactcaatcctgcacagctcactgtgctgggatccgcgttttgtgttatgctttccatgcatttcacgacccagttattgtctcagcatctcttctattggaagaatccaaaggagcaaaaggctattatcattatcatccttatggctcccctttatgcagctgtctcctttgtgggtctcttggatattagaggaagcaaggagtttttcacctttttggagtctgttaaagaatgttatgaggctttggtcattgccaagtttttggctttgatgtatagttacttgaacatatcaattagtgggaacattgtgcccgatgaaattaaaggcagggaaattcaccactcttttccaatgacactttttcagcctcgtactgttcggctgaaccaccgtactttgaagcttctaaaatattggacgtggcagtttgttgtcatccgtccagtatgttccattttgatgattgcattccagttgcttgggctgtatccaacttggttgagctggacattcaccatcattctcaacatatctgtgtcgttagccttgtattctctggtggtcttttaccatttgtttgctaaagaactggcaccacacaagcctctatcaaaattcttgtgcatcaaaggaattgttttcttctgcttttggcagggaatgttgctggaccttttagcgtcatttggcatcattaaatctcgtcatttgcggttagacgtggagcacattgaggaagcaatgcagaatattttggtgtgtctggagatggttatcttttctgttcttcaacagtatgcttatcatgttgcaccatatagtggagaagttgagcaaatgcttaaacaaagcaagaaatatgaataatatgattaggggaaaaaatgcgaatgattcaagctatagagatgtatttaatagttctttattgtggtgctagaaaacattgatgccgagtgaattggttctttttatgatgttattatactgtataaatccgctcatccatcacctctttaattattcctttttggttgctgtaatttcactaccatactaagaggtttatttgctatcttctagcgtatgacgattttcttaggatatgatagttgtttctgattaccgggtccgatacttgtattgttggaatcaagtgaataactgtttaatacattaattcaagcttagaattcttctttgtccttccaagattaatttgcatagctccgtg

SEQ ID NO: 9075 - DNA, 1846 bp, Glycine max
tagttatggccgtccagcagctacttcacaatcttgaagcttttcagccttccattacaatccgtattagaagaactccagttagaaaagagcccatagtttttccaaaaggctcctaatactattcgctcaagcatgcatacatgttttagggcattcataacaaactggatttcataccacgttccactacagcctaactgttcaattactttgagcttcactattgagaaaataaagttttattttattatttggacatgttaaaattttgtttcgttctctctataaatattaaaataaaaggtaatgttttttttcttctaattttacatccttattttatcagtttatattttattcatgagaattgtcatgattcataagagttttagtacggaattggagccacgtgtctcaattattaacttatacaatcataaaccctttctgtcatcgcttccgctgccattgaaagaagctgttgaatcgcgtcgaataaggttctgaaatttttaagctttcatctcagacagggtgtaataagaaatgatagatataagtactctcaatgctgcacagattactgtgctgggatccgcgttttgtgttatgctttccatgcatttcacgacgcagttaatgtctcagcatctcttctattggaagaatccgaaagagcaaaaggctattatcattatcatccttatggctcctatctatgcagctgtctcctttgtgggtctcttggatatcagaggaagcaaggagtttttcacctttttagagtcagttaaagaatgttacgaagctttggtcattgccaagtttctggctttgatgtatagttacctgaacatatccattagtagaaacattgtgcccgatgaaattaaaggcagggaaattcaccactcttttccaatgacactctttcagccttgtactgttcgcctgaaccaccataatttgaagcttctaaaatattggacatggcagtttgttgttgtccgtccagtatgttcctttctgatgattgcattacagctactcgggctgtatccaacttggttgagctgggcattcaccattgttctcaacatatctgtgtcgttagccttgtattctctggtggtcttttaccatgtgtttgctaaagaactggcaccacacaagcctctagcgaaattcttgtgcatcaaaggaattgttttcttctgcttttggcagggaatgttgctggaccttttagcggcaattggtgtcattcaatctcgtcatttgcggttagatgtggagcacattgaggaagcaatgcagaatattttggtatgtctagagatggttatcttttctgttcttcaacagtatgcttatcatcctgcaccatatagtggagaagttgagaaaatgcttaaacaaaacaagaaaaatgaatgatatgataaggtcaaaagaaaaaaatcagggtacagagatgtattcaagagctgtttattgtggcgctagaaatacatgaaaacactgatgcaaagtggatgtgttatttttataatgttattgtactcgtacaaggttgcccatccaccacctctgtaacgtttcctttttggttgatgttaaaagagattagtctttattattattattatttgctatcaagtatctagtatctagcgtaaggccatttgcttgggatgatagttgtttctggttactgtctcggatacttttatggtttgaatcaagggaataactgatcaatatacataaactcaaacttgaattcctttatctttccaacattgatttggattgctccatgatactccagtcttgatataaa

SEQ ID NO: 9076 - DNA, 1978 bp, Glycine max
gttagtttggattgtgtcgattgagccaaccctgagaaagacttactagtataacatcacttgattacaatacacagaaatcagaagactacaatagacttggcttcttttattcaagtgatgttatggtcttagttatggccgtccagcagctacttcacaatcttgaagcttttcagccttccattacaatccgtattagaagaactccagttagaaaagagcccatagtttttccaaaaggctcctaatactattcgctcaagcatgcatacatgttttagggcattcataacaaactggatttcataccacgttccactacagcctaactgttcaattactttgagcttcactattgagaaaataaagttttattttattatttggacatgttaaaattttgtttcgttctctctataaatattaaaataaaaggtaatgttttttttcttctaattttacatccttattttatcagtttatattttattcatgagaattgtcatgattcataagagttttagtacggaattggagccacgtgtctcaattattaacttatacaatcataaaccctttctgtcatcgcttccgctgccattgaaagaagctgttgaatcgcgtcgaataaggttctgaaatttttaagctttcatctcagacagggtgtaataagaaatgatagatataagtactctcaatgctgcacagattactgtgctgggatccgcgttttgtgttatgctttccatgcatttcacgacgcagttaatgtctcagcatctcttctattggaagaatccgaaagagcaaaaggctattatcattatcatccttatggctcctatctatgcagctgtctcctttgtgggtctcttggatatcagaggaagcaaggagtttttcacctttttagagtcagttaaagaatgttacgaagctttggtcattgccaagtttctggctttgatgtatagttacctgaacatatccattagtagaaacattgtgcccgatgaaattaaaggcagggaaattcaccactcttttccaatgacactctttcagccttgtactgttcgcctgaaccaccataatttgaagcttctaaaatattggacatggcagtttgttgttgtccgtccagtatgttcctttctgatgattgcattacagctactcgggctgtatccaacttggttgagctgggcattcaccattgttctcaacacatctgtgtcgttagccttgtattctctggtggtcttttaccatgtgtttgctaaagaactggcaccacacaagcctctagcgaaattcttgtgcatcaaaggaattgttttcttctgcttttggcagggaatgttgctggaccttttagcggcaattggtgtcattcaatctcgtcatttgcggttagatgtggagcacattgaggaagcaatgcagaatattttggtatgtctagagatggttatcttttctgttcttcaacagtatgcttatcatcctgcaccatatagtggagaagttgagaaaatgcttaaacaaaacaagaaaaatgaatgatatgataaggtcaaaagaaaaaaatcagggtacagagatgtattcaagagctgtttattgtggcgctagaaatacatgaaaacactgatgcaaagtggatgtgttatttttataatgttattgtactcgtacaaggttgcccatccaccacctctgtaacgtttcctttttggttgatgttaaaagagattagtctttattattattattatttgctatcaagtatctagtatctagcgtaaggccatttgcttgggatgatagttgtttctggttactgtctcggatacttttatggtttgaatcaagggaataactgatcaatatacataaactcaaacttgaattcctttatctttccaacattgatttggattgctccatgatactccagtcttgatataaa

SEQ ID NO: 9077 - DNA, 1226 bp, Arachis hypogaea
gagagaagtagttgttggactggggagcctttgaggtcagtcaaagttacaaacgagttcgatcattcatcagcttcaacttcaatccaactaaggttctaggatttcgtgagtagcgatggatttcagaaatttgaatcctgcacagatcactatgatgggatctggattctgtgttatgctttcaatgcatttcacgacgcagttactgtcacagcatctcttctattggaagaatccaaaggagcaaaaggctattatcatcatcatcctcatggctcccatctatgctgttgtctcctttgtgggactcttggatattaggggaagcaaggagttcttcactttcttggagtccatcaaggaatgctatgaagctcttgtcattgccaagttcctctctttgatgtacagttacttgaacatatccatcagcagaaacattgtgcctgatgagatcaaaggcagggaaattcaccactcttttcccatgacacttttccagcctcatactgttcgactgaaccaccatacactaaagcttctaaagtactggacatggcagtttgttgtgatccgaccagtgtgttccgtgctgatgattttgttacaagcagttgggctgtatccaaattggttgagctggggattcaccatcattctcaacatttctgtttctttggccttgtattctctggtggtcttttaccatgtgtttgcaaaagaattggaaccacacaaaccactagcaaagttcttatgcatcaaaggaattgttttcttctgcttttggcagggaatgttgcttgacatcttaggaggaatgggcgtactcaagcctcgtcatttgaagttagacgtggagcatgtcgaggaagcgatgcagaacattttggtttgtatagaaatggttatcttttctgttcttcagcagtatgcttatcatgttcatccatatagtggacaggttgagcaaatgctgaaacagaacaagaagaatgagtgatgctatgtgcacaaagatagaatgatattgatgatgcagatatgtgttctagttctagaatctagagttccacaatagaaacataaaaaaacattgatgcttaatgcaagtgcatgtgctctttttgtgaagaacatatgatgtatttttatcatggttgcattaatttatgggattactaggaaactaaggaactttaatttgctcatattatatcaat

SEQ ID NO: 9078 - DNA, 1359 bp, Arachis hypogaea
gggccaagagagaagtagttgttggactggggagcctttgagcttgaggtcagtcaaagttacaaacgagttcgatcattcatcagcttcaacttcaatccaactaaggttctaggatttcgtgagtagcgatggatttcagaaatttgaatcctgcacagatcactatgatgggatctggattctgtgttatgctttcaatgcatttcacgacgcagttactgtcacagcatctcttctattggaagaatccaaaggagcaaaaggctattatcatcatcatcctcatggctcccatctatgctgttgtctcctttgtgggactcttggatattaggggaagcaaggagttcttcactttcttggagtccatcaaggaatgctatgaagctcttgtcattgccaagttcctctctttgatgtacagttacttgaacatatccatcagcagaaacattgtgcctgatgagatcaaaggcagggaaattcaccactcttttcccatgacacttttccagcctcatactgttcgactgaaccaccatacactaaagcttctaaagtactggacatggcagtttgttgtgatccgaccagtgtgttccgtgctgatgattttgttacaagcagttgggctgtatccaaattggttgagctggggattcaccattattctcaacatttctgtttccttggccttgtattctctggtggtcttttaccatgtgtttgcaaaagaattggaaccacacaaaccactagcaaagttcttatgcatcaaaggaattgttttcttctgcttttggcagggaatgttgcttgacatcttaggaggaatgggcgtactcaagccgcgtcatttgaagttagacgtggagcatgtcgaggaagcgatgcagaacattttggtttgtatagaaatggttatcttttctgttcttcagcagtatgcttatcatgttcatccatatagtggacaggttgagcaaatgctgaaacagaacaagaagaatgagtgatgctatgtgcacaaagatagaatgatattgatgatgcagatatgtgttctagttctagaatctagagttccacaatagaaacataaaaaacattgatgcttaatgcaagtgcatgtgctctttttgtgaagaacatatgatgtattgttatcatggttgcattaatttatgggattactaaggaactttaatttgctcatattatatcaatcacatcggctaataattgttcctctttctagtccttcttgagttgtggttatggatctcaaacagttaagggatctgtccatggtcaagcgaaacatcgaatgccaaaggaaccatttctgccgtttac

SEQ ID NO: 9079 - DNA, 774 bp, Vigna unguiculata
ggacaaaagagtaaaagaagcagacaccaacactttgaacatcgaaatttccggcgcagaacaccgtatgatggcaaccaacaattccgaagtctatcacgaaaggcaaagattgcagttctgtctcgttcattctctcaactccctttttcagcaaaaagatgcttttactagagcaaaattgaatgaaatttctgaaagactcgcacttcaagactccaacacagaaacgtggaccccattctcttttatattcaagccccatcacaatgttatcacgggaaactatgacgtaaatgttctaattgcggctttggaagagaaaggaaagagtgtggagtggcacgatcgtagaaagggggcatcttgcattgatcttgatgcacctgttttgatggggattgtagtcaatgtgtcagcgtctaggtttggtgggatttggagaagtaggcactggattgcattgaggaagattaatggggtttggtttaacttggacagtgaccttgacgcccctcaaccttttcttgatgcacatgaagtaagggagttcttagattttacattggcacaacgaggggaggttttgattgtcttgaatgagaaacagtcttgaaaatttgaacttatgcttgttcactctaccatttgaagtgaaatttgggcatctatgtgtacagtaccagagtgattgcattcaatgtagaatgtagcttcgctcatcctcgaaagattttaatgagtttgttttgtgaataatggttgaaactgctt

SEQ ID NO: 9080 - DNA, 987 bp, Cajanus cajan
gataataatcttaaataatcacagtatgacaatatagagagttgataattcgaagcttccctatcgtcgtgcatgtgcatcaaatttcaacacaacatagaaatttcacgcctccgatggcaaccaagaattcccaaatctatcacgaaagacaaaagttacagttctgtctgctgcactctctcaactccctctttcagcaaaaagacgctttcactcgagcaaaactgaacgcaatttccgaaagactcgcacttgaagactccgacactgaaacgcggaccccactatctgtccttttcaagcctcatcacaatgtcttgactggaaactatgatataaatgttctaattgcggctttggaagagaagggaaagagtgtggtgtggcatgatcgtagaaatggtgcatcttccattgatctcgatgcatctgaggatgttttgatggggattgtgatcaatgtttcggtgacaaggtttgctgggatttggaggagtaggcattggattgcattgaggaagattgaaggggtttggtataatttggatagtgaccttgttgcccctaaacctttccttgacacagaaaaagtgagggagtttttggattttacattggcacatggtggggaggttttgattgtcatgaatgagaaacagtcttgaaaatttgaagtgaatgtttgtaaactctcagtcgtttgtggtcaaattttgtgttcatgtgtatagtacaagagtgattgaatttcaatggagaatgtagctttattcatccttgtgtctctggtgatttttcatgactttgttttgtgaataatggtaaaaattgcttcaggattggaggatgatcttaataggaaatagtgtcttgttgtaatacacttataaatgcaagcttccttgtgccttggatttgcagtgctcctttgaacgatgtttcttgattgtttcattgaattttagagacttatttttctttctt

SEQ ID NO: 9081 - DNA, 1477 bp, Glycine max
atcgaaatttcacgcgcaaaatggcaacagagaattctcaagtttatcacgaaaggcaaaggttacagttctgtctcgtgcatgctctcaactccctctttcagcaaaaggacgctttcactcgagcaaaattgaatgcaatttccgaaagactcacacttgaagactccaacagtgaaacgtggaccccactatctgttcttttcaagccccatcacaatgtgttgaccggaaactatgatataaatgttctaattgctgctttggaagagaagggaaagactgtggtgtggcatgatcgtagaaagggggcatcttccattgatgttgatgcacctgaggatgttttgatggggtttgtgatcaatgtggcagtgacaaggtttgctgggatttggagaagtaggcactggattgcattgaggaagattgatggggtttggtataacttggacagtgaccttactgcccctcaacctttttttgatactgataaagttagggagttcttggattcaaccttggcccatggtggggaggttttgattgtcatgaatgagaaacattcccacctctctaacaactctgcttccaacttcccaagtttcacctataattcctttcaactttcaataacatcacataccacagtctctcatatcgctttctctcatgaatataatgctatcatcatccaagcaagaataagcaacaaaatgagtcaaagtggctacatgaatgagaaaccaggcttgtccttgagacagaattccaataggaaatcaaccagaaatgggcaagtgaagagctgcatgttcagaattccttggcagtctgagacctctcccattgaacttgtgaaggatcttgcagaaagagtcacgaatgctctacgcttgatctctccaaagagatttttacaccgaggttcgtcttccttaacaagatcaaaatcagcagggtcctctgttgattcccatagaactgctgctgttgaggactgcattgagttcatccactcttccttttccagatcaaattcctcaactgcagcaccacgccaagattctatacaagctccttgagttgagatgtttgcaatcatgtgcttgctactatgcttaagtgtatatcttccttttgtttttttcccacaaataatagtgatgggaattaagtgattgtgtcatgtttctgtacaaacagaagcagtgtatattcttctgatggattccttacaaggtgcttttcattttcggctaaaatagcatgtttcaatgaaccaattgcaataaactacatttctcattagaaatattttgaaagatgattggtaggattttatgtttaaccatgcatatacagaaactaagaaataattacaagaaaaaatatgtgatgaatatataaaatccttagtcaatatctctattatgtttgtattggtctttcttttatggatcttttggaatataat

SEQ ID NO: 9082 - DNA, 972 bp, Glycine max
atttaatctagaaaaaaaataattaaaaagcaaacactaacgtggtgcatgagcgtcaaatttcaatttcaacactaacaccagaacgtgaacatcgaaatttcacgcgcaaaatggcaacagagaattctcaagtttatcacgaaaggcaaaggttacagttctgtctcgtgcatgctctcaactccctctttcagcaaaaggacgctttcactcgagcaaaattgaatgcaatttccgaaagactcacacttgaagactccaacagtgaaacgtggaccccactatctgttcttttcaagccccatcacaatgtgttgaccggaaactatgatataaatgttctaattgctgctttggaagagaagggaaagactgtggtgtggcatgatcgtagaaagggggcatcttccattgatgttgatgcacctgaggatgttttgatggggtttgtgatcaatgtggcagtgacaaggtttgctgggatttggagaagtaggcactggattgcattgaggaagattgatggggtttggtataacttggacagtgaccttactgcccctcaacctttttttgatactgataaagttagggagttcttggattcaaccttggcccatggtggggaggttttgattgtcatgaatgagaaacagtcttgaaaattatttgaagtaaatgtttgttaactctctgtcatttggggtcactttttgtgtgtccatgttatatagtgttttatttatcagccaatgttagtttatagtttgtgtgcgtccatgtatttagtgtaagactgagagtatttcaatgaagattgtagcttcattcatccttgtgtctctgatgattttttcataacttttgttttgtgaataatgctaaaaattgcttccagaggatgttctttataatagtgtgttgttaatgcactgataaatgcaagcttcattgtgtgtctttgatctg

SEQ ID NO: 9083 - DNA, 950 bp, Glycine max
atttaatctagaaaaaaaataattaaaaagcaaacactaacgtggtgcatgagcgtcaaatttcaatttcaacactaacaccagaacgtgaacatcgaaatttcacgcgcaaaatggcaacagagaattctcaagtttatcacgaaaggcaaaggttacagttctgtctcgtgcatgctctcaactccctctttcagcaaaaggacgctttcactcgagcaaaattgaatgcaatttccgaaagactcacacttgaagactccaacagtgaaacgtggaccccactatctgttcttttcaagccccatcacaatgtgttgaccggaaactatgatataaatgttctaattgctgctttggaagagaagggaaagactgtggtgtggcatgatcgtagaaagggggcatcttccattgatgttgatgcacctgaggatgttttgatggggtttgtgatcaatgtggcagtgacaaggtttgctgggatttggagaagtaggcactggattgcattgaggaagattgatggggtttggtataacttggacagtgaccttactgcccctcaacctttttttgatactgataaagttagggagttcttggattcaaccttggcccatggtggggaggttttgattgtcatgaatgagaaacagtcttgaaaattatttgaagtaaatgtttgttaactctctgtcatttggggtcactttttgtgtgtccatgttatatagtgttttatttatcagccaatgttagtttatagtttgtgtgcgtccatgtatttagtgtaagactgagagtatttcaatgaagattgtagcttcattcatccttgtgtctctgatgattttttcataacttttgttttgtgaataatgctaaaaattgcttccagaggatgttctttataatagtgtgttgttaatgcactgataaatgcaagc

SEQ ID NO: 9084 - DNA, 1232 bp, Glycine max
tttttcttcagtaaaaaacaaacacgaacactgcacattcaaaaccaaaccaagcttgtctttgtgcaagtgcatcaaatttcaatttcaacactaacaccagaacgtgaacatcgaaatttcacgcgaaaatggcaacagagaattctcaagtttaccacgaaaggcaaaggttacagttctgtctcgtgcactctctcaactccctctttcagcaaaaggacgctttcactcgagcaaaattgaatgcaatttctgaaaggctcgcacttgaagactccaacagtgaaacgtggaccccactatctgttcttttcaagccccatcacaatgtgttgactgggaactatgatataaatgttctaattgcggctttggaagagaagggaaagagtgtactgtggcatgatcatagaaagggggcatcttccattgatgttgatgcacctgaggatgttttgatgggggttgtgatcaatgtggcattgaaaaggtttgctgggatctggagaagtaggcactggattgcattgaggaagattgatggggtttggtataacttggacagtgaccttgctgcccctcaaccctttcttgatacatataaagttagggagttcttggattccacattggtgcatggtggggaggttttgattgtcatgaatgagaaacagtcttgaaaataattttaagtaaatgtttgttaactcggtcatttatggtcgatttttgtgtgcgtccatgttatagtgtttttatttttttttattttttactggtcaatgttagttgttagtttgtgtgcgtccatgtatatagtgtaagaccgatagtatttcaatggagattgttgcttccttcatcctcgtgtctctgatgattttttcatgacttttttttttgtgaataatgttaaaaattgcttccagagggtgttatttataggaaatagtgtgttaaagcactgataaatgcaggcttcgttgtgtctttgatctgcagtgcacctttgaaccattagatactgtttgattctgaaagtgatagtgtataagcatttaggctcagcatgtggatatttttctcagcactagggagcccacaaatgcatgtggatatttttcaagccccatcatgctgtaggcggatatgaacaaaagtgtttgataaacacctatgctgtaggcggatatgtaacttcaatttttccacaaatgcgacttgtaaaa

SEQ ID NO: 9085 - DNA, 1260 bp, Glycine max
cttaaaataaattaaatcaaacacacactttttcttgagtaaaaaacaaacacgaacactgcacattcaaaaccaaaccaagcttgtctttgtgcaagtgcatcaaatttcaatttcaacactaacaccagaacgtgaacatcgaaatttcacgcgaaaatggcaacagagaattctcaagtttaccacgaaaggcaaaggttacagttctgtctcgtgcactctctcaactccctctttcagcaaaaggacgctttcactcgagcaaaattgaatgcaatttctgaaaggctcgcacttgaagactccaacagtgaaacgtggaccccactatctgttcttttcaagccccatcacaatgtgttgactgggaactatgatataaatgttctaattgcggctttggaagagaagggaaagagtgtactgtggcatgatcatagaaagggggcatcttccattgatgttgatgcacctgaggatgttttgatgggggttgtgatcaatgtggcattgaaaaggtttgctgggatctggagaagtaggcactggattgcattgaggaagattgatggggtttggtataacttggacagtgaccttgctgcccctcaaccctttcttgatacatataaagttagggagttcttggattccacattggtgcatggtggggaggttttgattgtcatgaatgagaaacagtcttgaaaataattttaagtaaatgtttgttaactcggtcatttatggtcgatttttgtgtgcgtccatgttatagtgtttttatttttttttattttttactggtcaatgttagttgttagtttgtgtgcgtccatgtatatagtgtaagaccgatagtatttcaatggagattgttgcttccttcatcctcgtgtctctgatgattttttcatgacttttttttttgtgaataatgttaaaaattgcttccagagggtgttatttataggaaatagtgtgttaaagcactgataaatgcaggcttcgttgtgtctttgatctgcagtgcacctttgaaccattagatactgtttgattctgaaagtgatagtgtataagcatttaggctcagcatgtggatatttttctcagcactagggagcccacaaatgcatgtggatatttttcaagccccatcatgctgtaggcggatatgaacaaaagtgtttgataaacacctatgctgtaggcggatatgtaacttcaatttttccacaaatgcgacttgtaaaa

SEQ ID NO: 9086 - DNA, 2041 bp, Glycine max
ctcgttattacatgattcattcatcccacatttttaaaacaaataaaataatgcgtaaaacaataatttaaagcattcctaatttcctatgttgtttaatactgcatacgccacactgcaccagtctagaatgcgagtagatacaacaattgaaaagacaaaccccccactctcacttactcacttctccggctatgcataactccggcggcggcggaagcgacggcgtgtgccacgtggtggcgatgccgtttccggggagaggccacatcaacccgatgatgaacctgtgcaagatccttgcatcgaagagacccaacgagattctcataaccttcgtggtcaccgaggagtggcttggcttcatcggcgccgagcccaagccggacgccgttcgcctcgccgccatccccaacgtggtccctcccgagcgcctcaaagccgctaactttcccgcgttctatgaagccgtcgtgacagagatgcaggcgccgttcgagcggctcctcgatcggctccagccaccgccgacagcgatccttggctgcgtcgagctccgctggcccatcgccgtagccaatcggaggaatattccggtggctgcgttttggaccatgtcggcgtcgttttattccatgctgcatcaccttgatgtctttgcacgacaccggggtttgaccgtcgataaggatacgatggatggacaagccgagaacatcccgggaatttcttcagctcatttggcagaccttcgaactgtgcttcatgaaaatgatcaacgagtcatgcagcttgctttggaatgtatttcgaaagttcccagagcaaattatcttttactcaccacagtccaagagttagaagctgaaacaattgagtccttaaaagctatatttccctttccagtctatcctattggccctgctataccttatttagaactaggacaaaaccctttgaacaatgatcatagtcatgactatataaaatggctagattctcagccacctgaatcagtattgtacatttctttcggtagtttcctttcagtgtctactacccaaatggatcaaattgttgaagcactaaacagtagtgaagttcgttatctttgggtggctcgagccaatgcttcttttttgaaagaaaagtgtggagataagggcatggtggtgccatggtgtgaccaattgaaggtgttgtctcattcttccgttggtggattttggagccattgtggatggaattccactcttgaagctctctttgctggggtgccaatgctgacattccctcttttcttggatcaagttccaaatagcagccaaattgtggatgagtggaagaatgggtctaaggtagagacatcaaagttggacagtgaagttattgtggcaaaagaaaagatagaagaactagttaagaggtttatggatcttcaaagccaagagggaaaggagatcagagacagggcaagagaaatcaaggttatgtgtctcagagcgattgccgcagggggatcctcatatgggaaccttgatgcatttattagagacatttcaaaaccactgactcattaagcagcttgggatcaataacacaactaagcaatgtattaataaagggttggatattgttgttgaatgtaaggatgcatataacattgtaaaatgtctcgtaactgaaactgaagtgctctctgattctgatagctgaatttgtcctcttagattcagcaatttgagacgcttgctgcacattttgtgtaataacttatcaatgctaaagagtggagtttactgcagacatcaatgtcttgtatttgaatagagatgcttcattttagaagctttgcgagcgatacaagaaaaaccatacttaaggcagataatgctttaaatgaccagggagctgttacattatgttatctgtttagggtctatttgttagccatttcaaacaagtaaactgaagaaagttatataacttaaaaagtacgattcttattatttgattacagttggtgccatttcgttttctg

SEQ ID NO: 9087 - DNA, 2291 bp, Glycine max
aaccaatcaccctcgttattacatgattcattcatcccacatttttaaaacaaataaaataatgcgtaaaacaataatttaaagcattcctaatttcctatgttgtttaatactgcatacgccacactgcaccagtctagaatgcgagtagatacaacaattgaaaagacaaaccccccactctcacttactcacttctccggctatgcataactccggcggcggcggaagcgacggcgtgtgccacgtggtggcgatgccgtttccggggagaggccacatcaacccgatgatgaacctgtgcaagatccttgcatcgaagagacccaacgagattctcataaccttcgtggtcaccgaggagtggcttggcttcatcggcgccgagcccaagccggacgccgttcgcctcgccgccatccccaacgtggtccctcccgagcgcctcaaagccgctaactttcccgcgttctatgaagccgtcgtgacagagatgcaggcgccgttcgagcggctcctcgatcggctccagccaccgccgacagcgatccttggctgcgtcgagctccgctggcccatcgccgtagccaatcggaggaatattccggtggctgcgttttggaccatgtcggcgtcgttttattccatgctgcatcaccttgatgtctttgcacgacaccggggtttgaccgtcgataaggatacgatggatggacaagccgagaacatcccgggaatttcttcagctcatttggcagaccttcgaactgtgcttcatgaaaatgatcaacgagtcatgcagcttgctttggaatgtatttcgaaagttcccagagcaaattatcttttactcaccacagtccaagagttagaagctgaaacaattgagtccttaaaagctatatttccctttccagtctatcctattggccctgctataccttatttagaactaggacaaaaccctttgaacaatgatcatagtcatgactatataaaatggctagattctcagccacctgaatcagtattgtacatttctttcggtagtttcctttcagtgtctactacccaaatggatcaaattgttgaagcactaaacagtagtgaagttcgttatctttgggtggctcgagccaatgcttcttttttgaaagaaaagtgtggagataagggcatggtggtgccatggtgtgaccaattgaaggtgttgtctcattcttccgttggtggattttggagccattgtggatggaattccactcttgaagctctctttgctggggtgccaatgctgacattccctcttttcttggatcaagttccaaatagcagccaaattgtggatgagtggaagaatgggtctaaggtagagacatcaaagttggacagtgaagttattgtggcaaaagaaaagatagaagaactagttaagaggtttatggatcttcaaagccaagagggaaaggagatcagagacagggcaagagaaatcaaggttatgtgtctcagagcgattgccgcagggggatcctcatatgggaaccttgatgcatttattagagacatttcaaaaccactgactcattaagcagcttgggatcaataacacaactaagcaatgtattaataaagggttggatattgttgttgaatgtaaggatgcatataacattgtaaaatgtctcgtaactgaaactgaagtgctctctgattctgatagctgaatttgtcctcttagattcagcaatttgagacgcttgctgcacattttgtgtaataacttatcaatgctaaagagtggagtttactgcagacatcaatgtcttgtatttgaatagagatgcttcattttagaagctttgcgagcgatacaagaaaaaccatacttaaggcagataatgctttaaatgaccagggagctgttacattatgttatctgtttagggtctatttgttagccatttcaaacaagtaaactgaagaaagttatataacttaaaaagtacgattcttattatttgattacagttggtgccatttcgttttctgatcacttatgtgtttcatgaactactcccgttgtgtgtacacatgtgaaacataaacatacttatgagtgtcatgtacatacgtatattgccacacatgtaaacaattttgatgatatttttttttatggcaaaaagcatttttcattgaaccaccaagttcatgttcatgtgcatgtggatgagcatgcgaacttacaaatgctgtggtgtgtgggggagagtgattttgtgaagaag

SEQ ID NO: 9088 - DNA, 1437 bp, Vigna unguiculata
gaatattttaaaaaaaagatcaaaagaagtactgatctattctataacagagtctcgaaaaataagcaatatcttttcagcctttatcatttttttaggttcattggggttattgttggttgcaatttccagttatctcggtatgggtcttttccttttttctcaggaaattagtaattttccatttattccacaaggggccgcgatggctttttatggaattgggggtctctttattagtttttatttgtggtggattattttgtgggatattggcggtggttttgatatcttcgataaaaaaaataaagaagaagtatgttttcttcgttggggatttcctggaaaaaatcgtcgtattattctcaaaatacctatgaacgagattaaatctatcagaataataacaggagttcaagaacgaagtattttgactcgtactcttacttatgagagtctcgtttatatggaaacaatagaacaggggtttattcccttgactcgtattgaagataatttgactccactagaaattgcaaatagagctggcgaattatctttttttttaggtgtaccgcttctttattgatgaaaattggacttaactagaaataaaattgcacaaaaagtttcagaattgtcctatttatttagtgtaccgattgaaatattttgaaaaaaaactgtttttttcaaaatatttcaatttttatttttatagatgggacattttttgatttcgaaatttgaatattatagtcataactcgaagtgctccttggtgtatttctaaaaagaatccttttttcttcgaatcttagcaattaatatcctttcgaaacaatatttttttcttcattggattggaattgactgtgaattctttcgatttcttattcgatttatgtattcttttttctcaattaaagaaggcaaaggctaacttccgaagtttaagtaaaaaaaaatgataaaatacaatctaaatttatctagaagctctataacttgtaatgaagcttatacttgatagaaaagttattatcatatagagttgacgaaagagatgaagttaagttctgctctttatgttacttcagcacacatcttcttgtttcttcgaagcacgtctaaggtcaatctcaactgctctttatgttccttcagcacacatttcttgtttcttcgaagcacgtctaaggtcaatctcaactgctctttatgttccttcagcacacatttcttcgacatcttcttgtttcttcgaagcacgtctaaggtcaatctcaactgctctttatgttccttcagcacacatttcttcgacatcttcttgtttcttcgaagcacgtctaaggtcaatctcaactgctctttatgttccttcagctcatgaattcaactgctctttatgttccttcagctcatgaattcaac

SEQ ID NO: 9089 - DNA, 2082 bp, Glycine max
acccaattcatattcatatttctctcccttttctaatttattttctaagcccaacacatacaaccttatattctcccattcatcataaccaaaaactttgtcactggcttatttattctctattaatattatatcctttgggtattgtattgtatcgtattgctttatacaaattcttaactcaattagcctagctagctaggtcattataaaaaaaataaaaatagtgttccttgatggctgaccagaagaatcaaaacccggattcaggaaccattagtgttgaatcagcaaaagaaaaaagaaggaacaaacttcccaacttcctgctatcagtgagactcaagtatgtgaagctagggtaccattacgtaatctccaatgcaatgtaccttctgctcataccccttctaggcatagcttcggctcatctttcaaccctttccatcaaggactttctccaattatgggagaatctcaagttcaaccttgtctcggtaaccctatgttcaagcctcacggtgttcctcgccaccctctacttcatgacccgtccaaggggggtgtacttagtagattttgcatgctacaagcctgacgtggattgcacgtgcacgcgggagattttcgtggagaggtctggtctcacaggctcattctcggaggagaacttgtcctttcagaagaagatccttgagaggtctggtttggggcagaagacgtatcttccgcccgcaatcttgagtttgccgccgcgaccgtgcatggcggcggccagggaggaggctgagcaagtcatgtttggagcaattgaccagctgctggcaaagactggtgtgaaggctaaggatattgggatcttggtggtcaattgcagcttgttcaaccccacaccttcactctctgccatgattgtcaatcactacaagttgagagggaatgttttcagttataatcttggtggcatgggttgcagtgctggccttatctctattgaccttgccaagcacctcctccaggtccatcccaactcttatgccttggtagtgagcatggagaacatcactctgaactggtattttggcaacaaccggtcaatgctagtctcaaactgtctcttcagaatgggaggagcagcaatcctcctctccaaccgctccggcgaccgccaccgcgccaaataccaactagtccacacagtgcggactcacaaaggagcagatgacaagtcctacggctgtgtcttccaagaagaagatgagacaaaaagaattggtgtggcactctcaaaagacctaatggctgtggcaggagaggccctaaagaccaacatcacaacactaggacccttggtcctccctatgtcagaacagcttcttttctttgccacattggtggctaggaaagtgttcaagatgaagataaaaccatacatcccagatttcaagttggcctttgagcatttttgcattcatgctggagggagggcagtgttggatgagttggagaagaatcttgagctctctgattggcacatggagccctcaaggatgacactaaataggtttggtaacacttctagcagttccttgtggtatgaattggcctacactgaagccaaagggaggatcaagaaaggtgacaggacttggcagattgcatttgggtcagggtttaagtgcaacagtgctgtgtggagggctttgaggaccatcaatcctgctaaggagaaaaatccttggatggatgagattcatgagtttcctgttcatgtgcctaaagtggcaccaattgcttcctaaattaatcaaacatctttttctctttttagtatgattctaaaattaaagaaacttgttcatgaaacagaagagaagattgttaattattactcctgtagcttttccagtttctttggtcttgtaacattgtgttgaatttaaaagagtgtgcatacagttattcccctgttatttatttcattatttccaataaatgtatcaattgaccacctgaaggtgttcaaattttctacaaatggaaaattgggaattgataaggtttgattaaaacaaagatatt

SEQ ID NO: 9090 - DNA, 2072 bp, Glycine max
acccaattcatattcatatttctctcccttttctaatttattttctaagcccaacacatacaaccttatattctcccattcatcataaccaaaaactttgtcactggcttatttattctctattaatattatatcctttgggtattgtattgtatcgtattgctttatacaaattcttaactcaattagcctagctagctaggtcattataaaaaaaataaaaatagtgttccttgatggctgaccagaagaatcaaaacccggattcaggaaccattagtgttgaatcagcaaaagaaaaaagaaggaacaaacttcccaacttcctgctatcagtgagactcaagtatgtgaagctagggtaccattacgtaatctccaatgcaatgtaccttctgctcataccccttctaggcatagcttcggctcatctttcaaccctttccatcaaggactttctccaattatgggagaatctcaagttcaaccttgtctcggtaaccctatgttcaagcctcacggtgttcctcgccaccctctacttcatgacccgtccaaggggggtgtacttagtagattttgcatgctacaagcctgacgtggattgcacgtgcacgcgggagattttcgtggagaggtctggtctcacaggctcattctcggaggagaacttgtcctttcagaagaagatccttgagaggtctggtttggggcagaagacgtatcttccgcccgcaatcttgagtttgccgccgcgaccgtgcatggcggcggccagggaggaggctgagcaagtcatgtttggagcaattgaccagctgctggcaaagactggtgtgaaggctaaggatattgggatcttggtggtcaattgcagcttgttcaaccccacaccttcactctctgccatgattgtcaatcactacaagttgagagggaatgttttcagttataatcttggtggcatgggttgcagtgctggccttatctctattgaccttgccaagcacctcctccaggtccatcccaactcttatgccttggtagtgagcatggagaacatcactctgaactggtattttggcaacaaccggtcaatgctagtctcaaactgtctcttcagaatgggaggagcagcaatcctcctctccaaccgctccggcgaccgccaccgcgccaaataccaactagtccacacagtgcggactcacaaaggagcagatgacaagtcctacggctgtgtcttccaagaagaagatgagacaaaaagaattggtgtggcactctcaaaagacctaatggctgtggcaggagaggccctaaagaccaacatcacaacactaggacccttggtcctccctatgtcagaacagcttcttttctttgccacattggtggctaggaaagtgttcaagatgaagataaaaccatacatcccagatttcaagttggcctttgagcatttttgcattcatgctggagggagggcagtgttggatgagttggagaagaatcttgagctctctgattggcacatggagccctcaaggatgacactaaataggtttggtaacacttctagcagttccttgtggtatgaattggcctacactgaagccaaagggaggatcaagaaaggtgacaggacttggcagattgcatttgggtcagggtttaagtgcaacagtgctgtgtggagggctttgaggaccatcaatcctgctaaggagaaaaatccttggatggatgagattcatgagtttcctgttcatgtgcctaaagtggcaccaattgcttcctaaattaatcaaacatctttttctctttttagtatgattctaaaattaaagaaacttgttcatgaaacagaagagaagattgttaattattactcctgtagcttttccagtttctttggtcttgtaacattgtgttgaatttaaaagagtgtgcatacagttattcccctgttatttatttcattatttccaataaatgtatcaattgaccacctgaaggtgttcaaattttctacaaatggaaaattgggaattgataaggtttgattaaaa

SEQ ID NO: 9091 - DNA, 1980 bp, Glycine max
aacccaattcatattcatacttctctccctttttctaattctaagcccaacacaacctttattatcccactcatcataaccataaactttgttactctattaatattatatcctttatacaaattgttaataaataaataaaaaatagtagtgttccttgatggctgataggaagaattcaggaagcattcgtgttgaatcagcacaagaaaaaagaaggaagaaactccccaactttgtggtatcagtgagactcaagtatgtgaagctagggtaccattacgtaatctccaatgccatgtaccttcttctcataccccttctaggcatagcttcagctcatctatcaaccatttcaatgaaggagcttgtaagactatgggagaatctcaagttcgacctagtctcggtaacactatgttcaagcctcatggtgttcctcggcacactctacttcatgagccgtccaaggggggtgtacttagtagattttgcatgctacaagcctgacgtggattgcaagtgcacacgggagattttcgtggagaggtctggtctcacaggctcattctcggaggagaacttgtcctttcagaagaagattctggagaggtctggattggggcagaagacgtatcttccgccggcgatcttgagtttgccgccgaaaccgtgcatggcggcggccagggaggaggctgagaaagtgatgtttggagccattgaccagctgctggcaaagactggtgtcaaggctaaggatattgggatcttggtcgtcaattgcagcttgttcaaccccacaccttcactctctgccatgattgtcaatcactacaagttgagagggaatgttttcagttataatcttgctggcatgggttgcagtgcttcccttatctctattgaccttgccaagcacctcctccaggtccatcccaactcttatgccttggtagtgagcatggagaacatcacactgaactggtacttcggcaacaaccggtcaatgctagtctcaaactgtctcttcagaatgggaggagcagcaatcctcctctccaaccgctccggcgaccgccgccgcgccaaataccaactagtccacacagtgcgcactcacaaaggagcagatgacaagtcctacagctgtgtcttccaagaagaagatgaaacaaaaagaattggcgtggcactctcaaaagacctaatggccgtggcaggagaggccctgaagaccaacatcacaacactaggacccttagtccttcccatgtcagaacagcttcttttctttgcaaccttggtggctaggaaagtgttcaagatgaagataaagccatacattccagattttaaattggcctttgagcacttttgcattcatgctggagggagggcagtgttggatgagttggagaagaatcttgagctctctgattggcacatggagccctcaaggatgacactgtataggtttggaaacacttctagcagttccttgtggtatgagttggcctacactgaagccaaggggaggatcaagaaaggtgataggacttggcagattgcatttgggtcagggtttaagtgcaacagtgctgtgtggagggctttgaggaccatcaatcctgctaaggagaacaatccttggatggatgagattcatgactttccagttcatgtgcctaaagtggcaccaattgcttcctaaattaatcaaacatattttttttttcctttttcttgtttttattatgattcttagggaaggggtctaaattaaacaagcttgttcaagaaacacaagagaatattgttattactactgtggctttgcttatttctttgctcttgtaacattgtgttgaagttaaaaggttgaagttaaaagagtatgtgtgtatacagttatttattcccccgtggaacatttatttcattatttttccaataaatctatggaaaattaaaatattt

SEQ ID NO: 9092 - DNA, 1972 bp, Glycine max
attcatacttctctccctttttctaattctaagcccaacacaacctttattatcccactcatcataaccataaactttgttactctattaatattatatcctttatacaaattgttaataaataaataaaaaatagtagtgttccttgatggctgataggaagaattcaggaagcattcgtgttgaatcagcacaagaaaaaagaaggaagaaactccccaactttgtggtatcagtgagactcaagtatgtgaagctagggtaccattacgtaatctccaatgccatgtaccttatgctaataccccttataggcacagcttcagctcatctatcaaccatttcaatgaaggagcttgtaagactatgggagaatctcaagttcgacctagtctcggtaacactatgttcaagcctcatggtgttcctcggcacactctacttcatgagccgtccaaggggggtgtacttagtagattttgcatgctacaagcctgacgtggattgcaagtgcacacgggagattttcgtggagaggtctggtctcacaggctcattcacggaggagaacttgtcctttcagaagaagattctggagaggtctggattggggcagaagacgtatcttccgccggcgatcttgagtttgccgccgaaaccctgcatggcggcggccagggaggaggctgagcaagtcatgtttggagcaattgaccagctgctggcaaagactggtgtcaaggctaaggatattgggatcttggtcgtcaattgcagcttgttcaaccccacaccttcactctctgccatgattgtcaatcactacaagttgagagggaatgttttcagttataatcttgctggcatgggttgcagtgcttcccttatctctattgaccttgccaagcacctcctccaggtccatcccaactcttatgccttggtagtgagcatggagaacatcacactgaactggtacttcggcaacaaccggtcaatgctagtctcaaactgtctcttcagaatgggaggagcagcaatcctcctctccaaccgctccggcgaccgccgccgcgccaaataccaactagtccacacagtgcgcactcacaaaggagcagatgacaagtcctacagctgtgtcttccaagaagaagatgaaacaaaaagaattggcgtggcactctcaaaagacctaatggccgtggcaggagaggccctgaagaccaacatcacaacactaggacccttagtccttcccatgtcagaacagcttcttttctttgcaaccttggtggctaggaaagtgttcaagatgaagataaagccatacattccagattttaaattggcctttgagcacttttgcattcatgctggagggagggcagtgttggatgagttggagaagaatcttgagctctctgattggcacatggagccctcaaggatgacactgtataggtttggaaacacttctagcagttccttgtggtatgagttggcctacactgaagccaaggggaggatcaagaaaggtgataggacttggcagattgcatttgggtcagggtttaagtgcaacagtgctgtgtggagggctttgaggaccatcaatcctgctaaggagaacaatccttggatggatgagattcatgactttccagttcatgtgcctaaagtggcaccaattgcttcctaaattaatcaaacatcttttttttttttttcctttttcttgtttttagtatgattcttagggaaggggtctaaattaaacaagcttgttcaagaaacacaagagaagattgttattactcctgtggctttgcttatttctttgctcttgtaacattgtgttgaagttaaaaggttgaagttaaaagagtatgtgtgtatacagttatttattcccatgttgaacatttatttcattatttttccaataaatctatggaaaattaaaatattt

SEQ ID NO: 9093 - DNA, 1821 bp, Cajanus cajan
gttaattcctcgatggcagatgagaagaatcatgaaaaccatgactcaccagcaaatgaaagaaggaacaacaaacttccaaattttctgctgtctgtgaaactaaagtacgtgaagctagggtaccattacgtgatctcaaacgccatgtacctcatgctgatacccctccttggcatagcttcagctcatctatcaaccctttcaatcaaagactttgtccaactatgggagaatctcaagttcaacttggtcttagtgacagcatgttcgggcctgatagtgttcatagcaaccctttacttcatgacacgtccaaggggtgtgtacttggtggactttgcatgctacaagccacacgatgattgcaaagtcacaagggaggttttcatagagaagtctggtctcacagggtcattctctgaggagaatctctcctttcagaagagggttcttgagaggtctggtttggggcagaatacttatcttcctcctgcaatcctgagtttgccaccaaagccatgcatggctgcagctagaaaagaggctgaggaagtcatgtttggagccattgatcagcttctcgcaaagactcgggtcaaggccaaggatattgggatcttggtcgtcaattgcagcctcttcaaccccacaccttcactctctgccatggttgttaatcactacaaactcagggggaatatcctcagttataatcttggtggcatgggttgcagtgctggactcatctctattgaccttgccaagcagctcctccaggtccatcccaactcatatgccttggtagtgagcatggagaacatcactctgaactggtactttggcaacaaccgatcaatgctagtctcaaattgtctcttcagaatgggaggagcggcgatccttctctcaaaccgctccagcgaccggggccgcgccaaataccagctagtccacacagtgaggactcacaagggagcagatgacaggtcctatgggtgtgtcttccaagaagaagatgagacaaagagaattggtgtggcactctcaaaggacttgatggctgtggcaggagaggctctgaagaccaacatcaccacacttggcccattagtcctccccatgtcagagcagcttcttttctttgccaccttggttgcaaggaaagtgttcaagatgaatataaagccatacatcccagacttcaagttggcctttgagcacttttgcatccatgcaggagggagggcagtgttggatgagttggagaagaatcttgacctaagtgagtggcacatggagccctcaaggatgacactaaacaggtttgggaacacttctagcagctccttgtggtatgaattggcctacactgaatccaaggggaggatcaagaagggtgacaggacttggcagattgcatttggatcagggtttaagtgcaacagtgctgtgtggagggccatgaggaccatcaatccagcccaggagaagaatccttggacggatgaaattcatcagtttcctgttcatgtgcctaaagtggcaccaattgcttccaaatcctaaatcaaacatctttttttagtattattagttcaacaaacttgtttacagtgaatcttaggagatgtgcaaaaatagaacaaaagatcgttactttactgcctgtagctttgccaatttctttgctcttgtattgtgttcaagttaaaaggagtgtgcatacagttattcccctattgatcatttatttcattgtttttcaataaatgtaacaattgaattttccattatttaaggttatgcaattgatttcta

SEQ ID NO: 9094 - DNA, 1769 bp, Cajanus cajan
ttcctcgatggcagatgagaagaatcatgaaaaccatgactcaccagcaaatgaaagaaggaacaacaaacttccaaattttctgctgtctgtgaaactaaagtacgtgaagctagggtaccattacgtgatctcaaacgccatgtacctcatgctgatacccctccttggcatagcttcagctcatctatcaaccctttcaatcaaagactttgtccaactatgggagaatctcaagttcaacttggtcttagtgacagcatgttcgggcctgatagtgttcatagcaaccctttacttcatgacacgtccaaggggtgtgtacttggtggactttgcatgctacaagccacacgatgattgcaaagtcacaagggaggttttcatagagaagtctggtctcacagggtcattctctgaggagaatctctcctttcagaagagggttcttgagaggtctggtttggggcagaatacttatcttcctcctgcaatcctgagtttgccaccaaagccatgcatggctgcagctagaaaagaggctgaggaagtcatgtttggagccattgatcagcttctcgcaaagactcgggtcaaggccaaggatattgggatcttggtcgtcaattgcagcctcttcaaccccacaccttcactctctgccatggttgttaatcactacaaactcagggggaatatcctcagttataatcttggtggcatgggttgcagtgctggactcatctctattgaccttgccaagcagctcatgcaggtccatcccaactcatatgccttggtagtgagcatggagaacatcactctgaactggtactttggcaacaaccgatcaatgctagtctcaaattgtctcttcagaatgggaggagcggcgatccttctctcaaaccgctccagcgaccggggccgcgccaaataccagctagtccacacagtgaggactcacaagggagcagatgacaggtcctatgggtgtgtcttccaagaagaagatgagacaaagagaattggtgtggcactctcaaaggacttgatggctgtggcaggagaggctctgaagaccaacatcaccacacttggcccattagtcctccccatgtcagagcagcttcttttctttgccaccttggttgcaaggaaagtgttcaagatgaatataaagccatacatcccagacttcaagttggcctttgagcacttttgcatccatgcaggagggagggcagtgttggatgagttggagaagaatcttgacctaagtgagtggcacatggagccctcaaggatgacactaaacaggtttgggaacacttctagcagctccttgtggtatgaattggcctacactgaatccaaggggaggatcaagaagggtgacaggacttggcagattgcatttggatcagggtttaagtgcaacagtgctgtgtggagggccatgaggaccatcaatccagcccaggagaagaatccttggacggatgaaattcatcagtttcctgttcatgtgcctaaagtggcaccaattgcttccaaatcctaaatcaaacatctttttttagtattattagttcaacaaacttgtttacagtgaatcttaggagatgtgcaaaaatagaacaaaagatcgttactttactgcctgtagctttgccaatttctttgctcttgtattgtgttcaagttaaaaggagtgtgcatacagttattcccctattgatcatttatttcattgtttttcaataaat

SEQ ID NO: 9095 - DNA, 2206 bp, Glycine max
atcgactatcctccccctcctcctctcaccctttaaaaccctgccatctttcattattttgcaacccattggatcttcttcttctccttttgtactctcattcacattcttataggctaattaacatacactctcttccaaagttgagtactttgccaaaaaaaaaaaaaagttttccctttgagaaagaaaacccaaagacagtcttttgatcattttgagcagttgcattccttgttttcttccattttgggtcccctcaaaagtagtttcaaaagggttcctcttcctccacagatatcatggcagatcataccccgggttcaggaaccgtttctgttgaagcttcttcacaagaaagaaggaaacttccaaactttctcctatccgtgagacttaagtatgtgaagcttggttaccactacttgatctccaatgctatgtaccttttactcataccccttcttggtgtagcttctgctcatctttcaacaatctcttaccaagatgttgtccaactatgggaaaatctcaagttcaatcttgtctcagtgactctatgttctagccttatagtgttccttgtcaccttttacttcatgagccgtccaaggggtgtttacttggtggattttgcgtgctacaagccagagccagattgcacttgcacaagggagattttcatgcacaggtctgtggaaactggtgtgttttcggaggagaacttggcctttcagaagaagatacttgagaggtctggtttgggacaaaagacttacttgcccccagcaatcttgagtatccctccaaacccttgtatggctgaagcaaggaaagaagctgagcaagtgatgtttggagccattgaccagcttctggagaaaactggtgtgaaggctaaggatattgggattttggtggtgaattgcagcttgttcaatcccacaccttctctctctgcaatgattgtgaaccactacaagctgagagggaatatccaaagttataatcttggtggcatgggttgcagtgctggacttatctctatagaccttgccaaacagctcctccaggttcatccaaactcttatgccttagtggtgagcatggagaacatcactctcaactggtattttggcaacaacaggtcaatgctagtctcaaattgtctcttcagaatgggtggagctgcagttctactctccaacaagtcttctgatcgcagaagagccaaataccaactgatccatacagtgcgtactcacaagggtgcagatgacagatcatatggttgtgtcttccaagaagaagatgagaagaaaacaattggtgtggcactctcaaaggacttaatggctgttgcaggagaagccctcaagaccaatatcacaacacttggcccattagtccttcccatgtcagaacagctcttgttttttgcaactttggtggctagaaaagtgttcaagatgaaaataaagccatacataccagacttcaagctagcttttgagcacttttgcatccatgctggaggaagagcagtgttggatgagttggagaagaatcttgagctctctgattggcacatggagccttcaagaatgacactgaacaggtttggcaacacttctagcagttccttgtggtatgaattggcctacactgaagctaaagggaggatcagaaagggtgacaggacttggcagattgcatttggttcagggttcaagtgcaacagtgctgtgtggcgtgcattgaggaccattaatccagcaaaggagaaaaatccttggatggatgagattcacgagtttcctgttcatgtgcctaaagtggcaaccattagttcctaagttaaacaacctcttgcatttttttgggaggaggaaattaatttacttgaggttttcattgttaatcttaggaggtgtgcaaaatttagaagagaagattactcccagctgatttgatcttgtgctagtgtgttcaagtcgtaagagtgtgcatacaattattgtccaatgaaatttattacacgatttttcataaaaatgtattacgtttactacttgacctttcaaaggttcatgaaatttgattttttaagttgctcatcaagcttaggggctgtattggagaaagaaaaatgtattgatagttgttaattaaggtttgactaaaattatttcgtacagtgacattg

SEQ ID NO: 9096 - DNA, 2340 bp, Glycine max
tttcaaaacataaagtggcaaagtagcaataacagggaaagaacaaggtcaaaaaaccacatgaataaacccagttggcttggcttattcaatgctcccgcatgtaacaattaaaagttcgttggggtagttgtatcgactatcctccccctcctcctctcaccctttaaaaccctgccatctttcattattttgcaacccattggatcttcttcttctccttttgtactctcattcacattcttataggctaattaacatacactctcttccaaagttgagtactttgccaaaaaaaaaaaaaagttttccctttgagaaagaaaacccaaagacagtcttttgatcattttgagcagttgcattccttgttttcttccattttgggtcccctcaaaagtagtttcaaaagggttcctcttcctccacagatatcatggcagatcataccccgggttcaggaaccgtttctgttgaagcttcttcacaagaaagaaggaaacttccaaactttctcctatccgtgagacttaagtatgtgaagcttggttaccactacttgatctccaatgctatgtaccttttactcataccccttcttggtgtagcttctgctcatctttcaacaatctcttaccaagatgttgtccaactatgggaaaatctcaagttcaatcttgtctcagtgactctatgttctagccttatagtgttccttgtcaccttttacttcatgagccgtccaaggggtgtttacttggtggattttgcgtgctacaagccagagccagattgcacttgcacaagggagattttcatgcacaggtctgtggaaactggtgtgttttcggaggagaacttggcctttcagaagaagatacttgagaggtctggtttgggacaaaagacttacttgcccccagcaatcttgagtatccctccaaacccttgtatggctgaagcaaggaaagaagctgagcaagtgatgtttggagccattgaccagcttctggagaaaactggtgtgaaggctaaggatattgggattttggtggtgaattgcagcttgttcaatcccacaccttctctctctgcaatgattgtgaaccactacaagctgagagggaatatccaaagttataatcttggtggcatgggttgcagtgctggacttatctctatagaccttgccaaacagctcctccaggttcatccaaactcttatgccttagtggtgagcatggagaacatcactctcaactggtattttggcaacaacaggtcaatgctagtctcaaattgtctcttcagaatgggtggagctgcagttctactctccaacaagtcttctgatcgcagaagagccaaataccaactgatccatacagtgcgtactcacaagggtgcagatgacagatcatatggttgtgtcttccaagaagaagatgagaagaaaacaattggtgtggcactctcaaaggacttaatggctgttgcaggagaagccctcaagaccaatatcacaacacttggcccattagtccttcccatgtcagaacagctcttgttttttgcaactttggtggctagaaaagtgttcaagatgaaaataaagccatacataccagacttcaagctagcttttgagcacttttgcatccatgctggaggaagagcagtgttggatgagttggagaagaatcttgagctctctgattggcacatggagccttcaagaatgacactgaacaggtttggcaacacttctagcagttccttgtggtatgaattggcctacactgaagctaaagggaggatcagaaagggtgacaggacttggcagattgcatttggttcagggttcaagtgcaacagtgctgtgtggcgtgcattgaggaccattaatccagcaaaggagaaaaatccttggatggatgagattcacgagtttcctgttcatgtgcctaaagtggcaaccattagttcctaagttaaacaacctcttgcatttttttgggaggaggaaattaatttacttgaggttttcattgttaatcttaggaggtgtgcaaaatttagaagagaagattactcccagctgatttgatcttgtgctagtgtgttcaagtcgtaagagtgtgcatacaattattgtccaatgaaatttattacacgatttttcataaaaatgtattacgtttactacttgacctttcaaaggttcatgaaatttgattttttaagttgctcatcaagcttaggggctgtattggagaaagaaaaatgtattgatagttgttaattaaggtttgactaaaattatttcgtacagtgacattg

SEQ ID NO: 9097 - DNA, 2015 bp, Phaseolus vulgaris
attcatcttcctcaacttttgttctcattcacattcttagcctaacaattactcttccaaacaaaacctaaaccaacactctcttttttattttctctgcttccattttgcctgctattcaactctcccctcccaacctcatggcggatcaaacccgagattctggaaacgtatccgttgaagcttcggaagaaagaagaaaacttccaaactttctgctatctgtgagacttaagtatgtcaagcttggctaccactatttaatttccaatgctatgtaccttttgctcataccccttattggggtagcttctgctcatctctcaactctctcctaccaagatgttgctcaactatgggaaaacctaaagttcaatcttgtctcggtcactgtatgttcgagtcttatagtgttccttgtcaccttttacttcatgagccgtccaagaggtgtttacttggtggactttgcatgttataagccagagcaagactgcaattgcacaagggagactttcatggacaggtcgatcaaaaccggggtgttttcagaggagaacttgtcctttcagaagaagataattgagaggtctggtttggggcagaagacatgcttgcctacatcaatcttgagtgtcccaccaaacccgtgtatggctgaagcaaggaaagaagcggagcaagtaatgtttggagctattgaccagcttctggcaaaaactggggtgaaggcaaatgatattgggattttggtggtgaattgcagcttgttcaaccccacaccatctctctctgcaatgatcgtcaaccactacaagttgagagggaatatccagagttataatcttggtggcatgggttgcagtgctggccttatctccatagaccttgccaaacagctcctccaggttcatccaaactcttatgccttagtggtaagcatggagaatatcactctcaactggtattttggcaacaaccggtcaatgctagtctcaaattgtctcttcagaatgggtggagctgcggtcctcctatccaacaggtcttctgatcgcagaagagccaaatatcaattgatccatacagtgcgtactcataagggtgcagatgataaaagctatggttgcgttttccaagaagaggatgagagtaaaaatattggtgtgtcactctcgaaggatttaatggctgttgctggagaagccctgaagaccaatatcacaacacttgggccattggtccttcccatgtcagagcagctcttgttttttgcaactttggtggctagaaaagtgttgaagaccaaaataaagccttacatccctgactttaagctagcttttgagcacttttgtatccatgctggaggaagagcagtgttggatgagttggagaagaatctggagctcagtgattggcacatggagccttcaagaatgactctgaacaggtttggtaatacttctagcagttccttgtggtatgaactggcctacactgaagctaaagggaggatcagaaaaggtgacaggacttggcagattgcatttggctctggtttcaagtgcaacagtgctgtgtggcgtgcattgaggaccattaatcctgcgaaggagaaaaatccttggatggatgagattcacgagtttcctgttcatgtgcctaaagtggcaaccattggttcctaacttaaacctcttactttttttgggaggaggctatctaaaaggagaaaatttaattacttaagattttcatagttttaatcttaggaggtgtgcaaattagaagagaacattactccaccagaattgctggtttggcagtttgtttgatcttgtgccagtgtgctgaagttataagagtgtgcatacaattatattgtccaatgaaacatttattacacaaattttcataaaatgtacaagagtacttgagaaagaaaaatatggaaacttgtcaaggtttaaggtttgactaatgctaaacatctacacatttttcggttttga

SEQ ID NO: 9098 - DNA, 2011 bp, Phaseolus vulgaris
ttttccaaaccattcatcttcctcaacttttgttctcattcacattcttagcctaacaattactcttccaaacaaaacctaaaccaacactctcttttttattttctctgcttccattttgcctgctattcaactctcccctcccaacctcatggcggatcaaacccgagattctggaaacgtatccgttgaagcttcggaagaaagaagaaaacttccaaactttctgctatctgtgagacttaagtatgtcaagcttggctaccactatttaatttccaatgctatgtaccttttgctcataccccttattggggtagcttctgctcatctctcaactctctcctaccaagatgttgctcaactatgggaaaacctaaagttcaatcttgtctcggtcactgtatgttcgagtcttatagtgttccttgtcaccttttacttcatgagccgtccaagaggtgtttacttggtggactttgcatgttataagccagagcaagactgcaattgcacaagggagactttcatggacaggtcgatcaaaaccggggtgttttcagaggagaacttgtcctttcagaagaagataattgagaggtctggtttggggcagaagacatgcttgcctacatcaatcttgagtgtcccaccaaacccgtgtatggctgaagcaaggaaagaagcggagcaagtaatgtttggagctattgaccagcttctggcaaaaactggggtgaaggcaaatgatattgggattttggtggtgaattgcagcttgttcaaccccacaccatctctctctgcaatgatcgtcaaccactacaagttgagagggaatatccagagttataatcttggtggcatgggttgcagtgctggccttatctccatagaccttgccaaacagctcctccaggttcatccaaactcttatgccttagtggtaagcatggagaatatcactctcaactggtattttggcaacaaccggtcaatgctagtctcaaattgtctcttcagaatgggtggagctgcggtcctcctatccaacaggtcttctgatcgcagaagagccaaatatcaattgatccatacagtgcgtactcataagggtgcagatgataaaagctatggttgcgttttccaagaagaggatgagagtaaaaatattggtgtgtcactctcgaaggatttaatggctgttgctggagaagccctgaagaccaatatcacaacacttgggccattggtccttcccatgtcagagcagctcttgttttttgcaactttggtggctagaaaagtgttgaagaccaaaataaagccttacatccctgactttaagctagcttttgagcacttttgtatccatgctggaggaagagcagtgttggatgaattggagaagaatctggagctcagtgattggcacatggagccttcaagaatgactctgaacaggtttggtaatacttctagcagttccttgtggtatgaactggcctacactgaagctaaagggaggatcagaaaaggtgacaggacttggcagattgcatttggctctggtttcaagtgcaacagtgctgtgtggcgtgcattgaggaccattaatcctgcgaaggagaaaaatccttggatggatgagattcacgagtttcctgttcatgtgcctaaagtggcaaccattggttcctaacttaaacctcttactttttttgggaggaggctatctaaaaggagaaaatttaattacttaagattttcatagttttaatcttaggaggtgtgcaaattagaagagaacattactccaccagaattgctggtttggcagtttgtttgatcttgtgccagtgtgctgaagttataagagtgtgcatacaattatattgtccaatgaaacatttattacacaaattttcataaaatgtacaagagtacttgagaaagaaaaatatggaaacttgtcaaggtttaaggtttgactaatgctaaacatctacac

SEQ ID NO: 9099 - DNA, 2229 bp, Glycine max
ggcaaagcagcaataagaaggaaagaaggtcaaaaaacacacacgagtaaacccagttggcttggcttattcaatgcccccgcatgtaacaattaaaagttcgttggggtagttgtatcgactatcctccccctcctcctcctctcaccctttaaaaccctgccatctttcattattttgcaacccattggatcttcttcaaattcccacacattcttattagcctaacatactctctcttccaaagttgtttcactttaccaaaaaagctttccctttgagaaataaaacccaaaaccagtcttttgataattttgagcagttgcattccttgttttcttcctttttgggtcccctcaaaagtagtttcaaagagttcctcttcctccacagatatcatggcagatcaaaccccgggttcaggaaccgtttctgttgaagcttcttcacaagaaagaaggaaacttccaaactttctcttgtctgtgagacttaagtatgtgaagcttggttaccactacttgatctccaatgctatgtaccttttgctcataccccttcttggtgtagcttctgcttatctatcaacaatctcttaccaagatgttgttcagctatgggaaaatctcaagttcaatctcctctcagtgactctatgttccagtcttatagtattccttgtcaccttttactttatgagccgtccaaggggtgtttacttggtggattttgcgtgttacaagccagagccagagtgcacttgcacgagggagattttcatgaacaggtctgtggaaactggtgtgttttcagaggagaacttggcctttcagaagaagatacttgagaggtctggtttggggcaaaagacttacttgcccccagcaatattgagtgtcccttcaaacccttgtatggctgaagcaaggaaagaagctgagcaagtgatgtttggagccattgaccagcttctggagaaaactggggtcaaggctaaggatattgggattttggtagtgaattgcagcttgttcaatcccacaccttctctctctgcaatgattgtgaaccactacaagctaagagggaatatccaaagttataatcttggtggcatgggttgcagtgctggactaatctctatagaccttgccaaacagctcctccaggttcatccaaactcttatgccttagtggtgagcatggagaacatcactctcaactggtattttggcaacaacagatcaatgctagtctcaaattgtctattcagaatgggtggagctgcagtcctcctctccaacaagtcttctgatcgcagaagagccaaataccaactgatccatacagttcgtactcacaagggtgcagatgacaaatcatatggttgtgtcttccaagaagaagatgagaagaaaacaattggtgtggcactctcaaaggacttaatggctgttgcaggagaagccctcaagaccaacatcacaacacttggcccattagtccttcccatgtcagagcagcttcttttttttgcaactttggtggctagaaaagtgtttaagatgaaaataaagccatacatccctgactttaagctagcttttgagcacttttgcatccatgctggaggaagagcagtgttggatgagttggagaagaatctagagctctctgattggcacatggagccttcaagaatgacactaaacaggttcggcaatacttctagcagttccttgtggtatgaattggcctacactgaagctaaaggaaggatcagaaagggtgacaggacttggcagattgcatttggttcagggttcaagtgcaacagtgctgtgtggcgtgcattgaggaccattaatccagcaaaggagaaaaatccttggatggatgagattcacgagtttcctgttcatgtgcccaaagtggcaaccattggttcctaagttaaaacctcttgcattaggaaatttaattgaggttttcatggttaatcttaggaggtgtgcaaaatttagaagaggaagattactcccagctgatttgatcttctgctagtgtgttcaagttgtaagagtgtgcatacaattattgtccaatgagaacatttattacacgatttttcataaaatgtattagtacttgacatttcaaaggttcatgaaatttgattttttaagttgcctatggagctaaggggctgtattggacaaagaaaaacgt

SEQ ID NO: 9100 - DNA, 2350 bp, Glycine max
ggcaaagcagcaataagaaggaaagaaggtcaaaaaacacacacgagtaaacccagttggcttggcttattcaatgcccccgcatgtaacaattaaaagttcgttggggtagttgtatcgactatcctccccctcctcctcctctcaccctttaaaaccctgccatctttcattattttgcaacccattggatcttcttcaaattcccacacattcttattagcctaacatactctcttttccaaagttgaatactttatcaaaaaagctttccctttgagaaataaaacccaaaaccagtcttttgataattttgagcagttgcattccttgttttcttcctttttgggtcccctcaaaagtagtttcaaagagttcctcttcctccacagatatcatggcagatcaaaccccgggttcaggaaccgtttctgttgaagcttcttcacaagaaagaaggaaacttccaaactttctcttgtctgtgagacttaagtatgtgaagcttggttaccactacttgatctccaatgctatgtaccttttgctcataccccttcttggtgtagcttctgcttatctatcaacaatctcttaccaagatgttgttcagctatgggaaaatctcaagttcaatctcctctcagtgactctatgttccagtcttatagtattccttgtcaccttttactttatgagccgtccaaggggtgtttacttggtggattttgcgtgttacaagccagagccagagtgcacttgcacgagggagattttcatgaacaggtctgtggaaactggtgtgttttcagaggagaacttggcctttcagaagaagatacttgagaggtctggtttggggcaaaagacttacttgcccccagcaatattgagtgtcccttcaaacccttgtatggctgaagcaaggaaagaagctgagcaagtgatgtttggagccattgaccagcttctggagaaaactggggtcaaggctaaggatattgggattttggtagtgaattgcagcttgttcaatcccacaccttctctctctgcaatgattgtgaaccactacaagctaagagggaatatccaaagttataatcttggtggcatgggttgcagtgctggactaatctctatagaccttgccaaacagctcctccaggttcatccaaactcttatgccttagtggtgagcatggagaacatcactctcaactggtattttggcaacaacagatcaatgctagtctcaaattgtctattcagaatgggtggagctgcagtcctcctctccaacaagtcttctgatcgcagaagagccaaataccaactgatccatacagttcgtactcacaagggtgcagatgacaaatcatatggttgtgtcttccaagaagaagatgagaagaaaacaattggtgtggcactctcaaaggacttaatggctgttgcaggagaagccctcaagaccaacatcacaacacttggcccattagtccttcccatgtcagagcagcttcttttttttgcaactttggtggctagaaaagtgtttaagatgaaaataaagccatacatccctgactttaagctagcttttgagcacttttgcatccatgctggaggaagagcagtgttggatgagttggagaagaatctagagctctctgattggcacatggagccttcaagaatgacactaaacaggttcggcaatacttctagcagttccttgtggtatgaattggcctacactgaagctaaaggaaggatcagaaagggtgacaggacttggcagattgcatttggttcagggttcaagtgcaacagtgctgtgtggcgtgcattgaggaccattaatccagcaaaggagaaaaatccttggatggatgagattcacgagtttcctgttcatgtgcccaaagtggcaaccattggttcctaagttaaaacctcttgcattaggaaatttaattgaggttttcatggttaatcttaggaggtgtgcaaaatttagaagaggaagattactcccagctgatttgatcttctgctagtgtgttcaagttgtaagagtgtgcatacaattattgtccaatgagaacatttattacacgatttttcataaaatgtattagtacttgacatttcaaaggttcatgaaatttgattttttaagttgcctatggagctaaggggctgtattggacaaagaaaaacgtatggagagttattgcttatcgagctgaggggctgtagtagtacagtgacattgttggataaattgatcgattagatgaataattaatgttgagcatctaagatctgacacttaattaggaca

SEQ ID NO: 9101 - DNA, 1993 bp, Lupinus angustifolius
tgcaacacactaacctttcttccctttattttccattcacttgtttatgcaaacatatactcttctccaaagttgaagaaaatttcccgttgagaaggaaaacccaaagccataatcttttcattctatactgctattattattctttgttttcttctcttttgagtactctcccaagtttccaaatccacttccctatctcctcatggaaaataacaagaaccaaaacttagattcaggtacaatttctgttgaatctcaacaagggaaaaggaagcttccaaactttcttctatctgtgaggcttaagtatgtgaagcttgggtaccatatcttaatctccaatgctatgtatcttttgctcatacccattttaggggtagcttcagctcatctatcaactacttctatcaatgatgttatccaactatgggagaatctcaagttcaatcttgtctcagtgactctatgttctagccttatagtattccttgccaccctttactttatgagcaggccaagaggtgtttacttagtggactttgcatgttacaagccagaagaaaattgcatatgcactagggaaaccttcatggataggtctgtgttgactggaaccttttcagatgagaatttggcatttcagaagaagatacttgagaggtctggtttgggtcaaaagacttatttgcccccagcaatattgagggtcccaccaaatcctaatatggctgaagcaaggaaagaagctgaggaagttatgtttggtgctattgatcagcttttggcaaagactggggtgaaagctaaggatattggggttttggttgtgaattgtagtttgtttaatcctacaccttctctatctgcgatgattgtgaaccattataagttaagagggaatatccaaagttataatcttggtggcatgggttgtagtgctggcctactctctatagacctggccaagcagctccttcaggtacacccaaactcttatgccttagtagtgagcatggagaacatcactctgaactggtattttggcaacaacagatcaatgcttgtctcaaattgtctcttcagaatgggaggagctgcaatactcctctcaaacaaatcttctgacagaaaaaaggccaaataccaattggtccatacagttagaactcataaaggtgcagataacaaatcctatggttgtgttttccaagaagaagatgacaaaaaaacagttggtgttgcactctcaaaagacttaatggctgttgctggtgaagcccttaagacaaacatcacaacacttggaccattagtcctacctatgtcagaacagctcttgttttttgctaccttggttgctaggaaagtgttgaagatgaaaataaagccatatattccagattttaagctagcttttgagcacttttgcatccatgcaggaggaagagcagtgctggatgagttggagaaaaatctagacctaagtgattggcatatggagccatcaagaatgactttgtataggtttggaaacacttctagtagttcattgtggtatgaattggcatacactgaagcaaagggtaggatcagaaaaggtgataggacttggcaaattgcatttggttctggattcaagtgcaacagtgctgtgtggcgtgcattgaggaccattgatcctgcaaaagagaagaatccttggatggatgagattcatgagtttcctgtgcatgtgcctaaagtggaaacaattaattaaggatgatgttttatttaaggtttttatagttataatgttaggaggtgtgggaaaatagatgagatgattattttcaacagctttgctagtttctttgttcatgtgctagtgtgctgaagtgtgtatacaactattgttgatcaattgaaaatgtattacatgatttttcataaaatgtatcaattcacctttcaaagatatatgaaaattgttttttacgtggcctatcaa

SEQ ID NO: 9102 - DNA, 2091 bp, Lupinus angustifolius
ttttgcaacacattcatctttcttccctttctttttctttcactcgtttaggcaaacatatactcttttccaaagttaacaagtttcccattgagaaggaaaatccaaacccacaatattttttttttttaaatttctagtgctattaatctttgttttcttctgttttgagtactcttccaagtttccaaagccacttcccttctcctcatggcaaataacaagaaccaacaaaacttagattcaggaacaatttcttttgaatctccacaaggaaaaaggaagcttccaaactttcttctatctgtgaggcttaagtatgtgaagcttgggtaccatatcttaatctccaacgctatgtaccttttgctcataccctttcttgggttagcttcagctcatttatcaacaatatctataaatgatgttgtccaattatgggagaatctcaagttcaatcttgtctcagtgactctatgttctagcctcatagtatttcttgctaccctttactttatgagcaggccaagaggtgtttacttggtagactttgcatgttacaagccagaagaaaattgcatttgcactagggagattttcatggataggtctaggttaactggaaccttttcagatgagaatttggcctttcagaagaagatacttgaaaggtctggtttgggtcaaaagacttatttgcccccagcaatattgagggtaccaccaaatcctaatatggctgaagcaaggaaagaagctgaggaagttatgtttggagctattgatcagcttttggcaaaaactggtgtgaatgctaaggatattgggattttggttgtgaattgtagtttgtttaatccaacaccttctctatctgcaatgattgtgaaccactataagttaagagggaatattcaaagctataatcttggtggcatgggttgcagtgctggacttctctctatagacctaaccaaacagcttcttcaggtacaccctaactcttatgccttagtagtgagcatggaaaatatcacactcaactggtattttggcaacaataggtcaatgttagtctcaaactgcctctttagaatgggtggagctgcaattctcctctcaaacaaatcctctgacagaagaagagccaaataccaattggtccatacagtgagaactcacaaaggtgcagataacaaatcttatggttgtgtattccaagaagaagatgagaagaaaacaattggtgttgcactctcaaaggacttaatggctgttgctggagaagcattgaaaaccaacatcacaacacttgggccattagtccttcctatgtcagagcaattattgttctttgctacattggttgctaggaaagtattcaagatgaaaataaagccttatattccagattttaagttagcttttgagcacttttgtatccatgctggaggaagagcagtgctagatgagttggagaaaaatcttgagctaagtgattggcatatggaaccatcaagaatgactttgaataggtttggtaacacttctagtagttcattgtggtatgaattggcatacactgaagctaaaggaaggatcagaaaaggtgataggacttggcaaattgcatttggttctggattcaagtgcaatagtgcagtgtggcatgcattgaggacaattgatccagcaaaggagaagaatccttggatggatgagattcatgagtttcctgttcatgttcctaaagttgcaacaattgattaaggaagaaattaattaagggttcaatttgtgaattgagtttggaaggataaaaaatgataaaagttaactcataaatatatttcatgattcctaagtcttcattttttcctctttcccctttaaaatccatcacgtaaatggactttaaaggttttaggagttaatcttagaagatgtggaaaaaaatataagagatgattagtactcccaacagctttgctagttgctttgttcatgtactagtgtgctggagtgtgtatacaattgttacattatttttcataaaataaatcaattgatctttcaaagatatataaaaaa

SEQ ID NO: 9103 - DNA, 2129 bp, Cajanus cajan
atcccattcatcttcttcccctcttcttattcacattcttaggctatataacacatgctctcttccaaagtttagtactttccctttcataaagaaaacccttagccattacattagtcacactttttaatttcattttgagcatttgttttcttccattttgggtattcaactctcccccacctaatggcagatcaaacccatgattcaggatccgtttctgttggaacttcacaagaaggaaggaagcttccaaactttctgctatctgtgaggctaaagtatgtgaagcttgggtatcactgcttgatctcaaatgctatgtaccttatgctcataccccttatcgggctagcttctgctcatctatcaacgatctcttaccaagatgttgttcaactatgggaaagtctcaagttcaatcttgtgtgggtgactctatgtgttagtcttatagtattccttgccaccttttactttatgagccgcccaagaggtatttacttggtggattttgcatgttataagcctgagccaaactgcacttgcacaagggagactttcatggacaggtccgtcaatgctggtgcgttttcagaggagaacttggcctttcagaagaggataatcgagaggtctggtttgggccagaagacttacttgccttctgcaatcttgagtgtccctgcaaacccttgtatggctgaagctagaaaagaagctgagcaagtcatgtttggagccattgaccagcttctccagaaaactggggtcaaggctaaggatattgggattttggtggtcaattgcagtttgttcaatcccacaccatctctctctgccatgattgtcaaccactacaagttgagagggaatatcctaagttataacctaggtggcatgggttgcagtgctggccttatcgctgtagaccttgccaaacagctcctccaggttcatccaaactcttatgccttagtggtgagcatggagaacatcactctcaactggtattttggcaacaacaggtcaatgttagtctcaaattgtctctttagaatgggtggagctgcggttctcctctccaacaggccttctgatcgcagaagagccaaataccaactgatccatacagtgcgtactcataagggtgcagatgacaaatgttacggttgtgtgttccaagaagaagatgagcagaaatcaattggtgtggcactttcaaaggacttaatggctgttgctggagaagccctcaagaccaatatcacaacacttggcccattagtccttcctatgtcagagcaactattgttctttgcaactttggtggctagaaaagtgttgaagatgaaaataaagccatacatcccagacttcaagctagcttttgagcacttttgcatccatgctggaggaagagcagtgttggatgagttggagaaaaaccttgaactcactgattggcacatggaaccttcaaggatgactctgaacaggtttggcaacacttctagcagttccttgtggtatgagttggcgtacactgaagctaaagggaggatcaagaagggtgacaggacatggcagattgcattcggttcaggtttcaagtgtaacagtgctgtgtggcgtgcactgaggaccattaatcctgcaaaggagaaaaatccttggatggatgagattcatgagtttcccgttcatgtgcctaaggtggcaaccattagttcctaagttaattaaaacctcttgccttttttggggaggaggctatcgaaaaggaggaagttaatttacttgagcttttcagttttcacttttcatagttaatcttaattaattaggaggtctgcaaaattagaaaagaagattactcccggcagattgctggtttggtacgtagtttctttgatcttctgctagtgttactcttgaagttgtaagagtgtatacaatattatccaatgaaacatttattacacgatttttcataacatgtattacttcattgacctttcaaaggttaaccaaaattgaatttttttaagttgattgttgagatgagggtgtatattggagaaagaaaaacctacggagagttgttaaggtttgattaaaattctctt

SEQ ID NO: 9104 - DNA, 2787 bp, Lupinus angustifolius
atcctcccttaatctctctcttcatacaccctttaaaacaccctcccatcttccacttttttgcaacacattcatctttcttccctttcatttgttaagccaaacatatactcttctccaaagttaagaaaatttgtcattgacaaggaaaatcctaagccaaaacattttcattttctattactattattgttctttgttttcttctcttttgagtactctcccaagtttccaaacccacttcactctcctcatggcaaataacatgaaccaaaccttagattcatcagaaacaatttcttttgaatctccaaaagaaaaaatgaagcttccaaattttcttctatctgtaaggcttaagtatgtgaagcttggttaccatatcttaatatcaaacgctatgtaccttttgctgataccccttctagggttagcttcagctcatttatcaactatatctataaatgatgttgttcaattatgggaaaatctcaagttcaatcttctctcagtgactctatgttctagccttatagtatttcttgccaccctttactttatgagtaggccaagaggtgtttaccttgtggactttgcatgttacaaaccacaggaaaattgcatttgcactagggagattttcatggagaggtctgagttaactgaaacattttcagatgagaatttggcctttcagaagaagatacttgagaggtctggtttgggtcaaaagacttatttgcccccagctatcttgagggtcccaccaaatcctaatatggctgaagcaaggaaagaagctgaggaagttatgtttggtgctattgatcagcttttggaaaaaactggtgtgaaagctaaggatattgggattttggtggtgaattgtagtttgtttaatcctacaccttctctatctgcaatgattgtgaaccactacaagttaagagggaatatccaaagctataatcttggtggcatgggatgcagtgctggccttctctctattgaccttgctaagcagcttcttcaggtacatccaaactcttatgccttagtagtaagcatggagaacatcactctgaactggtattttggcaacaacagatcaatgctagtctcaaattgtctctttagaatgggtggagcagcaattctcctctcaaacaaatcatgtgaccaaagaagagccaaatatcaattgctcaatacagtgagaactcataaaggtgcagataacaaatcttatggctgtgttttccaagaagaagatgagaagaaaacaattggtgttgcactctcaaaggacctaatggctgttgctggagaagccttgaaaaccaacatcacaacacttgggccattagtccttcctatgtcagaacaactattattctttgcaacattggttgctagaaaagtgtttaagatgaaaataaagccttatattccagattttaagctagcttttgagcacttttgcatccatgctggtggaagagcagtgcttgatgagttagagaaaaatcttgacctaagtgattggcatatggagccatcaagaatgactttgaataggtttggtaacacttctagtagttcattgtggtatgaattggcttacactgaagctaagggtaggatcagaaaaggtgataggacttggcaaattgcatttggttctggattcaagtgtaatagtgcagtttggagagcattgaggaccattgatcctgcaaaagagaagaatccttggatggatgagattcatgattttcctgttcatgtgccaaaagtggcaacaattagttaaggaagaagttaattcaagccttgaattttcattgttgtaatctcaggaggtgtgagaagattattcctaacacctttgctagtttctcttttcatgtactatggactcatgtgtgtacacaattgctgcacaattgagtatttattacatgatttttcataaaatgtactccctttgtgcttgtaatttatcattctattttgttcacatgtatcaaatttaaataataattgtcataatgtttcacatactaaatctgataatattgtgccaagggaagataaagttgtgcttagcatactactcagatggccaagaccaatgctaatatgcacaaggatgagcatggtgcgcccagacttgaaacaaggtcaaatactaatgtgtcaaatgttcttgttgatgcgccaagcattgctgttgatgtgccaaagattgtccctcatgcgtcaagcctagctgttgatgccccaagaattgtttctgatgcgccaacatctgaccaagaaacacatgttgatttgccaaagtcaagtcaggcctcgcccataaccagatttacctattgcttgactgtgccaattgtgaccgtgccagattgtcccaagccttcaggcctaatgaatcagtaaagaaacattttgaccgagacacttgagtcagttgtctcggttattaggcaaatgatgctcggttagaatcaagctcatctcggttagaaacaaaacatcatgggccaaaccttagccaacagaattagtgacaattccagtctggtgcagcctagagttgcttgcgatacaagcaagtggcatgttcttaattccctctgatatttagcatgtgtttgtcgtgctctattgtttgttatgcaagttgttactctttctaactaccctttatgtattataaataaagggctttgatttgtaattaattaattcaatcattaataaaattcaaatgcattatac

SEQ ID NO: 9105 - DNA, 2485 bp, Vitis vinifera
caggagaagacaaagaccccatgtacccgtggcaaagttggaattaaggcagcacataaagggtcaaaactgtaaaattgggagggatcccgctatgtccccggctggcgaattgaatgccacgccgggttatcaattaaaagttcgttggggtggttgtatcctccctctcctctcactctttaaatccctatgcgcctctccacatttggacccattactctcatcctctttccccgctttctctccttcctttttggctgcctttgtcttttcgactttggaaaacatccgatataaagagactcttgtatcgatccatttaggcttgagggaggtgtttgggtaagtgggttgatttggaaatgggggacgagaagaagagagtttgggaactagtgggtgtgtgttagtccaggacatgggtgaaagagggaagaacaagctcccgaactttcttttatctgttagactcaagtatgtgaagcttgggtaccattatttgatctcccatggcatgtacctcttgctcgtgcccctgcttggcgttgctgctgctcatctttccactctcaccatcaaagattttctccaactatggaaccacctcaagttcaatcttgtcaccgtcattctctgttcagctcttatggttttcctggccaccctttacttcatgagtcgtccaaggaaggtctacttagtggacttcgcctgttacaagcctgaaaaggctcgtatgtgcactagggagatcttcatggagagatcagtgcttactgggaccttctccgaagagaacttggcctttcagaagaaaatcctggagaggtcagggttgggtcagaacacatacttgccagaagccgtgttgcgggttcctccaaacccgtgtatggcggaggcgaggaaggaggccgagttagtgatgtttggagccatcgatcagctcttggcaaagaccggggtgaaggctaaagatataggaatacttgtggtgaattgcagtctgttcaacccgacgccatccctctctgccatgattgtgaaccactacaagcttagaggcaatattatgagctacaatctcggtggaatgggttgcagtgctgggctcatatctatagaccttgccaaacaaatgctacaggttcatcccaactcgtatgctctagtagtgagcatggagaacattaccctcaactggtactttggcaacaaccgctccatgctcgtctccaactgcctctttcgcatggggggagcagccatcctcctatccaaccgatcatctgaccgccggcgttcgaagtatcagctcatccacaccgtccgcacccacaagggtgcggatgacagatgttacaactgtgtgttccaggaagaggatgagaccaagacaattggtgtcgccctctccaaagacctaatggccgtggctggagaagccttgaagacaaacatcaccacgctcgggccattagtacttccaatgtcagagcaactcctattctttttgactttggtaggacgaaagatctttaagatgaagattaagccatatattccagattttaagctggctttcgagcacttctgcattcatgctggagggagagctgtgttggatgagctagagaagaaccttgatctcagtgagtggcatatggagccttcaaggatgactctctataggtttgggaacacttccagtagttctttgtggtatgaactggcgtacaccgaagctaaagggaggatcagaaagggtgatcggacatggcagattgcatttggatctgggttcaagtgtaacagtgcggtctggcgtgccatcaggaccattgatcccgtgaaggagaagaacccttggatggacgagattgatgagttcccagtccatgttcctaaagtggcatccattgtcatgaagaccactcaaaattgcaccaattgtgttcactcagatcttacgatgatgaagatttcttcattttgttcggttgtaaaacctatttttcctttcctgccgttgattggtttctccaaaattttaggaattttattttctttactaccagtgcaagaaaatgcttttagcgtgtcttgctttgtaagttttgtagatgggagaaaaagacgccaaaaactagaagacgatacaagtgttctacagctggcctttggtgaccttagtagaaaaggccttcacattcaattgtctaaactatcaaagtttggttctctgtaccgtattttcaagaaaaaattcatttttgtttataaaatgtgatctcacccgacagtggatatggacgctttctgaaaaaactagacaccagaatagcacaaggattttatcaatcccaaattcttctactgaatggttacatggaagatggaagacaaacgataaaagcataaaccggagtccagaccatggccccctgtaagatgttaggcagctgccacaggtgaagctgca

SEQ ID NO: 9106 - DNA, 1918 bp, Vitis vinifera
tcatcctctttccccgctttctctccttactttttggctgcctttgtcttttcgactttggaaaacatccgatataaagagactcttgtatcgatccatttaggcttgagggaggtgtttgggtaagtgggttgatttggaaatgggggacgagaaggagagtttgggaactagtgggtgtgtgttagtccaggacatgggtgaaagagggaagaacaagctcccgaactttcttttatctgttagactcaagtatgtgaagcttgggtaccattatttgatctcccatggcatgtacctcttgctcgtgcccctgcttggcgttgctgctgctcatctttccactctcaccatcaaagattttctccaactatggaaccacctcaagttcaatcttgtcaccgtcattctctgttcagctcttatggttttcctggccaccctttacttcatgagtcgtccaaggaaggtctacttagtggacttcgcctgttacaagcctgaaaaggctcgtatgtgcactagggagatcttcatggagagatcagtgcttactgggaccttctccgaagagaacttggcctttcagaagaaaatcctggagaggtcagggttgggtcagaacacatacttgccagaagccgtgttgcgggttcctccaaacccgtgtatggcggaggcgaggaaggaggccgagctagtgatgtttggagccatcgatcagctcttggcaaagaccggggtgaaggctaaagatataggaatacttgtggtgaattgcagtctgttcaacccgacgccatccctctctgccatgattgtgaaccactacaagcttagaggcaatattatgagctacaatctcggtggaatgggttgcagtgctgggctcatatctatagaccttgccaaacaaatgctacaggttcatcccaactcgtatgctctagtagtgagcatggagaacattaccctcaactggtactttggcaacaaccgctccatgctcgtctccaactgcctctttcgcatggggggagcagccatcctcctatctaaccgatcatctgaccgccggcgttcgaagtatcagctcatccacaccgtccgcacccacaagggtgcggatgacagatgttacaactgtgtgttccaggaagaggatgagaccaagacaattggtgtcgccctctccaaagacctaatggccgtggctggagaagccttgaagacaaacatcaccacgctcgggccattagtacttccaatgtcagagcaactcctattctttttgactttggtaggacgaaagatctttaagatgaagataaagccatatattccagattttaagctggctttcgagcacttctgcattcatgctggagggagagctgtgttggatgagctagagaagaaccttgatctcagtgagtggcatatggagccttcaaggatgactctctataggtttgggaacacttccagtagttctttgtggtatgaactggcgtacactgaagctaaagggaggatcagaaagggtgatcggacatggcagattgcatttggatctgggttcaagtgtaacagtgcggtctggcgtgccatcaggaccattgatcccgtgaaggagaagaacccttggatggacgagattgatgagttcccagtccatgttcctaaagtggcatccattgttacttgatttttgttttggtgattgggatttgggagggaaaatttgtgtttactatggggtatcatatagaagattatttattaccgtgtgatgtcaggtttcatgtacaacccgtataaagccgtataaattatggccctcaactagcttatgctgatagattcattgcaattaataatttaatacacacccagtgttgtctgatcaaacatctaa

SEQ ID NO: 9107 - DNA, 1983 bp, Vitis vinifera
gtatcctccctctcctctcaactctttaaatccctatacgcctctccacatttggacccattactctcatcctctttccccgctttctctccttactttttggctgcctttgtcttttcgactttggaaaacatccgatataaagagactcttgtatcgatccatttaggcttgagggaggtgtttgggtaagtgggttgatttggaaatgggggacgagaaggagagtttgggaactagtgggtgtgtgttagtccaggacatgggtgaaagagggaagaacaagctcccgaactttcttttatctgttagactcaagtatgtgaagcttgggtaccattatttgatctcccatggcatgtacctcttgctcgtgcccctgcttggcgttgctgctgctcatctttccactctcaccatcaaagattttctccaactatggaaccacctcaagttcaatcttgtcaccgtcattctctgttcagctcttatggttttcctggccaccctttacttcatgagtcgtccaaggaaggtctacttagtggacttcgcctgttacaagcctgaaaaggctcgtatgtgcactagggagatcttcatggagagatcagtgcttactgggaccttctccgaagagaacttggcctttcagaagaaaatcctggagaggtcagggttgggtcagaacacatacttgccagaagccgtgttgcgggttcctccaaacccgtgtatggcggaggcgaggaaggaggccgagctagtgatgtttggagccatcgatcagctcttggcaaagaccggggtgaaggctaaagatataggaatacttgtggtgaattgcagtctgttcaacccgacgccatccctctctgccatgattgtgaaccactacaagcttagaggcaatattatgagctacaatctcggtggaatgggttgcagtgctgggctcatatctatagaccttgccaaacaaatgctacaggttcatcccaactcgtatgctctagtagtgagcatggagaacattaccctcaactggtactttggcaacaaccgctccatgctcgtctccaactgcctctttcgcatggggggagcagccatcctcctatctaaccgatcatctgaccgccggcgttcgaagtatcagctcatccacaccgtccgcacccacaagggtgcggatgacagatgttacaactgtgtgttccaggaagaggatgagaccaagacaattggtgtcgccctctccaaagacctaatggccgtggctggagaagccttgaagacaaacatcaccacgctcgggccattagtacttccaatgtcagagcaactcctattctttttgactttggtaggacgaaagatctttaagatgaagataaagccatatattccagattttaagctggctttcgagcacttctgcattcatgctggagggagagctgtgttggatgagctagagaagaaccttgattcagtgagtggcatatggagccttcaaggatgactctctataggtttgggaacacttccagtagttctttgtggtatgaactggcgtacaccgaagctaaagggaggatcagaaagggtgatcggacatggcagattgcatttggatctgggttcaagtgtaacagtgcggtctggcgtgccatcaggaccattgatcccgtgaaggagaagaacccttggatggacgagattgatgagttcccagtccatgttcctaaagtggcatccattgttacttgatttttgttttggtgattgggatttgggagggaaaatttgtgtttactatggggtatcatatagaagattatttattaccgtgtgatgtcaggtttcatgtacaacccgtataaagccgtataaattatggccctcaactagcttatgctgatagattcattgcaattaataatttaatacacacccagtgttgtctgatcaaacatctaa

SEQ ID NO: 9108 - DNA, 1670 bp, Tripterygium wilfordii
gatttcaacaatggcaggagagaataggcaaaacccaagaccagaatcctctgaaggaagggcaaataagctgccaaactttctcttatcagtcagattgaaatatgtgaaattgggttaccattacttgatctctaatgctatgtatctcctgctgttgccactcctactgatttcttcagctcatctttctactttcactttaaagaattttatgcagctatggatccatttaaagttcaattttgtctctgcaactctgtgttctggtcttattgttttcttggctactctgttcttcacaagcagaccaagaaaagtctacttggtagatttttcatgttacaagcctcctgctgaacgtatatgcacaaaagaggctttcatggagagatcaacacttgctgggtccttcacagaggagaatttggccttccagaagaaaattctcgagaggtctggtttgggtcaaaagacttacttgcccgaagcagtgctgcagactcccaccaaatccgtgtatggcaggaggcaagaaaagaagcagagaccgttatgttcaatgcaatcgacgaactcttgtcgaaaacaagggttaaggctaaagatattgggattcttgtagtgaattgcagtttgtttaatccgacaccgtctttgtctgcaatgattgtgaatcattacaagcttagagggaacatagtaagctttaatcttggtggtatgggttgcagtgcaggtcttatttcaattgatcttgccaaacaactcctacaggtgcatcccaactcttatgctttagtggtaagcatggagaacataacactgaattggtattttgggaatgaaagatctatgcttgtatcaaattgcctcttcagaatgggtggtgcagcaatccttctctcaaacagatcatcggatcgccggcgatccaagtaccaactcattcacactgtccgcacacacaagggtgctgatgacaaatgctacaattgtgtattccagcaagaggatccaaacaaagaaattggtgttgccctctcaaaagaccttatggcagtggctggtgaagcacttaagaccaacatcacaacactaggaccattagtccttccaatgtcagagcaacttcttttctttgcaactttggttgcaaggaaagtgtttaagatgaaaatcaaaccatacattccggatttcaagctcgctttcgagcatttctgcattcatgctggaggaagggcagtgttggatgagttggagaagaatcttgagctctcagagtggcatatggagccatcaagaatgacactttacaggtttggaaatacttctagtagctcattgtggtatgaattggcttactctgaagctaaagggagaatcaggaagggtgataggacatggcagattgcatttggttcaggattcaaatgtaacagtgctgtgtggaaggcattgaggacaatcaaacctgcaaaagagaagaatccttggattgatgagattcatgagttccctgttcatgtgcctaaagtggcagtcattaatggttctaataattgaagcccccaattcattgtttcctctttctagtgtagttgatttataaatgattggtgtatgtaatcatactgttgacacgatttgattcggattaataggca

SEQ ID NO: 9109 - DNA, 1985 bp, Theobroma cacao
cttttcccactctttccttcattttcttagcatattcgaaaccgaaagaactaccaatttttctcgagtttctttacaccaaatctttcgtttcttgattttcagcaacttgtttgatctgggtttttgttcaggcttcatattgggtttgttttatagcaaaaaggatggcagcagagagtaggcaaagctcgaatgccgagcctgtaaggttccaggcggcttcatcagaagaaagaagatcaaacaatctcccaaactttcttctttcagtaaggctaaaatatgtgaagcttggttaccattatctaatctccaacgccatgtatttaatgctagtgcctctcctaggcattgctgcagctcatctttccacgcttactttccttgactttgttcaactatgggaccaactcaagttcaatctcgtctcagtaaccctatgttcaggtcttttagttttcttggccacactttacttcatgagccgccctaggaaagtctacttagtggattttgcctgttacaagcctgaagctgatcgtacttgcaccagggagatcttcatggagagatctggcctcactgggagcttcactgaagagaacttagcctttcaaaagaaaatccttgagaggtctggtttggggcagaagacctacttgccagaggctgtgctgcatgtcccaccaaacccctgtatggcggaggctaggaaggaggctgagaccgtgatgtttggagccattgatgagcttttggctaaaactggtgtgaaggccaaggatatagggatccttgtggtgaattgcagcttgttcaaccctacaccatctctttctgccatggttgtgaacagatacaagcttagagggaacattttgagttacaatcttggtggaatgggctgcagtgctgggctcatttctatagaccttgctaaacagctactacaggtgcaccctaactcttatgccttagttgtaagcatggagaacattactctcaactggtatttcggcaacgaccgatccatgctcgtctcaaactgcctcttccgcatgggcggcgctgcaatcctgctctccaaccggttctccgatcgccgccgttccaagtatcaacttattcacaccgtacgtacccacaaaggggctgacgataaatgctacaactgtgtcttccaacgcgaggatgacaccaaaagaattggtgtttcgctctcgaaagacctcatggctgtcgctggagaagcccttaaaaccaatatcaccacgctcgggccattagttcttcccatgtccgagcaactcctgttttttgtcactttagttgcaaggaaagtcttcaaaatgaagatcaaaccatacattccggatttcaagttggctttcgagcatttctgtattcatgctggagggagggctgtgctagatgagctcgagaaaaaccttgatctcacggattggcacatggagccatcgaggatgaccctttacaggtttggaaacacttcaagcagttccttgtggtacgaactagcttactctgaggccaaagggagaatcagaaaaggtgatagaacatggcagattgctttcgggtcaggattcaagtgcaacagtgctgtttggaaggccttgaagtccatcaatccagccaaggagaagagtccttggattgatgaaatcgatgagtaccctgttcatgtgcccagggttgcaacagtctcttcttcctaaaaccataatttcccattaaggagagagagaaactttaattagtacaattagtactatgatttattttatacatgcttaatgtgtgttaatctgaatgttaattccaagttaaagaaaacacaccccattccattactttctttttttctccttttcatttttcttggtgttgaaaaacaattgattggtgaatgtaatttttacacaaatgaaatgttgcttatttcttaatcaaacttattg

SEQ ID NO: 9110 - DNA, 2248 bp, Theobroma cacao
gcaccatataggagtggcaaagctgaaattcgttccttaaaagaaggccaaaaaaagtatagttgcatacagatatatacgaatataaaaaaaacaaaatttgagggaaaaggtcggctgattttcccggttggaaaattcaatgccacggcggtttaacaattaaaagttcgttggggtagttgcatcctcccatcgctctctctcgcccctttaaattgctccaacatcctcccacaatttgcaactcggtaactcttttcccactctttccttcattttcttagcatattcgaaaccgaaagaactaccaatttttctcgagtttctttacaccaaatctttcgtttcttgattttcagcaacttgtttgatctgggtttttgttcaggcttcatattgggtttgttttatagcaaaacggatggcagcagagagtaggcaaagctcgaatgccgagcctgtaaggttccaggcggcttcatcagaagaaagaagatcaaacaatctcccaaactttcttctttcagtaaggctaaaatatgtgaagcttggttaccattatctaatctccaacgccatgtatttaatgctagtgcctctcctaggcattgctgcagctcatctttccacgcttactttccttgactttgttcaactatgggaccaactcaagttcaatctcgtctcagtaaccctatgttcaggtcttttagttttcttggccacactttacttcatgagccgccctaggaaagtctacttagtggattttgcctgttacaagcctgaagctgatcgtacttgcaccagggagatcttcatggagagatctggcctcactgggagcttcactgaagagaacttagcctttcaaaagaaaatccttgagaggtctggtttggggcagaagacctacttgccagaggctgtgctgcatgtcccaccaaacccctgtatggcggaggctaggaaggaggctgagaccgtgatgtttggagccattgatgagcttttggctaaaactggtgtgaaggccaaggatatagggatccttgtggtgaattgcagcttgttcaaccctacaccatctctttctgccatggttgtgaacagatacaagcttagagggaacattttgagttacaatcttggtggaatgggctgcagtgctgggctcatttctatagaccttgctaaacagctactacaggtgcaccctaactcttatgccttagttgtaagcatggagaacattactctcaactggtatttcggcaacgaccgatccatgctcgtctcaaactgcctcttccgcatgggcggcgctgcaatcctgctctccaaccggttctccgatcgccgccgttccaagtatcaacttattcacaccgtacgtacccacaaaggggctgacgataaatgctacaactgtgtcttccaacgcgaggatgacaccaaaagaattggtgtttcgctctcgaaagacctcatggctgtcgctggagaagcccttaaaaccaatatcaccacgctcgggccattagttcttcccatgtccgagcaactcctgttttttgtcactttagttgcaaggaaagtcttcaaaatgaagatcaaaccatacattccggatttcaagttggctttcgagcatttctgtattcatgctggagggagggctgtgctagatgagctcgagaaaaaccttgatctcacggattggcacatggagccatcgaggatgaccctttacaggtttggaaacacttcaagcagttccttgtggtacgaactagcttactctgaggccaaagggagaatcagaaaaggtgatagaacatggcagattgctttcgggtcaggattcaagtgcaacagtgctgtttggaaggccttgaagtccatcaatccagccaaggagaagagtccttggattgatgaaatcgatgagtaccctgttcatgtgcccagggttgcaacagtctcttcttcctaaaaccataatttcccattaaggagagagagaaactttaattagtacaattagtactatgatttattttatacatgcttaatgtgtgttaatctgaatgttaattccaagttaaagaaaacacaccccattccattactttctttttttctccttttcatttttcttggtgttgaaaaacaattgattggtgaatgtaatttttacacaaatgaaatgttgcttatttcttaatcaaacttattgcctata

SEQ ID NO: 9111 - DNA, 1845 bp, Medicago truncatula
acaactcaatgatcttctcttctctctttactttctttcctcttttccaaactccacttctttaccttaaacttttccctttcataaacaaaatataatccacacacacacactctttaaatattttgtaccttttatatttacattttataataagcctataattagtactcactttgtgcatgcccttcatggaagaacaaaataatcaacaaaatcattattctagaagaagcatttcttttgaaagaagtaaactccccaattttttaatatccgtgaaactaaaatatgtgaaacttggttaccattatttgatttctaatgctatgtaccttgttttaatacctctccttggagtagcttcagttcacttatcaactttttcaatcaaagatttaatccaaatatatgaaaatctcaaattcaactttgtgtcaatgcttatatgtacaagtctagtagtatttcttgcaaccctttatttcatgtctcgtccaagaggcatatacttggttgattttgcatgctacaaaccacaaaaagatttgcaagtcacaagagagatttttgtagaaagatcaattttaacaaaagcatttacagaagaaactctttcttttcaaaagaagatacttgagaggtcaggtttagggcaaaagacatatttgccaccagcaataatgagggtcccacctaatccatgtatggctgaagcaaggaaagaagctgaagaggttatgtttggtgctattgatgaggttcttcaaaaaactggtgtgaaggctaaggatattgggattttggttgtgaattgtagtttgtttaatccaacaccatctctttctgccatgattgtgaatcattataagttgagaggaaatatcttgagttataatcttggtggtatgggttgtagtgctggtcttatctctattgaccttgccaaacagctcctacaggtacatccaaactcatatgccttagtagtgagcatggagaacataacactaaactggtatttcggcaacgacagatcaatgctagtgccaaattgtctctttagaatgggaggagcagcagttctcctctccaacaagccacgcgaccgcctccgatcaaaataccaactagtccacaccgtccgaacgcacaaaggtgcagacaacaaatcctacggctgcgtctttcaagaagaagacgacacaaagcaagtcggtgtatcactctcaaaagacctaatggctgttgccggagaagcactcaaaacaaacatcacaacattaggaccattagtcctacctatgtcggaacagctcttatttttcgggacattggttgcgcgaaaaatcttcaagatgaaaataaaaccatacattcctgattttaaattagcttttgagcatttttgtattcatgctggtggaagagctgttttggatgagttggagaaaaatcttgatttaagtgattggcatatggaaccatcaaggatgacactgaatagatttggtaacacttctagtagttcattgtggtatgaattggcttatactgaagctaaagggaggattaaaaaaggtgatagaacttggcaaattgcatttggttctggttttaagtgtaatagtgctgtttggaaagcattgaagactattaatcctgcaaaggagaagaatccttggattgatgagattcatgagtttcctgttcatgtgcctaaagtgtcaaaagttattggttcttaaatatcaatattttcatgttttttttatgtatattaaggagggtgttttaatggatgaaagttgtttatggtattgttgatatttcttaggagatgtt

SEQ ID NO: 9112 - DNA, 2024 bp, Medicago truncatula
acaactcaatgatcttctcttctctctttactttctttcctcttttccaaactccacttctttaccttaaacttttccctttcataaacaaaatataatccacacacacacactctttaaatattttgtaccttttatatttacattttataataagcctataattagtactcactttgtgcatgcccttcatggaagaacaaaataatcaacaaaatcattattctagaagaagcatttcttttgaaagaagtaaactccccaattttttaatatccgtgaaactaaaatatgtgaaacttggttaccattatttgatttctaatgctatgtaccttgttttaatacctctccttggagtagcttcagttcacttatcaactttttcaatcaaagatttaatccaaatatatgaaaatctcaaattcaactttgtgtcaatgcttatatgtacaagtctagtagtatttcttgcaaccctttatttcatgtctcgtccaagaggcatatacttggttgattttgcatgctacaaaccacaaaaagatttgcaagtcacaagagagatttttgtagaaagatcaattttaacaaaagcatttacagaagaaactctttcttttcaaaagaagatacttgagaggtcaggtttagggcaaaagacatatttgccaccagcaataatgagggtcccacctaatccatgtatggctgaagcaaggaaagaagctgaagaggttatgtttggtgctattgatgaggttcttcaaaaaactggtgtgaaggctaaggatattgggattttggttgtgaattgtagtttgtttaatccaacaccatctctttctgccatgattgtgaatcattataagttgagaggaaatatcttgagttataatcttggtggtatgggttgtagtgctggtcttatctctattgaccttgccaaacagctcctacaggtacatccaaactcatatgccttagtagtgagcatggagaacataacactaaactggtatttcggcaacgacagatcaatgctagtgccaaattgtctctttagaatgggaggagcagcagttctcctctccaacaagccacgcgaccgcctccgatcaaaataccaactagtccacaccgtccgaacgcacaaaggtgcagacaacaaatcctacggctgcgtctttcaagaagaagacgacacaaagcaagtcggtgtatcactctcaaaagacctaatggctgttgccggagaagcactcaaaacaaacatcacaacattaggaccattagtcctacctatgtcggaacagctcttatttttcgggacattggttgcgcgaaaaatcttcaagatgaaaataaaaccatacattcctgattttaaattagcttttgagcatttttgtattcatgctggtggaagagctgttttggatgagttggagaaaaatcttgatttaagtgattggcatatggaaccatcaaggatgacactgaatagatttggtaacacttctagtagttcattgtggtatgaattggcttatactgaagctaaagggaggattaaaaaaggtgatagaacttggcaaattgcatttggttctggttttaagtgtaatagtgctgtttggaaagcattgaagactattaatcctgcaaaggagaagaatccttggattgatgagattcatgagtttcctgttcatgtgcctaaagtgtcaaaagttattggttcttaaatatcaatattttcatgttttttttatgtatattaaggagggtgttttaatggatgaaagttgtttatggtattgttgatatttcttaggagatgttgtaagaatagaagaaaataactatgccaatttgtaatttgtttttggtataagtgtgcacacaattattgtccatgttggtcatttgtttttgtttgtatcaattgactagttcattatgtatggcaattaattttcaaagttgcttgtcaagtttatggacagtttgtttgagattat

SEQ ID NO: 9113 - DNA, 2098 bp, Manihot esculenta
atgaatttctctgcgagaggataggataggagtggcaaagtggaaataccgagctacaagttgggcaaacatgtaaagagaaacatacagggagcaaaatcccgctctttttccggttggcaaattcaatgccatggagattaattgtaaaggttaattaacaattaaaggtttgttggggtagttgcatcctcccctcttcctctctctctctcggttcgcatcctttaaatcccccatcacccttcccctcctccttcctcatatcaaagctcagctctctcattcttttctcttctctctgggttttcttcctttttttttctccaaaacatcataatcaaagatttcagctcttcccattcggtgctataatggcagaggacagcagacaaaacccggaacctgaatcagtttccgtggaagctcagcctgaaataaagagaaacaacttgccaaattttctcctttcagttagactcaaatatgtgaaattaggttaccattatttaatctccagtgccctgtatttattacttattccactcctgggcattgcctcagctcatctttccacgctcacaatccaagatttaattcagatatggaaccacttgaagttcaattttgtatctgtaactctgtgttctggtcttatagttttcttggctactctttacttcatgagccgcccaagaaaagtatacctggtaaattttgcttgttacaagccagaagaagctcggatgtgcaccagagaaatttttatggagagatcagggctggctgggagcttcaccgaagagaacttggcctttcaaaagaagattctcgagaggtctgggttagggcaaaagacttacttgcctgaggcggtgatgcgggttccaccgaatccgtgtatggcagaagcgaggaaggaagctgagactgtgatgttcagcgcaatcgatgagctcttggacaaaactggggttaaagccaaggatatagggatccttgttgtgaactgtagcttgttcaatccgacgccgtctctatctgctatgatagtaaatcactacaagctaagaggcaacataatgagctataatcttggtggtatggggtgcagtgctggacttatttctattgatcttgccaaacagctcttacaggttcaccccaactcctatgctcttgtggtgagtatggaaaacatcactctcaattggtattttggtaatgaccgatcaatgcttgtctcaaactgtctcttccgaatgggcggtgccgccatccttctctccaaccgatcatcggatggtcgtcgttctaagtatcaactcatccacacagtacgtacccacaaaggtgcagatgataaatgttacaattgtgtgttccaaagagaggatgaaagtgaacgcaagagaattggtgtttcactttctaaagaccttatggctgttgctggagaagcccttaagaccaatatcacaactctagggccattggttcttcccatgtctgagcagctcttgttttttgcaactttagtagcaagaaaggtcttcaaaatgaagataaaaccgtacattccagatttcaaattagcatttgagcacttctgcatccatgcaggaggaagagctgttttagatgagctagagaaaaatcttgatctttcagattggcacatggagccttcaaggatgactctttacagatttggtaacacttcaagcagttcattgtggtatgaattggcttactctgaagccaaggggagaatcaggaaaggtgatagaacatggcagattgcttttggctcaggattcaagtgtaacagtgctgtgtggcgcgcattgaagacaatcaatccagccaaggagaagaatccttggatggatgagattgacgaatttcctgttcatgtgcctaaggtggtgtccattaattcttcttcaacctcgtcccattgatccatccttccattggagattgtgtttcttattttagttatctctgtgttgatatatatgcatgagaaatcatgtgttatttttctgatattgttaattgatggaagcattggtgtaagtttcaaaaaattaat

SEQ ID NO: 9114 - DNA, 1603 bp, Manihot esculenta
tgcttttctttttaatggcagaggaaagtagacgaaacccgaaacctgaatcggtttcggtggaagatcaggctgaaataaagagaaataatctgccaaactttctgttatcagttagactcaaatatgtgaaactaggttatcactatttaatctccaatgccatgtatctattgctgattccactcctcggcattgcctccgctcatctttcgactcttaccatccaagatttagttcagctgtggaaccacctaaagttcaattttatctcagtcattctgggttctggactagtggttctcttggctactctttacttcatgagccgcccaagaaaaatatatttgttggactttgcatgttacaaaccagaggaagctcgcatatgcaccagagaaactttcatggataggtcagcattggctgggagcttcaccgaagagaacttgggctttcaaaagaagatccttgagaggtctgggttgggacaaaagacttacttgcctgaagctgtgttgcgggttccgccaaacccatgtatggcggaggcaaggaaggaagcagagactgtgatgttcagcgcaatcgatcaactcttggccaaaactggtgttaaagccaaagatatagggatccttattgtgaactgtagtttgtttaatccgacgccgtctctatctgccatgatagtaaatcgctacaagctcagagggaatgtaataagctataacctcgggggtatgggctgcagtgctgggcttatttccatcgatcttgcccaacagctcttacaggttcatcccaattcctatgctctagttgtcagtatggagaacatcaccctcaattggtactttggcaatgaccgatcaatgcttgtctccaactgcctctttcgtatgggcggcgctgccattcttctttctaaccgatcatctgatgggcgccgctctaaatatcaactcatccacaccgttcgtactcacaagggtgctgatgataaatgttacaattgtgtatttcagaaagaggatgaaagtgatcgcagcagaattggtgtttcactttctaaagacctaatggctgttgctggagaagctcttaaaaccaatatcacaactctagggccattagtccttccaatgtctgagcaaatcctttttttcgcaactttagtaggaagaaaggtcttcaaaatgaagataaaaccgtacattccagatttcaagttggcatttgagcacttctgcatccatgcaggaggaagagctgttttagatgagttagagaaaaatttggatctcactgattggcacatggagccttcaaggatgactctttatagatttggtaacacatcaagcagttctttatggtatgaactggcttattctgaagcaaaggggagaatcaggaaaggtgataggacatggcagattgcatttggttcaggattcaagtgtaacagtgctgtgtggcgtgcgttgaagacgatcaatccagccacagaaaagaacccttggatggatgaaattgatgaatttcctgttcatgtgcctaaggtggtgtctattgcttcttgaagctccatttcatcatc

SEQ ID NO: 9115 - DNA, 1793 bp, Citrus sinensis
ctcacgcttttcacattctcttgcaacttccatcaacttcaattaattcttccttcattagtgccaatttctattatcatattttggcgagaaagccaacaaaaatggctgttgatcaaaagaacaaaccgaatccaaacccggaagctgaaggaagaggaaacaacaataataagcttccgaattttcttttatcggttaggctcaagtacgtgaagcttggttaccattatataatctccaatgccttgtatttactgctcgtacctattctaataatttcttcagctcatctttcaactctctcagttcaagatattgtccagctatggaaccaactcaggtacaatctcgtgacggtcactgtgtgttcaagcctcatggtgtttttgggcacgctttatttcatgagccgcccgagaaaagtttacttggttgattttgcatgttacaagccggagcccgagcggcagtgcactagagaaattttcatggagaggtcggagcagattggttgtttttcggaagagaacttggcatttcagaagaaaattcttgaacggtctggtttggggcagcacacttatttccctgaggccgtgctgcgggtccccccgaacccttgtatggctgaggctaggaatgaagctgagatggtcatgtttggtgccattgatgagctcttgtccaaaactggtgtaaaggctaaagatatagggattcttgtggtgaattgcagcttgttctgtccaacaccatctttgtcggccatgattgtgaatcattacaagcttcgaggcaacattaccagctataatcttggcggcatgggttgcagtgctggacttatttcaatagaccttgctaagcagcttttacaggtgcaccccaactcctatgccttggtagtgagcatggagaacataacactcaactggtactttggcaatgacaggtccatgcttgtatcaaattgcctcttccgcatgggtggtgccgctatccttttatctaaccgatcctccgatcgccgccgatcaaagtaccaactcatccacactgtaaggacccacaagggagctgatgacaagtgctacaactgtgtcttccaaagagaagatgataccaaaagagttggagtttcactctcaaaggacctcatggctgtcgctggagaagcccttaagactaacatcacaacactgggaccaatagtcctcccgatgtcagaacaactcttattttttgcaactttggttgctaaaaaagtctttaaaatgaaaatcaagccatatatcccagattttaagttggcttttgagcatttctgcatccatgctggaggcagagcagtgctagatgagctagagaagaatcttgagctcagtgaatggcatatggagccttcaagaatgactctttacagatttggtaacacttctagcagctctttgtggtatgaattggcttactctgaggctaaggggagaatgagaaaaggagacagaacatggcagatagcatttgggtcaggattcaagtgtaacagtgctgtgtggcaagcattgaggactatcaatcctgcaaaggagaagaatccttggattgaagagattcatgagtttcctgttcatgtccctagagtagcagctgttgatttgaaggcttcttaatttccttcaatggagggagtattatatctgattgatttgcatacttcacaatacgattatatatgtaatatttggatccatatatttagtttcaataaaattatttcttgattttcattt

SEQ ID NO: 9116 - DNA, 2001 bp, Ricinus communis
caaattcaatgccatggcgggttaacaattaaaaggttcgttggggtagttgcatcctctccccatccctttctctctctagactcctttctctctttaatttcctactttctttctctaacttcacaccctttaaatcctattatctttctcttactttaatctgggtcttctgtttcaacttcctaagttatagtttctaaagaattttgaattttgaagtcagtgcgctgttcttgataaggaaatggcagaggaaagtatacgaaactcgccacctgaatcggtcagagtggaagctcaaccgcctgaaatgaagagaaacaatctgccaaactttctcttatcagttagactcaagtatgtgaagttaggttaccattatttaatctctaatgccatgtatctcctgctcgttccacttctaggcattgcttctgctcaactctcgacactcaaaattgaagatcttgttcagctatggaaccacctcaagttcaattttgtatctgtaactctatgttctggtcttatagttttcttggctactctctacttcatgagccgtccaagaaaaatatacttggtaaattttgcatgttacaagccagaaccagctcgaatctgcacaagagaaacatttatggagaaatcagcaatggctggtagcttcactgaagagaacttggcctttcaaaagaagattcttgagaggtctggtctgggacaaaagacatacttgccggaggccgtgatgcgggtcccaccaaacccgtgtatggcggaggcaaggaaggaggctgagactgtgatgttcagcgccattgatgagctcttaggcaaaacaggggttaaagctaaggatttaggaattcttattgtgaattgtagtttgttcaatcctacaccgtctctgtctgctatgataattaaccactacaagcttagaggaaatattttgagctataatcttggtggtatgggctgcagtgctggacttatttcaattgatcttgccaaacagcttttacaggttcaacccaactcctatgctctagtggtcagtatggagaacattactctaaactggtacttcggcaatgatcggtcgatgcttgtctcaaactgcctctttcggatgggtggcgctgccatccttctctccaacaggtcatcggatcgccgccgttcaaagtatcaactcatccacacagttcgcacccacaaaggagctgatgataaatgttacaattgtgtgttccaaaaagaagatgaaagtgataaaaaaagaattggtgtctcactttctaaagatcttatggctgttgcaggagaagcattgaaaaccaatattactacactaggtcctttagttctaccgatgtctgagcaactactattctttgcaactttagttgcaagaaaagtctttaaaatgaagataaaaccatacattccagatttcaagttagcgtttgaacacttctgcattcacgcaggaggaagagctgttttagacgagttagagaagaatcttgatcttgcagagtggcatatggagccttcaagaatgactctttataggtttggtaatacttctagtagttctttatggtatgaacttgcttattctgaagccaaaggaagaatcaggaaaggtgatagaacatggcaaattgcattcggttcaggatttaaatgtaacagtgctgtttggcgtgcattgaagacaattaatcctgccaaagagaagaatccttggatggacgagattgatgattttcctgtacatgtgcctaaggtggtgtccatttcttcttcaagctagctctattcagattccccaagcagaatgtgttatcgattttaaacatgggtgatttttttttctttttcatgtgtcgctattgttcttttgtggttacacacaagaggagtacaaatttagtgatgaaatcaagatttatctaataaaagtaattattttctactttagtcttt

SEQ ID NO: 9117 - DNA, 1623 bp, Ricinus communis
aatggcagaggaaagtatacgaaactcgccacctgaatcggtcagagtggaagctcaaccgcctgaaatgaagagaaacaatctgccaaactttctcttatcagttagactcaagtatgtgaagttaggttaccattatttaatctctaatgccatgtatctcctgctcgttccacttctaggcattgcttctgctcaactctcgacactcaaaattgaagatcttgttcagctatggaaccacctcaagttcaattttgtatctgtaactctatgttctggtcttatagttttcttggctactctctacttcatgagccgtccaagaaaaatatacttggtaaattttgcatgttacaagccagaaccagctcgaatctgcacaagagaaacatttatggagaaatcagcaatggctggtagcttcactgaagagaacttggcctttcaaaagaagattcttgagaggtctggtctgggacaaaagacatacttgccggaggccgtgatgcgggtcccaccaaacccgtgtatggcggaggcaaggaaggaggctgagactgtgatgttcagcgccattgatgagctcttaggcaaaacaggggttaaagctaaggatttaggaattcttattgtgaattgtagtttgttcaatcctacaccgtctctgtctgctatgataattaaccactacaagcttagaggaaatattttgagctataatcttggtggtatgggctgcagtgctggacttatttcaattgatcttgccaaacagttctaacaggttcaacccaactcctatgctctagtggtcagtatggagaacattactctaaactggtacttcggcaatgatcggtcgatgcttgtctcaaactgcctctttcggatgggtggcgctgccatccttctctccaacaggtcatcggatcgccgccgttcaaagtatcaactcatccacacagttcgcacccacaaaggagctgatgataaatgttacaattgtgtgttccaaaaagaagatgaaagtgataaaaaaagaattggtgtctcactttctaaagatcttatggctgttgcaggagaagcattgaaaaccaatattactacactaggtcctttagttctaccgatgtctgagcaactactattctttgcaactttagttgcaagaaaagtctttaaaatgaagataaaaccatacattccagatttcaagttagcgtttgaacacttctgcattcacgcaggaggaagagctgttttagacgagttagagaagaatcttgatcttgcagagtggcatatggagccttcaagaatgactctttataggtttggtaatacttctagtagttctttatggtatgaacttgcttattctgaagccaaaggaagaatcaggaaaggtgatagaacatggcaaattgcattcggttcaggatttaaatgtaacagtgctgtttggcgtgcattgaagacaattaatcctgccaaagagaagaatccttggatggacgagattgatgattttcctgtacatgtgcctaaggtggtgtccatttcttcttcaagctagctctattcagattccccaagcagaatgtgttatcgatttta

SEQ ID NO: 9118 - DNA, 1793 bp, Citrus clementina
ctcacgcttttcacattctcttgcaacttccatcaacttcaattaattcttccttcattagtgccaatttctattatcatattttggcgagaaagccaacaaaaatggctgttgatcaaaagaacaaaccgaatccaaacccggaagctgaaggaagaggaaacaacaataataagcttccgaattttcttttatcggttaggctcaagtacgtgaagcttggttaccattatctaatctccaatgccttgtatttactgctcgtacctattctaataatttcttcagctcatctttcaactctctcagttcaagatattgtccagctatggaaccaactcaggtacaatctcgtgacggtcaccgtgtgttcaagcctcatggtgtttttgggcacgctttatttcatgagccgcccgagaaaagtttacttggttgattttgcatgttacaagccggagcccgagcggcagtgcactagagaaattttcatggagaggtcggagcagattggttgtttttcggaagagaacttggcatttcagaagaaaattcttgaacggtctggtttggggcagcacacttatttccctgaggccgtgctgcgggtccccccgaacccttgtatggctgaggctaggaatgaagctgagatggtcatgtttggtgccattgatgagctcttgtccaaaactggtgtaaaggctaaagatatagggattcttgtggtgaattgcagcttgttctgtccaacaccatctttgtcggccatgattgtgaatcattacaagcttcgaggcaacattaccagctataatcttggcggcatgggttgcagtgctggacttatttcaatagaccttgctaagcagcttttacaggtgcaccccaactcctatgccttggtagtgagcatggagaacataacactcaactggtactttggcaatgacaggtccatgcttgtatcaaattgcctcttccgcatgggtggtgccgctatccttttatctaaccgatcctccgatcgccgccgatcaaagtaccaactcatccacactgtaaggacccacaagggagctgatgacaagtgctacaactgtgtcttccaaagagaagatgataccaaaagagttggagtttcactctcaaaggacctcatggctgtcgctggagaagcccttaagactaacatcacaacactgggaccaatagtcctcccgatgtcagaacaactcttattttttgcaactttggttgctaaaaaagtctttaaaatgaaaatcaagccgtatatcccagattttaagttggcttttgagcatttctgcatccatgctggaggcagagcagtgttagatgagctagagaagaatcttgagctcagtgaatggcatatggagccttcaagaatgactctttacagatttggtaacacttctagcagctctttgtggtatgaattggcttactctgaggctaaggggagaatgagaaaaggtgacagaacatggcagatagcatttgggtcaggattcaagtgtaacagtgctgtgtggcaagcattgaggactatcaatcctgcaaaggagaagaatccttggattgatgagattcatgagtttcctgttcatgtccctagagtagcagctgttgatttgaaggctttttaatttccttcaatggagggagtattatatctgattgatttgcatacttcacaatacgattatatatgtaatatttggatccatatatttagtttcaataaaattatttcttgattttcattt

SEQ ID NO: 9119 - DNA, 1835 bp, Tabernaemontana elegans
tttttttctttaacttttcatgtacttctgtgacttctgttgatattgctttccatcaagaattctttcccatttatattgacagaactgtgaatttttttggttaaaaatgggggatgagaagaggggtgcctctgaaagtggaagcatttctgttgagtctgagaggaggagtaataatcttcctaattttctactatcagttaggctcaaatatgtgaagcttggataccattatttgatctctcatgctatgtatttgatgctaattccacttctaggggttgtttcagttcatctttcgactgttacggttgaagatgcagtcttgctatggaatcagctcaggttcaatcttgtcacagtgattttgtgttctgctcttatggttttcctaggtaccctttacttcatgactaggcctaggaaagtttatttagtggattttgcatgccacaagcctggacctgaatttatgtgctctaaagaacttttcatggagagatcaaaccaagctcagactttcaacgatgaaaatttggcctttcagaagaaaattttggagaggtcaggtttaggccagaagacatatttccctgaagcactattgcagctgccggcaaatccgtgcatggcagaggccaggaaggaggctgaaatgatcatgtttggtgccattgatcagctattggcaaagactggtgtgaaggcaaaggatattgggattcttgtggtgaactgcagcttgttctgcccaacaccatccctttctgccatgattgtgaaccattacaagcttagaggcaatattttgagctacaaccttggtgggatgggttgcagtgctggactcatctcaatagatcttgccaagcaacttttacaggtgcatcccaactcgtatgctttggtggtgagcatggagaacataaccctgaattggtactttgggaacaacagatcaatgctggtctcaaattgcatcttccgtatgggaggggctgcaattctgctttcaaacaaatcatctgaccgtcgtcgttcaaagtatcagctcattcacactgttcgtacccacaagggtgctgatgacagaagctatggctgtgtatttcaagaggaagatgaaaacaaggaaataggcgtggccttgtcaaaagatcttatggctgttgccggggaggccttgaaaacaaacataacgacactcgggccattagttcttcccatgtctgagcagctcctattctttgtcaccttagttgcgaggaaggtgtttaacatgaagatcaaaccatatattccagattttaagcttgccttcgagcatttctgtattcatgctggaggaagagcagtgctggatgagctagaaaagaaccttgatcttagtgaatggcaaatggagccttcaagaatgacactttacaggtttggcaacacttcgagcagttcattgtggtacgaactggcttattctgaggctaaggggagaataaggaagggtgatcggacatggcagattgcatttggttccggattcaaatgtaacagtgccgtgtggcgtgctttgaggaccattaatccagcaaaagaaaagaatccttggatggatgaaattgacgaattccctgtacaggtccctagagtgtcaaccattgcttcctgaaataattctcatcttctgtcaagagaaattgattacacactctcttttttgtaccaccaaactctacttctgctgtattattcataatttagaagtgtcatatgaaggcaatgatcaagccttccctcggactatgccaattattcataacagatataacattgcc

SEQ ID NO: 9120 - DNA, 2057 bp, Gossypium raimondii
aactcatcagcacttttcgtacttcttttttttccttcattttcttagcaaattcaacatcgaaaaataaactaccacttttgttcacttctttataccaaagttttgtttccttgattttcaacaccgttttcgatttgggtttttctttaagcttcaaattgagttggatttgtagctaaaaaaaagaaaagaaaatggcagaagagagtaagcaaagaaggaacgttgagcccgtaaaggttcaaacagcttcatcatcagaagaaagaagatcaaacaacaatctcccaaactttcttctttcagtaaggctaaaatatgtgaagcttggctaccattacgttatctctaacgctatgtatttgatgttggtgcctctcctaggcattgcttcagttcatctttccacacttactctcttagattttgttcgactatggaaccaactcaagttcaatctcgtttcagtaaccctatgttccggtcttttagttttcttggccacactttacttcatgagccggccaaggaaagtttacttagtgaatttcgcttgttacaagcctgaagctgatcgtatttgcaccagggagatcttcatggagagatctggtctcactggtagcttcaccgaagagaacttagcctttcagaagaaaatcctggagaggtctgggttgggacaaaagacatacttgcctgaggcagtgatgcgtgtcccacccaacccttgcatggcggaagccaggaaggaggccgagacagtgatgtttggagctattgatgaactcttggacaaaactggtgttaaggcaaaggatatagggatccttgtggtgaattgtagcttgttcaatcctacaccatctctttctgccatggttgtcaacagatacaagcttagaggcaacattttgagttataatcttggtggaatggggtgcagtgctgggctcatttctatagaccttgctaaacagctgctgcaggtgcaccccagctcttatgccttagtggtaagcatggagaacattactctcaactggtacttcggcaacgaccgatctatgctcgtctcaaattgcctcttccgcatggggggtgccgcaatccttctctccaaccgctcatccgatcgccaccgctccaaataccaactcattcacaccgtacgcacgcacaaaggtgccgatgacaaatgctacaactgcgtcttccaacgtgaggacgacaccaaaagaatcggcatttccctctcgaaagacctcatggctgtcgccggagaagcccttaaaaccaacatcaccactctggggccactagttcttcccatgtcggagcaactcctgtttttcgtcacgttggtggcaaggaaagtgttgaagatgaagatcaaaccctatatcccagatttcaagttggcattcgaacatttttgcattcatgcaggtgggagagccgtgctagatgagcttgaaaaaaaccttgaccttacagattggcacatggagccatcgagaatgacgctttacagatttggaaacacttcaagcagttctttgtggtatgaattagcttactctgaagccaaaggaagaatcagaaagggtgataggacatggcagattgctttcgggtcaggatttaagtgcaacagtgcagtttggaaggcattgaagaccatcaatccagctaaggagaaaagcccttggattgatgagattgatgagtttcctgttcatgtgcctagggtggcaaatattgcttcttcttctaaatcctaattcttcttaacaaggagattatcatttagtactgagtactatatatatggtttaatcattttatacgtggttaaggtgtgataatcaaattggttgttaatacccagttagaagggggaaaagggagaccattgtttcattttcattttttggtgttataaagtcaatttgattgatcaatgtatgtaaaatgcttttacacacaagaaatgcttgcttaattgttcaagaatttgttcaaaaaaaaaatgttcaagaattatgcttgcc

SEQ ID NO: 9121 - DNA, 2069 bp, Gossypium hirsutum
gggtccgcgcggcggtctccgtaaaatcccagaattcggcacgagacttttcgtacttcttttttttttttccttcattttcttagcaaattcaacatcgaaaaataaactaccacttttgttcacttctttataccaaagttttgtttccttgattttcaacaccgttttcgatttgggtttttctttaagcttcaaattgagttggatttgtagctaaaaaagaaaagaaaatggcagaagagagtaagcaaagaaggaacgttgagcccgtaaaggttcaaacagctccatcatcagaagaaagatcaaacaacaatctcccaaactttcttctttcagtaaggctaaaatatgtgaagcttggctaccattacgttatctctaacgctatgtatttgatgttggtgcctctcctaggcattgcttcagttcatctttccacacttactctcttagattttgttcgactatggaaccaactcaagttcaatctcgtttcagtaaccctatgttccggtcttttagttttcttggccacactttacttcatgagccggccaaggaaagtttacttagtgaatttcgcttgttacaagcctgaagctgatcgtatttgcaccagggagatcttcatggagagatctggtctcactggtagcttcaccgaagagaacttagcctttcagaagaaaatcctggagaggtctgggttgggacaaaagacatacttgcctgaggcagtgatgcgtgtcccacccaacccttgcatggcggaagccaggaaggaggccgagacagtgatgtttggagctattgatgaactcttggacaaaactggtgttaaggcaaaggatatagggatccttgtggtgaattgtagcttgttcaatcctacaccatctctttctgccatggttgtcaacagatacaagcttagaggcaacattttgagttataatcttggtggaatggggtgcagtgctgggctcatttctatagaccatgctaaacagctgctgcaggtgcaccccagctcttatgccttagtggtaagcatggagaacattacgctcaactggtacttcggcaacgaccgatctatgctcgtctcaaattgcctcttccgcatggggggtgccgcaatccttctctccaaccgctcatccgatcgccaccgctccaaataccaactcattcacaccgtacgcacgcacaaaggtgccgatgacaaatgctacaactgcgtcttccaacgtgaggacgacaccaaaagaatcggcatttccctctcgaaagacctcatggctgtcgccggagaagcccttaaaaccaacatcaccactctggggccactagttcttcccatgtcggagcaactcctgtttttcgtcacgttggtggcaaggaaagtgttgaagatgaagatcaaaccctatatcccagatttcaagttggcattcgaacatttttgcattcatgcaggtgggagagccgtgctagatgagcttgaaaaaaaccttgaccttacagattggcacatggagccatcgagaatgacgctttacagatttggaaacacttcaagcagttctttgtggtatgaattagcttactctgaagccaaaggaagaatcagaaagggtgataggacatggcagattgctttcgggtcaggatttaagtgcaacagtgcagtttggaaggcattgaagaccatcaatccagctaaggagaaaagcccttggattgatgagattgatgagtttcctgttcatgtgcctagggtggcaaatattgcttcttcttctaaatcctaattcttcttaacaaggagattatcatttagtactgagtactatatatatatatggtttaatcattttatacgtggttaaggtgtgataatcaaattggttgttaatacccagttagaagggggaaaagggagaccattgtttcattttcattttttggtgttataaagtcaatttgattgatcaatgtatgtaaaatgcttttacacacaagaaatgcttgcttaattgttcaagaatttgttcaaaaaa

SEQ ID NO: 9122 - DNA, 2190 bp, Gossypium raimondii
ttacccggttggcaaatacgtcaggtcaggttaacaattaaggttcgttgggggtagttgcatcctcccatctctcactcttcccctttaaatagctccaatttcttcccacaatttaactcatcagcacttttcgtacttcttttttttccttcattttcttagcaaattcaacatcgaaaaataaactaccacttttgttcacttctttataccaaagttttgtttccttgattttcaacaccgttttcgatttgggtttttctttaagcttcaaattgagttggatttgtagctaaaaaaaagaaaagaaaatggcagaagagagtaagcaaagaaggaacgttgagcccgtaaaggttcaaacagcttcatcatcagaagaaagaagatcaaacaacaatctcccaaactttcttctttcagtaaggctaaaatatgtgaagcttggctaccattacgttatctctaacgctatgtatttgatgttggtgcctctcctaggcattgcttcagttcatctttccacacttactctcttagattttgttcgactatggaaccaactcaagttcaatctcgtttcagtaaccctatgttccggtcttttagttttcttggccacactttacttcatgagccggccaaggaaagtttacttagtgaatttcgcttgttacaagcctgaagctgatcgtatttgcaccagggagatcttcatggagagatctggtctcactggtagcttcaccgaagagaacttagcctttcagaagaaaatcctggagaggtctgggttgggacaaaagacatacttgcctgaggcagtgatgcgtgtcccacccaacccttgcatggcggaagccaggaaggaggccgagacagtgatgtttggagctattgatgaactcttggacaaaactggtgttaaggcaaaggatatagggatccttgtggtgaattgtagcttgttcaatcctacaccatctctttctgccatggttgtcaacagatacaagcttagaggcaacattttgagttataatcttggtggaatggggtgcagtgctgggctcatttctatagaccttgctaaacagctgctgcaggtgcaccccaactcttatgccttagtggtaagcatggagaacattactctcaactggtactttggcaacgaccgatctatgctcgtctcaaattgcctcttccgcatgggcggtgtcgcaatccttctctccaaccgctcatctgatcgccaccgctccaaataccaactcattcacaccgtacgcacgcacaaaggtgccgatgacaaatgctacaactgcgtcttccaacgtgaggatgacaccaaaagaatcggcatttccctctcgaaagacctcatggctgtcgccggagaagcccttaaaaccaacatcaccactctggggccactagttcttcccatgtcggagcaactcttgtttttcgtcacgttagtggcaaggaaagtgttgaagatgaagatcaaaccctacatcccagatttcaagttggcattcgaacatttttgcattcatgcaggtgggagagccgtgctagatgagcttgaaaaaaaccttgaccttacagattggcacatggagccatcgagaatgacgctttatagatttgggaacacttcaagcagttctttgtggtatgaattagcttactctgaagccaaaggaagaatcagaaagggtgataggacatggcagattgctttcgggtcaggatttaagtgcaacagtgcagtttggaaggcattgaagaccatcaatccagctaaggagaaaagcccttggattgatgagattgatgagtttcctgttcatgtgcctagggtggcaaatattgcttcttcttctaaatcctaattcttcttaacaaggagattatcatttagtactgagtactatatatatatatggtttaatcattttatacgtggttaaggtgtgataatcaaattggttgttaatacccagttagaagggggaaaagggagaccattgtttcattttcattttttggtgttataaagtcaatttgattgatcaatgtatgtaaatgcttttacacacaagaaatgcttgcttaattgttcaagaatttgttcaaaaaaaaaatgttcaagaattatgcttgccagctctattttgt

SEQ ID NO: 9123 - DNA, 1799 bp, Populus trichocarpa
ttctccttctccatatagccttctggggcctcttcgttttcgtgcattcaggccaagactttccatttttttagggtatttaattaagtgccccggaaatggcagaggatcagagaaaacaaagactgggaccagaatcagtcacggttcatgatgaagaaccagctgaaacgaagagaaacaccctcccaaactttcttctatcagttaaactcaaatatgtgaaacttggttatcattacttaatttccaatgccatgtttctcctgcttattccactcctattcattgcatcagctcatctttcaactcttaccatccaagatttcgtccagctttggaaccacctcaaattcaattttgtctcagtaactgtttgctcaggccttctagttttcttggctactctttacttcaccagccgtcctagaaaaatatacttgttggattttgcatgttacaagcccgaacccgctcgaatgtgcaccagagagactttcatggagaaatcagtactagcaggcagcttcagtgaagagaacatagcctttcaaaagaagattattgagaggtctggtttaggacaaaatacttacttccctgaggcagtgatgcggatcacaccaaggccgggcatggaggacgcaaggaaggaggctgagatggtgatgtttggagccattgatgagctcttggccaaaactggggttaaagctaaggatataggcattcttatagtgaattgcagtttgttcaatccaaccccgtctctctctgccatggtagtcaatcactacagactcagggggaacatattgagctataatcttggtggtatgggttgcagtgctgggctcatctctattgatcttgccaagcagctactgcaggtgcatcccaattcctatgctctagtgatcagtatggagaacatcactcttaattgttactttggtaatgaccggtccatgcttgtctccaactgcttattccgtatgggtggtgctgcaatccttctctccaaccgatcatccgatcgccgccgctcaaagtatcaactaatccacactgttcgaacacacaagggggctgatgataagtgttacaattgtgtgttccaaaaagaggataacaccagaagagttggtgtttcgctttccaaggacctcatggctgttgctggagaagcccttaaaaccaatatcacaacactagggccgttagtccttcccatgtcagagcaactcctattttttgctactttagtaggaagaaagatcttcaaaatgaagataaaaccatacattccagatttcaagttggcttttgagcacttctgcatccatgctggtgggagagccgtgttagatgaactagagaaaaatctcgagctctctgactggcacatggagccttcaagaatgactctttataggtttggtaacacttctagtagctctttgtggtatgaattggcttactctgaggccaaagggagaattaggaagggtgatagaacctggcagattgctttcggttcaggattcaagtgtaacagtgcggtgtggcatgcattgaggacaatcaatccggcaaaagagaagaatccttgggttgatgaaattgatgaattccctgttcatgtgcctaaagtggtgcccatcgcctcttgaatctttctctttttgttttttttataaaaaatggatcgattgttaaatataagtgaatttatgtgcgatttatgaagaagaaaggaaaagaagtaagaaaagaaaaacccttggtaggatattaac

SEQ ID NO: 9124 - DNA, 1902 bp, Quercus alba
atggggaagccattactctctcacgtttcctagatagctaggccgtacgtctacctttctttaattttatcttgaattccgatttggattttaccattttatatccaaatttccaacccccataatacacatacaactgccttctttcttctctaaaagctaccaaaatttttcattttgatcccaccaccggtaccatgggagatgagaggaagcaaaccccagaaactgtaccggtttctgttcaaactctgcccgagagaaagaaaaataagctccctaactttctcttatccgtcagactcaaatatgtgaaacttgggtaccactacttaatctccaatgccatgtacctcttgcttgtaccacttcttggcatgacttcggctcatctttctatgctcactcttcaagatgttttgcagttatgggacaacctaataaagttcaatcttgtttcggtgactataggctcatgcgtaatggttttccttgccaccttttacttcaccagccgtccaagaaaagtttacctagtaaactttgcgtgttacaagcctgaagaggctcgaatatgtaggagggagattttcattgaaagatctactttaactgggactttcacggaggagaacttggcttttcaaaagaagattctggaaaggtcaggattgggccaaaagacctacttgcctgaggccgtgttgagagtcccgcccaatccctgtatggccgaggcaaggaaggaggctgaagctgtcatgttcggagccattgatgagctcttggcaaagactggagtgaaggctaaggatatagggattcttgtagtcaattgtagcttgttcaacccgactccatccctctcctccatgattgtgaatcactacaagctcagagggaacattttaagctataatcttggtggtatgggttgtagtgctggccttatttctatagatcttgctaagcagctattacaggtgcaccctaactcttatgccctagtaatgagcatggagaatataactctcaattggtacttcggcaacgaccgatcaatgctagtctcaaactgcctctttcgcatgggtggagcagcgatcctcctctccaatcattcttcagatcgtcgtcgttcaaagtatcaactcatccacaccgtacgtacccacaagggtgccgatgataagtgttacaattgtgtgttccaaaaagaggatgaaaccaaaagaattggtgtctcactctcaaaagacctaatggcagtggctggagaagccctcaaaaccaacatcactacacttgggccattagtccttcccatgtctgaacaactactattttttgcgactttagtgggaaggaagatctttaaaatgaagataaaaccatacattccggattttaagctagctttcgagcatttttgcattcatgcaggggggagagcagtgctagatgagctggagaaaaacctggagctcacggattggcaaatggagccttcaagaatgactcttaataggtttgggaatacttctagtagttctttgtggtatgaattggcttacactgaggctaaagggaggatcaagaagggtgacaggacgtggcagattgcttttggttcgggattcaagtgtaacagtgctgtgtggcgtgctttaaagaccattgacccagctaaggagaagagtccttgggtggatgagattgatgagtttccagttcatgtgcctaaagtgtcagccattaatgtttcttgaaagtttaaattaagtttcttcgtgggggggagagggaaggagggaatttgtgtgtattaaatttatttctgaatgccgtataaacaattgaaatctgttgcctaattgaatgtttcttatagtttttatgtgt

SEQ ID NO: 9125 - DNA, 2048 bp, Populus trichocarpa
caaattgaatgccatggcgggttaacaattaaaagttcgttggggtagttgcatcctcccgagaaccaccctctctctctctctctcgatccactctctttaaaacccaatacatttcttccctttcggcaacccagttttctctcttctccttctccttctccatatagccttctggggcctcttcgttttcgtgcattcaggccaagactttccatttttttagggtatttaataagtgccccggaaatggcagaggatcagagcaaacaaagactgggaccagaatcagtcacggttcatgatagggaaccagctgaaacgaagagaaacaccctcccaaactttcttctatcagttaaactcaaatatgtgaaacttggttatcattacttaatctccaatgccatgtttctcctgcttattccactcctattcattgcatcagctcatctttcaactcttaccatccaagatttcgtccagctttggaaccacctcaaattcaattttgtctcagtaactgtttgctcaggccttctagttttcttggctactctttacttcaccagccgtcctagaaaaatatacttgttggattttgcatgttacaagcccgaacccgctcgaatgtgcaccagagagactttcatggagacatcagcactagcaggcagcttcagtgaagagaacttagcctttcaaaagaagattattgagaggtctggtttaggacaaaatacttacttccctgaggcagtgatgcggatcacaccaaggccgggcatggaggacgcaaggaaggaggctgagatggtgatgtttggagccattgatgagctcttggccaaaactggggttaaagctaaggatataggcattcttatagtgaattgcagtttgttcaatccaaccccgtctctctctgccatggtagtcaatcactacagactcagggggaacatattgagctataatcttggtggtatgggttgcagtgctgggctcatctctattgatcttgccaagcagctactgcaggtgcatcccaattcctatgctctagtgatcagtatggagaacatcactcttaatcggtactttggtaatgaacggtccatgcttgtctccaactgcttattccgtatgggtggtgctgcaatccttctctccaaccgatcatccgatcgccgccgctcaaagtatcaactaatccacactgttcgaacgcacaagggggctgatgataagtgttacaattgtgtgttccaaaaagaggataacaccagaagagttggtgtttcgctttccaaggacctcatggctgttgctggagaagcccttaaaaccaatatcacaacactagggccgttagtccttcccatgtcagagcaactcctattttttgctactttagtaggaagaaagatcttcaaaatgaagataaaaccatacattcctgatttcaagttggcttttgagcacttctgcatccatgctggtgggagagccgtgttagatgaactagagaaaaatctcgagctctctgactggcacatggagccttcaagaatgactctttataggtttggtaacacttctagtagctctttgtggtatgaattggcttactctgaggccaaagggagaattaggaagggtgatagaacctggcagattgctttcggttcaggattcaagtgtaacagtgcggtgtggcatgcattgaggacaatcaatccggcaaaagagaagaatccttgggttgatgaaattgatgaattccctgttcatgtgcctaaagtggtgcccatggcctcttgaatctttctcttttttttttttttttttaaaatggatcgattgttaaatgtaagtgaatttatgtgcgatatatgaagtggccattgactattttctccttttctgttctttggttacattctattcttcttcttcttattatttcgagaagtagtgttttagttgttattagtcaatgaatgtcattcatgtgcaagatggttgaagagtttaacattccttta

SEQ ID NO: 9126 - DNA, 1971 bp, Solanum lycopersicum
ttgttggggtagttgtacccccccccccacaccccacttctccacatactctttaaattctcatacaacctttttttttcctcctcaacacatctctacttttcctcaagtcctttttttcttacttgtgtacttcttgttcacatttgtcacaaaaaatcaataaaaatccaagaaagtcacttatttgtctaagttatagttgataaatttgtggggttgattgaaaaattccaacaaaatgggagatgaatcaactagaagagtttcaattgaagctaatagtaataaacttccaaattttctattatcagttaggctcaaatatgttaaacttggctatcattatttgattagccatgctatgtatttgttccttatcccaattttaattgctttatttgctcatctttcaacaattactatggaagatatggttcaattatggaatcaactaaaattcaatcttgtcacagtaattttatgttcagcccttatagttttcttggctacactttattttatgactaggccacgtaaagtgtacctagtcgatttttcgtgttacaagcccaaacctgaagttatgtgtcctaaggaattattcatggagagatcaaagttagccgggattttcactgaggagaatttggcctttcagaagaaaatactagagaggtcaggtttaggtcaaaagacgtattttccggaagcacttttgaaattgccaccaaatccttgtatggctgaggcaagaaaagaagctgaaatggttatgtttggtgcaattgatgaattgttagagaaaactggtgttaaggctaaggatattgggattcttgtggtgaattgtagtttatttaatccaactccatcactttctgctatgattgttaatcattataagcttagaggaaatattttgagttataaccttggtggtatgggatgtagtgctggattaatttcaattgaccttgccaagcaaatgctacaggttcaaccaaactcatatgcactagtagtcagcatggaaaacataacactaaattggtactttggtaacaatcgatccatgttagtctcaaattgcatttttcgtatgggtggtgcagcaatattattatcaaataaatcgtccgatcgaaaacgttcaaaataccaactcatacatacagtacgaacacacaaaggtgccgatgacaagagctatggatgtgtgttccaagaagaagacgataataaaaaaatcggggtcgcgctgtctaaagacctaatggctgtagcaggggaggccttgaaaacgaacattacaactctagggccaatcgttctacctatgtccgaacaactattatttttcgcgacattagtcgcgaggaaagtgttgaagatgaaaataaaaccgtatattcctgattttaagttagcgtttgaacatttttgtatacatgctggtggtagggcggtgttggatgagttagaaaaaaatcttgagttgagtgaatggcatatggagccatcaagaatgacactttatagatttggtaatacttcaagtagttcattgtggtatgaattggcatatactgaagctaaagggaggattaagaaaggtgataggacatggcaaattgcatttggttcaggatttaagtgtaatagtgctgtgtggtgtgcattaaggactattaatcctgctaaggagaagaatccttggatggatgagattgatgaatttccagttgaagtgcctagggttgtgacaattaatgattcttgaagaatgttttgtttaacctaaaaaaaggggaagcaaaaggaactagtttatgtgttgtgatcattgtaatattacctcactttgttgttgttgtttggtgttataactaggtggatatgtactttgattatgatttaagaaatcaatacaatatcttctatatacatgtttttgataaacgtgttatt

SEQ ID NO: 9127 - DNA, 1876 bp, Solanum lycopersicum
ctcaacacatctctacttttcctcgagtcctttttttcttacttgtgtacttcttgttcacatttgtcacaaaaaatcaataaaaatccaagaaagtcacttatttgtctaagttatagttgataaatttgtggggttgattataaaattccaacaaaatgggagatgaatcaactagaagagtttcaattgaagctaatagtaataaacttccaaattttctattatcagttaggctcaaatatgttaaacttggctatcattatttgattagccatgctatgtatttgttccttatcccaattttaattgctttatttgctcatctttcaacaattactatggaagatatggttcaattatggaatcaactaaaattcaatcttgtcacagtaattttatgttcagcccttatagttttcttggctacactttattttatgactaggccacgtaaagtgtacctagtcgatttttcgtgttacaagcccaaacctgaagttatgtgtcctaaggaattattcatggagagatcaaagttagccgggattttcactgaggagaatttggcctttcagaagaaaatactagagaggtcaggtttaggtcaaaagacgtattttccggaagcacttttgaaattgccaccaaatccttgtatggctgaggcaagaaaagaagctgaaatggttatgtttggtgcaattgatgaattgttagagaaaactggtgttaaggctaaggatattgggattcttgtggtgaattgtagtttatttaatccaactccatcactttctgctatgattgttaatcattataagcttagaggaaatattttgagttataaccttggtggtatgggatgtagtgctggattaatttcaattgaccttgccaagcaaatgctacaggttcaaccaaactcatatgcactagtagtcagcatggaaaacataacactaaattggtactttggtaacaatcgatcaatgttagtctcaaattgcatttttcgtatgggtggtgcagcaatattattatcaaataaatcgtccgatcgaaaacgttcaaaataccaactcatacatacagtacgaacacacaaaggtgcggatgacaagagctatggatgtgtgttccaagaagaagatgataataaaaaaatcggggtcgcgctgtctaaagacctaatggctgtagcaggggaggccttgaaaacgaacattacaactctagggccaattgttctacctatgtccgaacaactattatttttcgcgacattagtcgcgaggaaagtgttgaagatgaaaataaaaccgtatattccagattttaagttagcgtttgaacatttttgtatacatgctggtggtagggcggtgttggatgagttagaaaaaaatcttgagttgagtgaatggcatatggagccatcaagaatgacactttatagatttggtaatacttcaagtagttcattgtggtatgaattggcatatactgaagctaaagggaggattaagaaaggtgataggacatggcaaattgcatttggttcaggatttaagtgtaatagtgctgtgtggtgtgcattaaggactattaatcctgctaaggagaagaatccttggatggatgagattgatgaatttccagttgaagtgcctagggttgtgacaattaatgattcttgaagaatgttttgtttaacctaaaaaaaggggaagcaaaaggaactagtttatgtgttgtgatcattgtaatattacctcactttgttgttgttgttgttataactaggtggatatgtactttgattatgatttaagaaatcaatacaatatcttctatatacatgtttttcataaac

SEQ ID NO: 9128 - DNA, 1995 bp, Gossypium raimondii
gcaagcaactcattaactcattcatacattttccttcattttctcagcgaattcgaaaccgaaaacgcaagaaatttttcattttttcttgattccaggcaacttttcaatctgggttttgcttgaatattcatattaactttgttttataccaaaaaaaaaaagatgacagaagcgagtaagaaaagcatgaatccggaaccagttcatgttcaaagcacagcttcgtcaaacgaaacaagatcaaacaacaatctccccaattttcttctttcagtgaggctaaaatacgtgaagctcggctaccattatttaatctccaacgccatgtatttaatgctggtgccgttgttagccattgcttcagctcatctctcaacgctcacggtccttgatttcgttcaactatgggaccaactcaagttcaatcttgtctctgttactttatgttcaggccttttggtttttttagccaccctttacttcatgagccgtccccggaaagtttatttggtggatttcgcttgttataagccggagcctgaacggacttgtaccagggagattttcatggagaggtcgggtcttactggaagtttcactgaagagaacttggcttttcaaaagaagatactggagaggtctggtttagggcaaaagacgtatttgcctgaggcggtgttgcgtgtaccgccgaacccttgtatggcggaggcaaggaaagaagcggaggcagtgatgtttggtgccattgatgagctgttggagaagactggtgttaaggctaaggatatcggcatccttgtggtgaattgtagcttgtttaaccctacaccgtcgctttccgccatgattgttaatagatataagcttagaggcaatattttgagctataatcttggtggaatgggttgcagtgctgggctgatttctattgaccttgctaaacaaatgctacaggtacatcctaactcttatgccttggtggtgagcatggagaacattactctcaactggtacttcggcaacgaccgatccatgctagtctctaactgcttgttccgtatgggcggtgccgcgatccttctatcaaaccggtcatccgatcgccgccgctccaagtaccaactcatccacaccgtacgaacccacaaaggagccgacgacaaatgctacaactgcgtcttccaacgtgaggacgacaccaaacggatcggcgtttccctctccaaagacctcatggcggtcgccggcgaagccctcaaaaccaacatcaccaccctcggtccattagtcctccccatgtccgaacaactcctctttttcatcactttagtagcccgaaaagtcttcaaaatgaagatcaggccatacatcccggatttcaaactagctttcgagcatttttgcatccatgcaggtgggagagccgtgttagatgagctagaaaagaaccttgagctctcagattggcacatggaaccatcgaggatgacactttacaggttcggtaacacgtcgagcagctctttatggtacgaactagcttactcggaagccaaaggaaggatccgaaaaggtgatcggacatggcagattgcattcgggtcagggtttaaatgcaacagtgctgtatggaaagcattgaagaccattaatccagcaaaggagaagagtccatggattgatgaaattgatgaatatcctgtttatgtgcctaaggtggccactgtttcttcttcttcttcttcccaaaaaaccatataattttcatcattcaaaggaagagaatagagagaaagagaggacttaatcagtaattattagaactatgatttattttttattttttttacatattgtttaattttgtgttgatttgaagattaatttattccaagttgaagatatatatatataaatatatatatttcatttttcattttcattttcattttaattttaatttttagtgttataaaaaaattattgatg

SEQ ID NO: 9129 - DNA, 1944 bp, Gossypium hirsutum
cgaatcgaaaccgaaaacgcaagaaatttttcattttttcttgattccaggcaacttttcaatctgggttttgcttgaatattcatattaactttgttttatacttaaaaaagatgacagaagcgagtaagaaaagcatgaatccggaaccagttcatgttcaaagcacagcttcgtcaaacgaaacaagatcaaacaacaatctccccaattttcttctttcagtgaggctaaaatacgtgaagctcggctaccattatttaatctccaacgccatgtatttaatgctggtgccgttgttagccattgcttcagctcatctctcaacgctcacggtccttgatttcgttcaactatgggaccaactcaagttcaatcttgtctctgttactttatgttcaggccttttggtttttttagccaccctttacttcatgagccgtccccggaaagtttatttggtggatttcgcttgttataagccggagcctgaacggacttgtaccagggagattttcatggagaggtcgggtcttactggaagtttcactgaagagaacttggcttttcaaaagaagatactggagaggtctggtttagggcaaaagacgtatttgcctgaggcggtgttgcgtgtaccgccgaacccttgtatggcggaggcaaggaaagaagcggaggcagtgatgtttggtgccattgatgagctgttggagaagactggtgttaaggctaaggatatcggcatccttgtggtgaattgtagcttgtttaaccctacaccgtcgctttccgccatgattgttaatagatataagcttagaggcaatattttgagctataatcttggtggaatgggttgcagtgctgggctgatttctattgaccttgctaaacaaatgctacaggtacatcctaactcttatgccttggtggtgagcatggagaacattactctcaactggtacttcggcaacgaccgatccatgctagtctctaactgcttgttccgtatgggcggtgccgcgatccttctatcaaaccggtcatccgatcgccgccgctccaagtaccaactcatccacaccgtacgaacccacaaaggagccgacgacaaatgctacaactgcgtcttccaacgtgaggacgacaccaaacggatcggcgtttccctttccaaagacctcatggcggtcgccggcgaagccctcaaaaccaacatcaccaccctcggtccattagtcctccccatgtccgaacaactcctctttttcatcactttagtagccagaaaagtcttcaaaatgaaaatcaggccgtacatcccggatttcaaactagctttcgagcatttttgcatccatgcaggtgggagagccgtgttagatgagctagaaaagaaccttgagctctcagattggcacatggaaccatcgaggatgacactttacaggttcggtaacacgtcgagcagttctttatggtacgaactagcttactcggaagccaaaggaaggatccgaaaaggtgatcggacatggcagattgcattcgggtcagggtttaaatgcaacagtgctgtatggaaagcactgaagaccattaatccagcaaaggagaagagtccatggattgatgaaattgatgaatatcctgtttatgtgcctaaggtggccactgtttcttcttcttcttcttcccagaaagccatataattttcatcaaaggaagacagtagagagaaagagaggacataattagtgattattagaactatgatttattttttattttttttacatgtttacttgtgtgttgatttgaagattaatttattctaagttgaagatatatatatatcatttttcattttcattttcatttttagtgttataaaaaaaattattgatgttgtagaaaacaaatttgcttatttctttttaa

SEQ ID NO: 9130 - DNA, 2429 bp, Gossypium raimondii
attcatttgagcaaattgaccaagttgtaaacccttggtccatgcacccaaatcacatacacaatatacaagagtggcaaatctgaaatttcctaattacgagaaggccgaaaagtaaatcattataaaatatttccataagataaaaaaaaacaaaaatagagaaaataaaataaataattttccgggttggcgaattcaatgccaaggcgtgttaacaattaaaagttcgttggggtagttgtatcctcccatctctctttccccccttacctctttaaattctccactaaacctcttcccccaaactgcaagcaactcattaactcattcatacattttccttcattttctcagcgaattcgaaaccgaaaacgcaagaaatttttcattttttcttgattccaggcaacttttcaatctgggttttgcttgaatattcatattaactttgttttataccaaaaaaaaaagatgacagaagcgagtaagaaaagcatgaatccggaaccagttcatgttcaaagcacagcttcgtcaaacgaaacaagatcaaacaacaatctccccaattttcttctttcagtgaggctaaaatacgtgaagctcggctaccattatttaatctccaacgccatgtatttaatgctggtgccgttgttagccattgcttcagctcatctctcaacgctcacggtccttgatttcgttcaactatgggaccaactcaagttcaatcttgtctctgttactttatgttcaggccttttggtttttttagccaccctttacttcatgagccgtccccggaaagtttatttggtggatttcgcttgttataagccggagcctgaacggacttgtaccagggagattttcatggagaggtcgggtcttactggaagtttcactgaagagaacttggcttttcaaaagaagatactggagaggtctggtttagggcaaaagacgtatttgcctgaggcggtgttgcgtgtaccgccgaacccttgtatggcggaggcaaggaaagaagcggaggcagtgatgtttggtgccattgatgagctgttggagaagactggtgttaaggctaaggatatcggtatccttgtggtgaattgtagcttgtttaaccctacaccgtcgctttccgccatgattgttaatagatataagcttagaggcaatattttgagctataatcttggtggaatgggttgcagtgctgggctgatttctattgaccttgctaaacaaatgctacaggtacatcctaactcttatgccttggtggtgagcatggagaacattactctcaactggtacttcggcaacgaccgatccatgctagtctctaactgcttgttccgtatgggcggtgccgcgatccttctatcaaaccggtcatccgatcgccgccgctccaagtaccaactcatccacaccgtacgaacccacaaaggagccgacgacaaatgctacaactgcgtcttccaacgtgaggacgacaccaaacggatcggcgtttccctctccaaagacctcatggcggtcgccggcgaagccctcaaaaccaacatcaccaccctcggtccattagtcctccccatgtccgaacaactcctctttttcatcactttagtagcccgaaaagtcttcaaaatgaagatcaggccatacatcccggatttcaaactagctttcgagcatttttgcatccatgcaggtgggagagccgtgttagatgagctagaaaagaaccttgagctctcagattggcacatggaaccatcgaggatgacactttacaggttcggtaacacgtcgagcagctctttatggtacgaactagcttactcggaagccaaaggaaggatccgaaaaggtgatcggacatggcagattgcattcgggtcagggtttaaatgcaacagtgctgtatggaaagcattgaagaccattaatccagcaaaggagaagagtccatggattgatgaaattgatgaatatcctgtttatgtgcctaaggtggccactgtttcttcttcttcttcttcccaaaaaaccatataattttcatcattcaaaggaagagaatagagagaaagagaggacttaatcagtaattattagaactatgatttattttttatttttttttacatgtttaattgtgtgttgatttgaagattaatttattccaagttgaagatatatatatataaataatatatatttcatttttcattttcattttcattttaatttttatttttagtgttataaaaaaattattgatgttgtagaaaacaaatttgcttatttctttttcttaaccaattgttattggaattattgttcctactatctctgcccaacagcttttgtttgagtcagttcacctaataaaatgttaaaatatttgg

SEQ ID NO: 9131 - DNA, 2130 bp, Populus trichocarpa
cgctggggtagttgcatcctcccgagtacaactctcccttctttatctatacccatactctttaaatcccaactcatctcttccctctttgcaagccatttttctttcttctcaattatcatacaacaaagcaagcacaccttcaagtttttttttttctgtgctcatttcacagaatccggccctcttagctataatttccacactgatcagagatctttccattccttctctatagctttgtgggttctcctctttttgtttaaccacataaaaagagtaagaactccgatttaatttcttaggctatacattgaagttccaataaaatggcagaggatcagagcaaacaaaaaccgaaaccagaatcagtcacagttgatgctgagacgaagagaaacaggctcccatactttctcttatcagttagactcaaatatgtgaagcttggttatcattatttaatctctagtgccatgtatctcttgcttgttccactcctattcattgcatcagctcatctttcaacactcactatccgagattttgtccagctatggaaccacctcaagttcaattttgtctcagtaactctgtgctcaggtcttgtagttttcttggctactctctacttcatgagccgtcctagaaaaatattcttggtggattttgcatgttacaagcctgaacctgctcgaatgtgcaccagagaaactttcatggagaaatcagcagtagcaggctgcttcagtgaagagaacctggcctttcaaaagaagatcctcgagaggtctggtttaggacagaacacttacttccccgaggctgtgatgcgggtcacaccaaggccgtgcatggaggacgcaaggaaggaggctgagatggtgatgtttggagccattgatgagctcttggccaaaactggggttaaagctaaggatataggtgttcttatagtgaactgcagtttgttcaacccaaccccttctctctctgctatggtaatcaatcattacaagcttagagggaacatattgagctacaatcttggcggtatgggttgcagtgctgggcttatttccatcgatctcgccaagcagcttttgcaggtgctccccaattcctatgccctggtgatcagtatggagaacatcactcttaattggtacttcggcaatgaccgctccatgcttgtctccaactgcttattccgtatgggtggtgccgcaatccttctctccaaccgaccatccgatcgccgccgctcaaagtatcaactaatccacactgttcgcacacacaaaggtgccgatgacaagtgttacaattgtgtcttccaaaaggaggatgacaccaaaagaattggtgtctcactttctaaagaccttatggctgttgcgggggaagctctcaaaaccaatattactacactagggccattggtacttcccatgtcagaacagctcctattttttgcaactttagtaggaaggaagatctttaaactgaacataaaaccatacattcctgatttcaagttggcttttgaacacttctgcattcatgctggagggagagctgtgttagatgaactagagaaaaaccttgagctctctgattggcatatggagccttcaagaatgactctttataggtttggtaacacctctagtagttcgttgtggtatgaattggcttactctgaggccaaaggaagaattaggaagggtgatagaacttggcagattgctttcggttcaggattcaagtgtaacagtgcggtgtggtatgcattgaggacgatcaatccggcaaaagagaagaatccctggattgatgagattgacgaattccctgttcatgtgcctaaagtggtgtccattgcttcttgaagctcgacaatttccccttttcggagggagatagttataatgtcaattgcttacaactcttttcttttctttcgatttttcttttttttgagaacggattatcaattgttttatgtaagtgcaatttatgtgcaagtgaagacaattaattgtttatggttaaattctgattctcttcgtattttaattttgttgttaatcaacgaatgtcattcatgttcaagatggctgaaaagct

SEQ ID NO: 9132 - DNA, 2098 bp, Gossypium hirsutum
cattaactcattcatacattttccttcattttctcagcgaattcgaaaccgaaaacgcaagaaatttttcattttttcttgattccaggcaacttttcaatctgggttttgcttgaatattcatattaactttgttttatacttaaaaaagatgacagaagcgagtaagaaaagcatgaatccggaaccagttcatgttcaaagcacagcttcgtcaaacgaaacaagatcaaacaacaatctccccaattttcttctttcagtgaggctaaaatacgtgaagctcggctaccattatttaatctccaacgccatgtatttaatgctggtgccgttgttagccattgcttcagctcatctctcaacgctcacggtccttgatttcgttcaactatgggaccaactcaagttcaatcttgtctctgttactttatgttcaggccttttggtttttttagccaccctttactttatgagccgtccccggaaagtttatttggtggatttcgcttgttataagccggagcctgaacggacttgtaccagggagattttcatggagaggtcgggtcttactggaagtttcactgaagagaacttggcttttcaaaagaagatactggagaggtctggtttagggcaaaagacgtatttgcctgaggcggtgttgcgtgtaccgccgaacccttgtatggcggaggcaaggaaagaagcggaggcagtgatgtttggtgccattgatgagctgttggagaagactggtgttaaggctaaggatatcggcatccttgtggtgaattgtagcttgtttaaccctacaccgtcgctttccgccatgattgttaatagatataagcttagaggcaatattttgagctataatcttggtggaatgggttgcagtgctgggctgatttctattgaccttgctaaacaaatgctacaggtacatcctaactcttatgccttggtggtgagcatggagaacattactctcaactggtacttcggcaacgaccgatccatgctagtctctaactgcttgttccgtatgggcggtgccgcgatccttctatcaaaccggtcatccgatcgccgccgctccaagtaccaactcatccacaccgtacgaacccacaaaggagccgacgacaaatgccacaactgcgtcttccaacgtgaggacgacaccaaacggatcggcgtttccctctccaaagacctcatggcggtcgccggcgaagccctcaaaaccaacatcaccaccctcggtccattagtcctccccatgtccgaacaactcctctttttcatcactttagtagcccgaaaagtcttcaaaatgaagatcaggccatacatcccggatttcaaactagctttcgagcatttttgcatccatgcaggtgggagagccgtgttagatgagctagaaaagaaccttgagctctcagattggcacatggaaccatcgaggatgacactttacaggttcggtaacacgtcgagcagctctttatggtacgaactagcttactcggaagccaaaggaaggatccgaaaaggtgatcggacatggcagattgcattcgggtcagggtttaaatgcaacagtgctgtatggaaagcattgaagaccattaatccagcaaaggagaagagtccatggattgatgaaattgatgaatatcctgtttatgtgcctaaggtggccactgtttcttcttcttcttcttcccaaaaaaccatataattttcatcattcaaaggaagagaatagagagaaagagaggacttaatcagtaattattagaactatgatttattttttatttttttacatgtttaattgtgtgttgatttgaagattaatttattccaagttgaagatatatatatataatatttcttttcattttcattttcattttatttttagtgttataaaaaaattattgatgaaatattgatgttgtagaaaacaaatttgcttatttctttttcttaaccaattgttgttggaattattgttcctactatctctgcccaacatcttttgtttgagtcagttcacctaataaaatgttaaaatatttgg

SEQ ID NO: 9133 - DNA, 1960 bp, Solanum phureja
aacacatctcttttcctcaagtctttttttctcacttgtgtacttcttgttcacatttgtgacaaaaaaataataaaaatccaagaaagtcacttatttctctaagttatatttgattaatttgtggggttggttcaaaaattccaacaaaatgggagatgaatcaactagaagagtttcaattgaagctaatcatcatgatgatcaaagaattaatagtaataaacttccaaattttctattatcagttaggctcaaatatgttaaacttggctaccattatttgattagccatgctatgtatttgttccttatcccaattttaattgctttatttgctcatctttcaacaattactatggaagatatggttcaattatggaaccaactaaaattcaatcttgtcacagtaattttatgctcagcccttatagttttcttggctacactttattttatgactaggccacgtaaagtgtacctagtcgatttttcgtgttacaaacccaaacctgaagttatgtgtcctaaggaattattcatggagagatcaaaattagccggaattttcactgaggagaatttggcctttcaaaagaaaatattagaaaggtcaggtttaggtcaaaagacgtattttccagaagcgttattgaaattgccaccaaatccttgtatggctgaggcaagaaaagaagctgaaatggttatgtttggtgcaattgatgaattgttagagaaaactggtgtgaaggctaaggatattgggattcttgtggtgaattgtagtttatttaatccaactccatcactttctgctatgattgttaatcattataagcttagaggaaatattttgagttataaccttggtggtatgggatgtagtgctggattaatttcaattgaccttgccaagcaaatgctacaggtgcaaccaaactcatatgcactagtagtcagcatggaaaacataacactaaattggtactttggtaacaatcgatcaatgctagtctcaaattgcatttttcgtatgggtggtgcagcaatattattatcgaataaatcgtccgatcgacgacgttcaaaatatcaactcatacatacagtgcgtacaaacaaaggtgcagatgacaagagctatggatgtgtgttccaagaggaagatgatagtaaaaaaatcggggtcgcgttgtctaaagacctaatggctgtagcaggggaggccttgaaaacgaacattacaactctagggccaattgttctccctatgtccgaacaactattgttttttgcgacattagtcgctaggaaagtgttgaagatgaaaataaaaccgtatattcctgattttaagttagcgtttgaacatttttgtatacatgctggtggtagggcagtgttggatgagttagaaaaaaatcttgagttaagtgaatggcatatggagccatcaagaatgacactttatagatttggtaatacttcaagtagttcattgtggtatgaattggcatatactgaagctaaagggaggattaagaaaggtgataggacatggcaaattgcatttggttcaggatttaagtgtaatagtgctgtgtggtgtgcattgaggactattgatcctgctaaggagaagaatccttggatggatgaaattgatgaatttccagttgaagtgcctagagttgtgacaattaatgattcttgaagaatattttgtttaaccctaagaaaggggaagcaaaggaactagtttatgtgttgtgatcattgtattattacctcactttgttgttagcaaaggaactagtttatgtgttgtgatcattgtaatattacctcactttgtttttgttgtttttgttgttactagctaggtgggtgtgtactttgattatgatttaagaaagcaatacaatatcttctgtatacatgtttttgataaacgtgt

SEQ ID NO: 9134 - DNA, 1772 bp, Tripterygium wilfordii
tacttcaatttggctttcctttctcaaatctcatcaaagactccaacttttttggatatctaaggtgggttttgtgattgctgtttgatttcaacaatggtggaagagaataggcagaacgcaagaccagaatcctctgttgtagttgaaggaagggaaaataagctgccaaactttctctcgtcagtcagattgaaatatgtgaaattgggttaccattacttgatctccaatgctatgtatctcctgctattaccactcctattgatttcttcggctcatctttctacgttcactgtcgagaattttatgcagctgtggagtcacctgaagttcaattttgtgtctgcaactctgtgttctggtcttatcgttttcttggccactctgtacttgaccagcagaccaagaaaagtctacttagtagatttcgcatgttacaagcctcccactgaacgcatatgcacaagagagattttcatggagagatcaacacttgctgggtccttcacagaggagaatttggccttccagaagaaaattcttgagaggtctggtttgggtcaaaagacttacttgccagaagcggtgctgcgggttccgccgaacccgtgtatggcagaggcgagaaaagaagcagagactgtgatgttcaatgcaattgatgaactcttgtcaaaaacgggggttaaggccaaggatattgggattcttgttgtgaattgcagtttgttcaatccgactccgtctttgtctgcgatgattgtgaatcattacaagcttagagggaacatcttgagctttaaccttggtggtatgggttgcagtgctggacttatttcgattgatcttgccaaacaactcctacaggtgaatcccaactcatatgctctagtggtaagcatggagaacataaccctaaattggtattttgggaatgaaagatctatgcttgtatcaaactgcctctttagaatgggtggtgcagcaatacttctctcaaacagatcatctgacagcaggcggtccaagtaccaactcattcacactgtccggacacacaagggtgccgatgatagatgctataattgtgtgttccagcaagaggattcaagcaaagaaattggtgtggctctctcaaaagatctaatggcagtagctggtgaagcacttaagaccaatatcacaacactaggaccattagtccttccgatgtcagagcaactgctattctttgcaactttggttgctagaaaagtatttaagatgaaaatcaagccatacattccggatttcaagctcgctttcgagcatttctgcattcacgcaggaggcagggcagtgttggatgaattggagaagaatcttgagctctcagagtggcatatggaaccatcaagaatgacacttaataggtttggaaatacttcaagtagctcattgtggtatgaattggcttattctgaagctaaagggaggatcaagaagggtgatagaacatggcagattgcatttggttcaggattcaagtgtaacagtgctgtgtggaaggctttgaggacaatcaaccctgcaaaagagaagaatccatgggttgatgagattcatgagttccctgttcatgtgcctaaagtggcagccattaatggttctaataatggaagtccccattcattgtttacttgatttatttatgtcattagttcaaaaaaaaatgattggtgtctgtaatctcatcaacctatggattattatctagcaggaagaaaact

SEQ ID NO: 9135 - DNA, 1576 bp, Olea europaea
tttgttgatcatcaatggggaatgaggatttgattaatcctgaaccgcaaaaaatatctgttgaaagagggaataacctccccaactttcttctatctgttaggcttaaatatgtgaaacttggtatttattacttattctcaaatgctatgtacttatttttagttccacttttaggggctgtttcagttcatctttctactgtttcagtggaagatttggtccttttatggaaccaattgaaattcaatcttgtttctgtgattttatgttctgctcttatggtgttcttggggacactttattttatgactaggcctaggaaggtttacttagttgatttcgcatgttacaagccgaaacccgaggctgtgtgcagtaaagaagtgttcgtggagagatcaaaaattgcagggacatttactgacgaaaatttggcctttcagaagaaaatcttggagaggtcaggtttggggcaaaagacgtacttccccgaagcccttctgcgagtcccagctaatccttgtatggctgaggcaaggaaggaggctgagatggttatgtttggtgcaattgatgatttgttggcgaaaaccaggattaaggctaaggatattgggattcttgtggtgaattgtagtttgtttaatccaacaccatcactttctgctatgattgtgaaccattacaagcttaggggaaatattttgagttataatcttggtggtatgggatgcagtgctggactaatatcgatcgatcttgcgaaacaacttttacaggtgaatcccaattcctatgctctggtagtgagcatggagaacataaccttgaattggtactggggcaacaaccgatcaatgcttgtctcgaattgcattttccggatgggaggagcagcgatcctactatcgaacaagtcatcagatcgtagaagagcaaaataccaactaacgcacacagttcgtacccacaaaggagctgatgataagagttatggttgtgtgtttcaagaagaagacgaatcgaaaaaattggcgtagcattgtcaaaagacctaatggctgttgctggagaggccttgaaaacaaatatcacaactttagggccattagtcctacccatgtctgaacaattattgttcttttttactcttgtggcaaaaaaggttttcaagatgaaaattaagccgtatataccagattttaagctcgcgttcgagcatttctgcattcacgctggaggaagagcggtgttggacgaactcgagaagaatctcgagcttacagaatggcatatggagccatcaagaatgacactttatagatttggtaacacttctagcagttcattgtggtatgaattggcctattctgaggctaaaggaaggattaaaaagggtgacaaaacatggcaaattgcctttggatcaggttttaaatgtaacagtgctgtgtggaaagcactgaggagtattaatccagccaaggagaagaatccatggatggatgaaattaatgatttccctactgaggttccaagaattgccaccattaattcttgaaaaaatattata

SEQ ID NO: 9136 - DNA, 1722 bp, Amsonia hubrichtii
atctccatccatcaagattttttctttttcacattatactcatattgatagaagtttggttttgtgctgattctttcggttgaagatgggagatgagaagaggggagcatctgaaagtggaaaaatttctgtagagtctgagaggagaagtaataatctccctaattttctcctatcagttaggcttaaatatgttaagcttggataccattatttgatctctaatgctatgtatttgatgctgattcctcttttaggggttgtttcagttcatctttcgactgttacagttgaagatgtattcctgctatgggatcagcttaggttcaatcttgttacagtgattttgtgttctgctctaatggttttcctaggtaccctttactttatgactcggcctaggaaagtttatttagtggattttgcatgttacaagcctggacctgaatttatgtgttctaaagaacttttcatggagagatcaacacaagctgagactttcaatgatgaaaatttggcctttcagaagaaaattctggagaggtcaggtttaggtcagaagacatatttccctgaagcactcttgcaggtgccggcaaatccgtgcatggctgaggccaggaaggaggctgaaatggtcatgtttggtgccattgatcaactgttggaaaagactggcgtgaaagcaaaagatattgggattcttgtggtgaactgcagcttgttttgtccaaccccgtctctttctgctatgattgtgaaccattacaagcttcgaggcaatattttgagctacaaccttggtggcatggggtgcagtgctggactgatatcgatagatcttgccaagcaacttttacaggtgcagcccaactcgtatgcaatggtggtgagcatggagaacataaccctgaattggtactgggggaacaacagatcaatgctggtctcaaattgcatcttccgtatgggaggggctgcaattctgctatcaaacaagtcatctgaccgtcgtcgctcaaagtatcagctcattcacactgttcgtacccataagggtgcagatgacagaagttacggttgtgtattccaagaggaagatgaaaacaagaaaataggcgtggccttgtcgaaagatcttatggctgtcgctggagaggccttgaaaacaaatatcactacactcggaccattagttcttcctatgtctgagcagctcctattttttgtcaccttagttgccagaaaggtttttaacatgaagatcaaaccatatattccagatttcaagctcgcattcgagcatttctgcattcatgctggaggaagagcagtgttggatgagctagaaaagaaccttgatcttagtgaatggcaaatggaaccttcaagaatgacactttacaggtttggcaacacttccagcagttcattgtggtatgaactggcttattctgaggccaagggaagaataaggaagggtgaccggacgtggcagattgcatttggttcaggattcaaatgtaacagtgccgtgtggcgtgcactgaggaccattaatcccgcaaaagaaaaaagtccatggattgaagaaattgacgaattccctgtacaggtccctagagtggcaaccattggttcctgattcttctgtcaagagaaattgataatacaccctctcttttctactgtaaaactacactcctgctgtattattcatga

SEQ ID NO: 9137 - DNA, 2015 bp, Gossypium hirsutum
cttcttttttttccttcattttcttagcaaattcaacatcgaaaaataaactaccacttttgttcacctctttataccaaagttttgtttccttgattttcaacaccgttttcgatttgggtttttctttaagcttcaaattgagttggatttgtagctaaaaaaaagataagaaaatggcagaagagagtaagcaaagaaggaatgttaagcccgtaaaggttcaaacagcttcatcatcagaagaaagaagatcaaacaacaatctcccaaactttcttctttcagtaaggctaaaatatgtgaagcttggctactattacgttatctctaacgctatgtatttgatgttggtgcctctcctaggcattgcttcagttcatctttccacacttactatccaagattttgttcgactatgggaccaactcaagttcaatctcgtttcagtaaccctatgttccggtcttttagttttcttggccacactttacttcatgagccggccaaggaaagtttacttagtgaatttcgcttgttacaagcctgaagctgatcgtatttgcaccagggaaatcttcatggagagatctggtctcactggtagcttcaccggagagaacttagcctttcagaagaaaatcctggagaggtctgggttgggacaaaagacatacttgcctgaggcagtgatgcgtgtcccagccaacccttgcatggcagaagccaggaaggaggccgagacagtgatgtttggagctattgatgaactcttggacaaaactggtgttaaggcaaaggatatagggatccttgtggtgaattgtagcttgttcaatcctacaccatctctttctgccatggttgtcaacagatacaagcttaggggaaacattttgagttataatcttggtggaatggggtgcagtgctgggcttatttctatagaccttgctaaacagctgctgcgggtgcaccccaactcttatgccttagtggtaagcatggagaacattactctcaactggtactttggcaacgaccgatctatgctcctctcaaattgcctctttcgcatgggcggtgtcgcaatccttctctccaaccactcatctgatcgccaccgctccaaataccaactgattcacaccgtacgcacgcacaaaggtgccgatgacaaatgctacaactgcgtcttccaacgtgaggatgacaccaaaagaatcggcatttccctctcgaaagacctcatggctgtcgccggagaagcccttaaaaccaacatcaccactctggggccactagttcttcccatgtcggagcaactcttgtttttcgtcacgttagtggcaaggaaagtgttgaagatgaagatcaaaccctacatcccagatttcaagttggcattcgaacatttttgcattcatgcaggtgggagagccgtgctagatgagcttgaaaaaaaccttgaccttacagattggcacatggagccatcgagaatgacgctttatagatttgggaacacttcaagcagttctttgtggtatgaattagcttactctgaagccaaaggaagaatcagaagaggtgataggacatggcagattgctttcgggtcaggatttaagtgcaatagtgcagtttggaaggcattgaagaccatcaatccagctaaggagaaaagcccttggattgatgagattgatgagtttcctgttcatgtgcctggggtggcaaatattgcttcttcttataaatcctaattcttattaacaaggagattatcatttagtactgagtactatatatatatatggtttaatcattttatacgtggttaaggtgtgataatcaaattggttgttaatacccagttagaagggggaaaagggagaccattgtttcattttcattttttggtgttataaagtcaatttgattgatcaatgtatgtaaaatgcttttacacacaagaaatgcttgcttaattgttcaagaatttgttcaaaaaa

SEQ ID NO: 9138 - DNA, 1946 bp, Sesamum indicum
agggtcttgtggcccttgttggaccaatccaattcacacaacatcctctttaagttcttacaaccttttcccaccaattctaagtctttcttttctggccaacatcaataacttctgtccgaattcgtgcgttctgtcactctaattcttgctatccacattggatttctgctaacaatgggacacgaaaacgagcagaaacaacaacccgaaacgggcaagatttcggtcgagtcgacttcgtctgaaggtagaggggctaacaatctccccaacttcctccaatcagtcaggctcaaatacgtcaaactcggctaccactacttgatctcacatgctatgtacttgttcctagttcccttacttggtattctctccgttcatctctccaccatcaccacagacgatcttgtcctattatgggaccagctcaaattcaatctggtttcagttgtcatatgttccgccctcatcgtcttcttgggcacgctctacttcatgaccaggccaaggaaagtctacttggtcgactttgcgtgttacaagcctaagcccgaggttatgtgtagtaaagaaatgttcatggagaaatcgagggccgccgggattttcactccggagaatttggagtttcaaaagaggattttggagcgatcggggttaggacaaaagacatactttcctgaagcattaatgcgcgtgcctgccaacccatgcatggccgaggccagaaaggaggctgagatggtcatgttcggggcaatcgatgatttgttggcgaaaacgggcgtgaaggctaaggatattgggattcttgtcgtgaattgcagcttgtttaatccgacgccgtccctctcagctatgattgtgaaccattacaaacttaggggtaatattttgagctataatcttggagggatggggtgcagtgctggtttgatatcaattgatcttgccaaacagctcttgcaggtgaatcccaactcctacgccctagtagtgagcatggagaacatcaccctcaactggtacttcggcaacaaccgatcaatgctagtctccaactgcattttccgaatgggaggcgccgcaattctcctctccaacaagccatcagacagacgacgcgcaaaataccaactaatacacacagtccgaacccacaaaggtgccgatgacaagagctacggctgcgtgtttcaagaagaggacgacactaaaagagtcggcgtcgcgctctccaaagacctaatggccgtggccggagaggccttaaagaccaacatcacaacgctaggcccattagtccttcccatgtcggaacaattgctcttcttcgtcacattagttgcaagaaaagtgttcaagatgaagatcaagccatatataccggattttaagcttgcgttcgatcatttctgcattcatgcaggagggagggcagtgttggatgagttggagaagaatcttgagctgagcaagtggcacatggagccttcaagaatgacattgtacaggtttggtaacacatctagcagctcattgtggtatgagttggcgtatacggaggctaaagggcggattaggaagggggacaggacgtggcagattgcgttcgggtccggattcaagtgtaatagcgcagtatggagagcgttgaggcggatagatccagctaaggagaagaacccttggatggatgagattgatgagtttcctgtcgaggtgccaagagtggcaactcttgcttgatactatgttgacaaaggttgcgttttgctttcgtacaacgttgcaagaaaggtgtcacgagtgtgtaattgttggatggatccgtttcaatagtgtcaattcattcgtatgacgatgtggacaagatcagcagcatctggtccattgtaaaatgaatcgtttcagtgttctttttacaatggaccagatgctgc

SEQ ID NO: 9139 - DNA, 1592 bp, Prunus persica
aatttagtgttctgactgtgtaaaatggcggcacaggatcataaccaggaagggaagtcgaacttaggacctgaatcgtcgggagggcgtaaagctcttccgaactttcttttatcagtgaggctcaagtatgtcaaacttgggtaccactatttgatctctaatgccgtctacttcttactagtccctttgatggccgtagcgtcggcccatctctcaaccctaaccctcgaggactttgtccaattatggcaccaactcaagttcaactttgtgtcagtcactttgtgctcaggcctcttggttttcttaaccaccctctacttcaccacccgcccaagaaaagtttacttgatgaactttgcttgttacaagcccgagtatgcgatcacgtgcacacgtgagctgttcatggagaggtctaagctgacaggcagcttctctgatgagaacttggcttttcagcagaagattcttgagagggccgggctggggcagaaaacctacatgcccgaggccgtgatgcgggtcccgccgaacccgtgtatggccgaggcgaggaaggaggcggaaatggtgatgtttggtgccattgacgagttgctggagaagactggggtgaagcctaaggatattgggattttggtggtgaactgcagcttgttcaatccgacgccgtctttgtccgccatggtcgtgaatcactacaagcttagagggaatattgtgagctacaatcttggtgggatgggttgcagtgctgggctgatttctattgaccttgccaaacagcttctccaggtgcacccaaactcttatgccctagtggtaagcatggagaacatcaccctcaattggtacttcggcaatgaccgctcaatgcttctctccaactgcctcttccgattgggcggtgccgccatcctcctctccaaccgttcctctgaccgccgccgctcaaagtaccaactcatgcatactgtccgcacccataaaggttcagatgacaaagcatacagctgtgttttccaaagggaagatgacacaaaaagagtcggcgttgctctctcaaaagacttgatggctgttgctggagaagcccttaaaaccaacatcaccacacttggcccaatagtcctacccatgtcagagcaactcctcttctttgttactttggtggcaagaaaggtgttcaagatgaagaatatcaaaccctacatcccggatttcaagctggcgttcgaacacttctgcattcacgccggtgggagagcagtgctggatgagatggagaagaaccttgagctcagtgactggcacatggagccttcgagaatgacactttataggtttgggaacacttcaagcagctctttgtggtatgaactggcttactctgaggccaagggaagagtgaggaagggtgataggatgtggcagattgcgttcgggtcgggtttcaagtgtaacagtgctgtgtggaaggctttgaggactgttaatccagctaaagagaagaacccttggatagatgagattgatcaatttcctgttgatgtgcctaaagtggcaccatgcaaggcttcttaatg

SEQ ID NO: 9140 - DNA, 1908 bp, Gossypium hirsutum
caagcaactcattaactcattcatacattttccttcattttctcggcgaattcgaaaccgaaaacgcaagaaatttttcattttttcttgattcccagcaacttttcaatctgggttttgcttgaatattcatattaactttgttttataccaaaaaaaaaaatgacagaagcgagtaagaaaagcatgaatccagacccagttcatgttcaaagcacagcttcatcaaacgaaacaagatcaaacaacaatctccccaattttcttctttcagtgaggctaaaatacgtgaagctcggctaccattatttaatctccaacgccatgtatctaatgctggtgccgttattagccattgcttcagctcatctctcaacgctcacggtccttgatttggttcaactatgggaccaactcaagttcaatcttgtctctgttactttatgttcaggccttttggtttttttagccaccctttacttcatgagccgtccccggaaagtttatttggtggatttcgcttgttataagccggagcctgaacggacttgtaccagagagattttcatggagagatcgaatcttactggaagtttcactgaagagaacttggcttttcaaaagaagatactggagaggtctggtttagggcaaaagacgtatttgcctgaggcggtgttgcgtgtaccgccgaacccttgtatggcggaggcaaggaaagaagcggaggcagtgatgtttggtgccattgatgagctgttggagaagactggtgttaaggctaaggatatcggtatccttgtggtgaattgtagcttgtttaaccctacaccgtcgctttccgccatgattgttaatagatataagcttagaggcaatattttgagctataatcttggtggaatgggttgcagtgctgggctgatttctattgaccttgctaaacaaatgctacaggtacatcctaactcttatgccttggtggtgagcatggagaacattactctcaactggtacttcggcaacgaccgatccatgctagtctctaactgcttgttccgtatgggcggtgccgcgatccttctatcaaaccggtcatccgatcgccgccgctccaagtaccaactcatccacaccgtacgaacccacaaaggagccgacgacaaatgctacaactgcgtcttccaacgtgaggacgacaccaaacggatcggcgtttccctttccaaagacctcatgacggtcgccggcgaagccctcaaaaccaacatcaccaccctcggtccattagtcctccccatgtccgaacaactcctctttttcatcactttagtagccagaaaagtcttcaaaatgaaaatcaggccgtacatcccggatttcaaactagctttcgagcatttttgcatccatgcaggtgggagagccgtgttagatgagctagaaaagaaccttgagctctcagattggcacatggaaccatcgaggatgacactttacaggttcggtaacacgtcgagcagttctttatggtacgaactagcttactcggaagccaaaggaaggatccgaaaaggtgatcggacatggcagattgcattcgggtcagggtttaaatgcaacagtgctgtatggaaagcactgaagaccattaatccagcaaaggagaagagtccatggattgatgaaattgatgaatatcctgtttatgtgcctaaggtggccactgtttcttcttcttcttcttcccagaaagccatataattttcatcaaaggaagacagtagagagaaagagaggacataattagtgattattagaactatgatttattttttatttttttacatgtttacttgtgtgttgatttgaagattaatttattccaagttgaagatatatatatat

SEQ ID NO: 9141 - DNA, 2194 bp, Aquilegia formosa
tgtcacttgtccacctttatagcaaaattccttgtttctttctttcattcattttctttcttcttctgagtacttgatcacaaagctctttttatcagactacttttctttcaacatttacacaactttagctttgtgatcaattcatttcttcttttgctattagtttttgaagcacttcatcttaagaaattattattttcattacagatttgtcctctcccctgttctctaaaagattttcaccaacataaatagacttcaataagtcacaatcttcccaaattgtgcagttcactagacctccaatttctttttcaagttcattgaacttctcccttgtttagaaccaagtttaaaactcttgtatgaaatatggaggacaagaaacaaaagcaagacactaactcagtttcagtccatgttccatcaagtagtgccaagaagaagcttcctgacttcctccaatctgtgaagctcaaatatgtgaagcttgggtaccattatttgatcactcatgccatgtacctcttgctcatccctatccttgctattgcttctgctcgtatctcattgctttccattgacgatgtaactgagctatggaaccaacttaggttcaatcttgtctcagtaatcatatgttctgctctcttagtatttgtagccaccctttatttcatgtcacgccctcggaagatctacttacttgattttgcttgttataagcctgaaccagaacgaacatgcacgagagagatcttcatggagcggtcaacaatcacaggaagttttactgaagagaacttagcattccaacaaaagattttggagaggtctggactgggacaatcaacatacttgcctgaggcagtattacaagtgccaccaaatccatgtatggccgaggccaggaaggaggctgaggtggtgatgttcggtgcagttgatgagctattggctaagactggggtaaaggcaaaggatataggaattttagttgtgaattgcagtcttttcaatcctacaccatctctctcagccatgcttgtgaatcactacaagcttagaggaaatattgtgagctacaaccttggaggtatgggttgcagtgctggacttatctccatagaccttgcaaagcagctactccaggtgcaccccaactcatatgctttagtagtgagcatggagaacatcacactcaactggtacttcggcaacaatcgctcaatgcttgtttctaactgcctctttcgtatgggtggcgccgccattctcctctcaaatcgctccactgatcgtcgtagatccaagtaccaacttatccacactgtacgcacccacaagggcgctgacaacagttccttcaattgtgtgtaccaagaagaagatgacactggaagagtgggagttgccctttcaaaaaacctaatggctgtagccggggaggctcttaaaaccaatattaccacgctgggacctattgttcttcccatgtccgagcaactcctcttttttgcaactttggtagcaagaaaggtcctgaaaatgaaaattaaaccgtacatcccagattttaaactcgccttcgaacacttctgcattcatgcaggtggaagagcagttttggatgaactggagaagaacttggagctcactgactggcacatggaaccatcaaggatgacactttacagatttgggaacacatctagtagttcattgtggtatgaactagcatattctgaggccaaagggaggatcaagagaggggataggacatggcagattgcatttggttccgggttcaagtgcaacagcgcagtatggcgagcgcttaaaaccatcaatcctgctaaagaaaagaatccttggatgagtgagattgatcagtttcctgttcatgtgcctaaggtgtcatcagtcatctcaaacaattagataccatgattaagttagtcatttcttctgtttttgtttgtataaattttctaactgggatcatttgaaatctggtcctagtactgaacatttacacacaatttaacagattaaatgtcatattagattagggccttatacttgcaccctttttccgatcttcttatgcttattgttggatatataattgtgtgattcatatgttatcatttgtattgatatttacatgttgattaataaagttgtttct

SEQ ID NO: 9142 - DNA, 1696 bp, Platanus occidentalis
tagttattttcctacaagggcttcacaagtaatccaaggtttcttgtgttaagaattagtgcatttttttaccatttcaaaacaatggaggaaactagacaatacccagaatcagaaacggtatctctccaagttccccagagaagtaggaacaagcttcctgatttcctactctctgtgaagctcaaatatgtgaagctaggataccattacgtgatctccaatgccatgtatctcatactcactcccctcctagttatagtctcagcccatctctccactgtcagctgtgacgattttcttgagttatggaaccacctcaagttcaatcttgtttctgttgtcatatgttcagccctcctggttttcctagccaccctctacttcatgactcgcccacgaaaggtctacctagtcgatttcgcttgctataaggctgacccttctcaaatctgcacccgagagaggttcatggatctgtcacggctcgcgaagaccttcacagaggagaacttggcctttcagaagaagctcgcggagcggtcgggattgggacagtctacgtacttcccggaggcagtgttgagggtgccgccgaacccatgtatggcggaggcgagaaaagaagcggagactgtgatgtttggtgccatcgaccagctcttggccaagactggcgtgaaggctaaggatattgggattttagtggtgaattgcagcctttttaatccgacgccgtccctctcggccatgattgttaatcactacaagcttagagggaatgttttgagttacaatttgggtgggatgggttgcagtgctggtcttatctctatagaccttgctaagaagcttctccaggtggagcccaactcctacgctctagtagttagcatggagaacatcacccaaaactggtactggggcaacaatcgctccatgctcctctgcaactgcctctttcgcatgggcggcgccgccatcctcctctccaaccgcccggctgatcgccgccgctccaagtaccagctcatccacaccgtccgaacccacaaaggcgccgacgaccgctgctacaaatgcgtctaccaagaagaagacgacactggaagagtcggcgtcgccctctccaaggacctcatggccgtcgccggcgaagccctgaaggcgaacatcaccactctcggtcctctagttctcccaatgtccgagcaactcctcttcttcgccaccctcgtcggaagacaggtcttcaagatgaagatcaagccttacatccccgatttcaagctcgcgttcgaacacttctgcattcacgcaggtgggcgggcagttttggatgagctagagaagaaccttcagctcagcgagtggcacatggagccttcaaggatgacactttacaggttcgggaacacctctagtagttccttgtggtacgagcttgcttactctgaggccaaggggagaatcaagaagggtgatcggacatggcagattgcatttgggtcgggtttcaagtgcaacagcgcagtttggagggcattgaggacaattgatccagccaaggagaagaatccttggataggtgagattgacgggttccctgttccagtgcccaaaatatcaccaattacgtcttaaaatgaaccctttacagtgtaatttgttacggcatagtcaaagtttctttagt

SEQ ID NO: 9143 - DNA, 1808 bp, Catharanthus roseus
ttctttcacattctatcaatacatacacaaaaaggtgtttgtgatattctctagcttaaaaaaataaaaatatggcagatggggagagggcagcagcctctgatcaaactggaagaatttctgttgattcttctgatcagaggagaaataatctccctaattttctcctatcagttaggctcaaatatgtgaaacttgggtaccattatttaatctctcatgctatgtatttgatgctaattcctcttttaggggttgtttcagttcatatttccactcttactgttgaagatattgtcctttttatggaatcagctcaggttcaatcttgttactgtcattttgtgttctactctgatggttttcttgggtaccctttattttatgacaaggcctagaaaggtttatttagttgatttttcatgttacaaaccgaatcctgaattcatgtgtcctaaagaacttttcatggaaagatcacaccaagcagagacttttagtgatgaaaacttggcttttcaaaaaaagattttagagaggtcaggtttaggccagaagacatatttccctggtgctctgttacaggtaccggcgaatccttgtatggctgaggctaggaaagaggctgaaatggttatgtttggtgccattgatcaattgttggaaaaaactggtgttaaggcaaaggacattgggattcttgtggtgaattgcagtttgttttgtccaacaccttctctttctgctatgattgtgaatcattacaaacttagaggcaatattttgagctataatcttggtggtatgggttgcagtgctggacttatttcaatagatcttgctaaacagcttttacaggttcatcccaactcatatgcactggtggtgagcatggagaacataacattgaactggtactttgggaacaacagatcaatgctggtctcaaattgcatcttccgtatgggaggagctgcaattcttctatcgaacaaatcatcagaccgtcgtcgttctaagtatcagctcatccacacagttcgtacccacaagggtgcagatgacagaagttatggctgtgtattccaagaagaagacgagaacaagaaaatcggagtagccttatcgaaagatctcatggcagtagcaggagaagccttaaaaacaaacataacaacattaggaccattagtccttccaatgtctgaacaactcctattcttaatcacattagttgcaagaaaggtttttaacatgaaaatcaagccatatattccagatttcaagcttgcgttcgagcatttttgcattcatgctggaggaagagcagttcttgatgagttggaaaagaatcttgatcttagtgaatggcatatggaaccatcaagaatgacactttatagatttggtaacacttctagcagttcattgtggtatgaattggcttattctgaagctaagggaagaataaggaaaggtgataggacatggcagattgcatttggttcaggattcaaatgtaacagtgctgtttggaaggcattgaggactattaatccagcaaagaaaagaatccatggattgatgaaattgatgatttccctgtacaggttccgagagtagttaccattggttcttgaaaaacaaaatgctctccattaattcttctgtcaaagaaaaattgattatacaccctgttccccccccccccccccccctcgttaaattctacccctgttgtattctattttgatgattttacaacaatcatcataacggattataagattgctgaaatattcattcaa

SEQ ID NO: 9144 - DNA, 1895 bp, Nicotiana benthamiana
actaagtcttttccctctcaacaaatctctctttctatctaccattcttccctagttttttcaaaactcattatcttttctcactttgggtataatttctttgttttcatttgaagaaaaaaaaaccaagaaaatcccttatttcacttgttattgttgattgatttgtggggttggttccaattcttgtgaatatattttatatacaatgggagatgaatcaaatggaaaagtttcaattgaagctcaagaaagatgtagtaataataataaacttcctaattttcttctatcagttaagctcaaatatgtaaaacttggctatcattatttgattagccatgttatgtatttgtgtcttgctccaattttaggtgctgtttttgttcatctttctacacttactgtagaagaagttgtccaattatggtaccaactcaaattcaatcttgtcacagttattttatgctcagctcttatggttttcttggctacactttattttatgactaggccaagaaaagtgtacctagtcgatttttcgtgttacaaacctaaaccagatgttatgtgtcctaaggaattatttatggaaagatcaaaacaagctggaatttttactgatgaaaatttggcatttcagaaaaaaatattggagaggtcaggtttaggtcaaaagacatattttccagaagcacttttaaaagtaccaccaaatccttgtatggctgaggcaagaaaagaagctgaaatggttatgtttggtgcaattgatgaattgttggaaaaaactggtgttaaggctaaagatattgggattcttgtggtgaactgtagcttgtttaatccaactccttcactttctgcaatgattgttaatcattataagcttagaggaaatattatgagttataatcttgggggtatgggctgtagtgctggattaatttcaattgaccttgccaagcagatgctacaggtgcatcctaactcttatgccctagtagtcagtatggaaaacataacactcaattggtactttggcaacaacagatcaatgcttgtttcaaattgcattttcagaatgggtggtgctgcaattttactatcaaataaatcctcagatcgtcgtcgttcaaaataccaactcattcacacagtacgtacccacaaaggtgcagatgacaaaagctatagttgtgtgtttcaagaagaagatgacaacaaaaaaattggtgtagcattgtccaaagacctaatggctgtagcaggagaagccttgaaaaccaacatcacaactcttgggccaatagtccttcctatgtccgaacaacttctatttttcatcacattagtcgcgagaaaagttttcaagatgaaaattaaaccctatataccagattttaagttggcgttcgagcatttctgtattcatgcaggtggaagggcggtgttggacgagttagagaagaatctcgagttaagtcaatggcatatggaaccctcaagaatgacattatataggtttggaaatacatcaagtagttcattgtggtatgaattggcatatactgaggctaaagggaggattaagaaaggagatagaacatggcaaattgcatttggatcaggttttaaatgtaacagtgctgtgtggtgtgcacttaggacaattaatcctgccaaggagaagaacccttggatggatgagattaatgaattcccagttcaagtacctagagttgtaacaattaatgattcctaaagtatgaatagttggaagcaattattatgtgatcattgtaatattacctttgttgttattattactaggtggatatgtactttgattatgctttaagaaagcaatacaatcacttctgttttagctaatg

SEQ ID NO: 9145 - DNA, 2211 bp, Solanum phureja
tatttcatctaaaaatcaatttttttcacttggatctctcttatttcatctaaaagtcaaattttttcactcgggtatttcttatttcatttaaaaatcagttctttctatttgggtacctcttatttcatttaaaaattagttcttttcactcgggtatctcttatttcacctaaaagttcattttttcacttgggtatatcttatttcatctaaaattccattcttttcacttgggtatctcttatttcatctaaaaagttcattttttcacttgggtatctcttatttcatctaaaagttcatttttttcactcgggtacctcttatttcatctaaaaaatcatttttttcactgggctacatcttatttcatctaaaaatcaattcttttcactcggtttcatctaaaaaacagttctttacactcgggtatctcttatttcatcaagaaaacttctcattttctcttatctaagttcattgaattgagggtcaagctcagtttaaacaatgggggatgagaacaacaagaattcagttagctctgaaaccgcgcgaatttcggttgaagttaacaatcttcctaattttcttcaatcaatcaggctcaaatatgtcaaacttggttaccactatttgatcagcaatgctatgtatctgtttttggttcctgttttggggttactttgtgttcatgttatgactatttcagtagatgacttaatccaattattggataaattgaagttcaatcttgttacagtgattttgtgttctgctcttgttgtttttttggggacactttatttcatgacaaggcctagaaaagtgtatttggttgatttttcatgttataagcctaagcctgatgttatgtgtagtaaagaagttttcatggagagatcaaaacaagccggggttttcactgaggagaatttggcctttcagaagaagatattagagaggtcgggtttagggcaaaagacatattttcctgaggcacttttgagagtgcccgcggaacctaacatggctgaggcaagaaaagaggctgagatggtgatgtttggtgctatagatgagttgttggcgaaaaccggggtgaaggctaaggatattgggatacttgtggtgaattgtagcttgtttaatccaacaccatcactttctgctatgattgttaaccattacaagctcaggggaaatgttatgagttataatcttggtggaatgggatgtagtgctggactcatttctattgatcttgccaaacaactattgcaggtgaatcctaattcttatgcacttgtagtgagtatggaaaacataacactcaattggtactttggcaacaatagatcaatgcttgtctcaaattgcatattcaggatgggaggtgctgcaattcttctgtcaaacagatcatcagatcgtcgacgttccaagtaccaactcatccatacagtacgtacacacaagggcgcggatgacaggagctatggttgtgtgttccaggaggaggacgagaagaaggagatcggtgttgccttatcgaaggacctaatggctgttgcaggggaagcactaaaaactaacatcacaactctcgggccattagtccttcctatgtctgagcaactccttttcttcatgacattagtcgcgaggaagatctttaagatgaaaatcaagccttacatacctgatttcaagctggcattcgagcatttctgtatacacgctggtggaagggctgtactggatgagctcgagaagaatctcgagctcagccagtggcatatggagccatcaagaatgacactttacaggtttggtaacacatcaagcagctctttatggtatgaattggcttatactgaagctaaagggaggatcaagaaaggagacaggacatggcaaattgcatttggttctggatttaaatgtaacagtgccgtgtggcgcgcgttgaagacgattaatcctgctaaagagaagaatccatggatggatgaggttcatgaattcccagttgaagtacctagaatggtcacaattaatgattcttgaaaaataatttttaattttcctccagtaaaagttatgtagtagtattatcattctttgttaccttaaggattgcaatgtacaatgtaatttgatttgattatttatataaaagtgataccaaatattctattttctagc

SEQ ID NO: 9146 - DNA, 1772 bp, Petunia hybrida
atcggccgagggatcatttgtggggttgattccaaatattattgtgtatattttataatgggagatgaatcaacacgaagagtttcagttgagactaatagtactacacatgaaagaagtaacaaacttcctaatttcctcctgtcagttaggctcaaatatgtgaaacttggctaccattatttgatcagccatgctatgtatttgtgtcttgttccacttttaggtgttgtttctgttcatctttcagcaattactgtggaagatgttgtccaattatgggaccaactcaaatttaatcttgtcacagttattttatgctcagctctcatggttttcttggctacactttattttatgactaggccaagaaaagtatacctagtcgatttttcgtgttacaagcctcaatcagatgttatgtgtcctaaggaattatttatggaaagatcaaaacaagctgggatttttactgatgaaaatttggcctttcaaaagaaaatattggagaggtcaggtttaggtcaaaagacatattttccagaagcactattgaaagttccaccaaatccttctatggctgaagcaagaaaagaagctgaaatggttatgtttggtgcaattgatgaattattggcaaaaactggtgtgaaggctaaggatattgggattcttgtggtgaattgcagcttgtttaatccaactccatcactttctgctatgattgtcaatcactataagcttagaggcaatatcatgagttacaaccttggtggtatgggctgtagtgctggattaatttcaattgaccttgccaagcagatgctacaggtgaatcctaactcttatgcactagtagtgagcatggagaacataacactcaattggtactttggaaaaaatagatcatgcttgtttcaattgcatcttcagaatgggcgtgctgcattttactgtcaaataaatcatcggatcgccgtcgttccaagtatcaactcatccacacagtacgtacacacaagggtgcagatgacagaagctatggttgtgtgtttcaagaagaagatgagaacaaaaaagttggtgtagcattgtccaaagatttaatggctgttgcaggggaagccttaaaaacgaacattacaactctcgggccaatagtcctccctatgtccgaacaactgctattttttgtcacactagtcgcgagaaaggtgttcaagatgaaaattaaaccatatatcccagattttaaattagcattcgagcatttttgcattcatgctggtggaagagcagtattggatgagttagagaagaatcttgaacttagtccatggcatatggagccatcaagaatgacactttataggtttgggaatacttcaagtagttcattgtggtatgaattggcatatacagaagctaaaggaaggatcagaaaggagatagaacatggcaaattgcatttggatcaggttttaaatgtaacagtgctgtgtggcgtgcacttaggactattaatcctgctaaggagaagaatccttggatggatgagatttctgaattcccagttcaagtacctagaattgtaactattaatgattcttgaacaatgatttttatatgtccctatccccaaaaccaaccccaaggaagactaaagttattatgtgatcactgttctattacctttcttattactaggtgactatgtactttgattatgattttagatcaaagcaatacaatgacttctatttctctaatgc

SEQ ID NO: 9147 - DNA, 1881 bp, Panax ginseng
aagcagtggtatcaacgcagagtacatggggacctctttctttcaattttcttgaacactctgttattcctagtcgtaagccaaatttatactaatttaggaccccatttcttctttttttccccttcttggtcctaatataaagaatttgaattgttagctagtggttattgacaaaaatggtcgatgaaaagaagctaaacccggaaacccaaccggtttcagttgaaaatagaaataacacaacccttcccaattttctattatctgttaaactcaagtatgtgaaacttggttatcattacttaatttcccatgccatgtacctattgctcatacctttactaggtgttttttctgctcatctttcgacatttagtgttcaagattttgtcgaaatatggaaccaactcaagttcaactcattgacagttatcatatgttctgccttgatgatttttttagtgaccctttactatatgaggcttcccaaaaaggtttatctagtcgatttcgcttgttacaagcctgaaccggagcggatgtgcactaaagaacttttcatggaaaggtcagcacaattcgggagttttagtgaagagaatttggcatttcaaaagaagattttggagaggtcagggctggggcaaaagacttattttccggaggcagtgatgcaggtgccaccgaatatttgtatggccgaggcgagaaaagaggctgagatggtgatgtttggtgccattgatgagctgttggcgaaaaccagggtgaaggctaaggatattgggattcttattgtgaattgcagcttgtttaatcctacgccgtctctttctgctatggttgtaaatcattacaagcttagggggaacattttgagctataatcttggtggtatgggctgcagtgctggcctaatttcaatagaccttgccaagcaacttttgcaggtgcaaccaaactcctatgccctagtggtaagcatggaaaatataacactgaactggtactttggcaacaaccgttctatgctcgtctcaaactgcctcttccgcgtgggtggagcagcaattctcctttcaaacaaatcatctgatcgtggtcgctccaaataccaactcatccataccgttcgtacccacaaaggcgctgacgatagaagttacagctgtgtgttccaagaagaagaccaagacaagaaaataggggtggcgctctcaaaagacctaatggctgtggcaggggaggccttaaaaacaaacattacaaccctcgggccattagtccttcccatgtccgagcaactcctatttttcttcactttagtcgcgaggaaagttttcaaaatgaaaattaagccgtatattccagactttaagctagcgtttgagcatttctgcatccatgctggtggaagggcggtgctagatgagctagaaaaaaatctcgagcttaaagagtggcatatggagccttcaagaatgactctgtatagatttggtaacacttctagtagttcattgtggtatgaattggcttattctgaggcaaaagggaggatccgaaaaggccatcggacatggcagattgcgttcggctcaggtttcaagtgtaacagtgcggtttggcgtgccatgaggactattaatcctgccaaggagaagaatccttggattgatgaaattgatgagtttccggttcatgtgccaagagtaacacaaattggttcttgaacgtacattttttattttcttaggggatttagtgataatataaaactcatgattgtgtggtatgtgatcatttaggagaagtcataaaaggcaatttcctacatgtacgttttctgtctactacacacacacacacacacacaca

SEQ ID NO: 9148 - DNA, 2026 bp, Eucalyptus grandis
ctctctctctccgtgccatttccctccgtttgcttttgaaacaccgagttctcgtccttcgttactcttcaggaaacccctctgaagaagacacgagaaccccccgaaactgcaaaaatcttgtcttctctgcagaaatggccgaccaacaagaacagatcagtcgacaaaacccagatcagacagtccccgtgtccgtcgagcctcgaagccaagactcggacagaccatcgaagcacagcctcccgaacttcctcttgtcggtgaagctcaagtacgtgaagctcggttaccactacctcatctccaaagctctgtatctactcctcgtgccactcctcggcatctcctcggttcacctctcaaccctcacggctcgagacctggcccagctctgggaccaactcaggttcaatctcgtcaccgtcgtcgtctgctcgaccctgatggtgtttctggtcactctctacttcatgacccgacccaggaaagtctacctcgtagacttcgcctgctacaagcccgacccggcccggatatgcacccgcgagaccttcatggagtgctcggagctcacgaaggccttcaccgaggagaacctcgctttccagcggcggatcctcgagcggtctggcctcgggcagcggacgtacctgcccgaggcggtgctacaggtcccaccgaacccgtgcatggcagaagcgcgggcggaggctgagaccgtcatgttcggggccgtcgaccagctgctggccaagactggggtcaaggccaaggacatagggatcctcgtcgtgaactgcagcttgttcaacccaacgccatcattgtcggcgatgatcgtaaaccactacaagctcagagggaatgtattgagctacaatcttggtgggatgggctgcagtgctggattgatttctatcgaccttgctaagcagttgttacaggtacaccctaactcttatgccctagtggtgagcatggagaatatcaccctcaactggtacttcggtaatgaccggtcgatgctcgtctcaaactgcctcttccggatgggcggcgcagcaatcctcctctccaaccggtcctcagaccgccgccgctccaagtaccagctcatccacaccgtgcgcacccacaaaggctcagatgacaagagctacagctgcgtgttccaacgagaggacgacaagaagaagatcggcgtgtcgctctccaaggacttgatggcggttgctggggaagccttgaagaccaacatcacgaccctcggcccgttagtgctcccaatgtcggagcagctcttgttcttcatgactttggtcgcaaggaaggtgttaaagatgaagattaggccatacattcctgacttcaagctggccttcgagcatttttgcatccacgctggaggccgagctgttctcgacgagatagagaagaacctcgagctctccgattggcacatggagccatcacgaatgactctataccgattcgggaacacgtcgagtagctcattgtggtatgaattggcctattcggaggccaaaggaaggattaggaaaggtgacaggacatggcagattgcttttgggtccggattcaagtgcaatagcgcggtttggcaggcgttgaggaccgtcgacccagcgaaggaaaagaacccatggatggatgatattcacgagttccctgtccatgttccgaaagcggtgtccattggatctaccacaaaataagtgcatcgctcgggacgttgccaatataggcgaggttgattttgaaggatatgcagaaccttaattctccttttaacttgtgttcaagcgcaagcatcatcccaaatctactcgatattaaacttttcttctcctggaatcgattcctggaagaagtgtgcatttagctttgtaattgtccatatgaccggtcaaagcaggttttctatagctggattaattgaagaaactattgtgaagtacacctataatgaaaaattaatttgagacttcgaactttatattcc

SEQ ID NO: 9149 - DNA, 1871 bp, Nicotiana benthamiana
taatttttcaaaactcattatcttttctcacttgggtatctgtagctttcatttgaagaaaaaaaatccaagaaattaaatcccttatttcacttgttattgttgattgatttgtggggttggtttcaattcttgtgaatatattatacatacaatgggagatgaaccaaatggaaaagtttcaattgaggctcaagaaagaagtagttataataacaaacttcctaattttctcctatcagttaagctcaaatatgtaaaacttggctaccattatttgattagccatgttatgtatttgtgtcttgctccaattttaggtgctgtttttgttcatctttctacccttactgtagaagatgttgtccaattatggaaccaactcaaattcaatcttgttacagttattttatgctcagctcttatggttttcttggctacactttattttatgaccaggccaagaaaagtgtacctagtcgatttttcgtgttataaacctaaaccagatgttatgtgtcctaaagaattatttatggaaagatcaaaacaagctggaatttttactgatgaaaatttggcatttcagaaaaaaatagttgaaaggtcaggtttaggtcaaaagacatattttccagaatcactattgaaattaccaccgaatccttgtatggctgaggcaagaaaagaagctgaaatggttatgtttggtgcaattgatgaattgttagagaaaactggtgttaaggctaaggatattgggattcttgtggtgaattgtagtttgtttaatccaactccatcactttctgctatgattgttaatcattataagcttagaggaaatattatgagttataatcttggtggtatgggctgtagtgctggattaatttcaattgaccttgccaagcagatgctacaggtaaatcccaactcttatgcactagtagtcagtatggaaaacataacactcaattggtactttggcaacaacagatcaatgctagtctcaaattgcattttcagaatgggtggtgctgcaattttactatcaaataaatcatcagatcgtcgtcgttcaaaatatcaactcattcacacagtacgtacacacaaaggtgctgatgacaaaagctatagttgtgtatttcaagaagaagatgacaacaaaaaaattggtgtagcattgtcaaaagacctaatggctgtagcaggagaagccttaaaaacaaacatcacaactctcgggccaatagtcctccctatgtcagaacaactactatttttcatcacattagtcgcgagaaaagttttcaagatgaaaataaaaccgtatataccagattttaagttagcgttcgagcatttctgtattcatgcaggtggaagggcggtgttggacgaattagagaagaatcttgaattgagtcaatggcatatggaaccctcaagaatgacattatataggtttggaaatacttcaagtagttcattgtggtatgaattggcatatactgaagctaaaggaaggattaagaaaggagatagaacatggcaaattgcatttggatcaggttttaaatgtaacagtgcagtgtggtgtgcacttaggacaattaatcctgctaaggagaagaatccttggatggatgagattgatgaattcccagttcaagtacctagagttgtaacaattaatgattcctaaagtatgatatttgggaaggaattatgtgatcaattgtaatattacctttgttattattattacttggtggatatgtactttgattatgctttaagaaagcaatacaattacttctgttttagctagtgtacattgctatgtttttcgattttttttgttg

SEQ ID NO: 9150 - DNA, 1710 bp, Nicotiana benthamiana
atcaatttttctcacttgggaatcttttattttcgtctaaaatccccccaaaaaaaattttacttctcttctcaaagtgtattgatttgagggtacgtatctatttcgattcttgattattttaacgatgggggatgagaaaaacaagaatcttgtgaattctgaagcaggacgagtttcgattgaggctaaaaatgaaaaaagaaataacaatcttcctaattttcttctatcagttaggctcaaatatgtgaaacttggttatcattatttgattagcaatgctatgtatgtgtgtttagtacccattttaggggtactttcagttcatcttatgactatttctgtggaagatttactccaattatgggataagttgaaattcaatcttgtcacggtaattttttgctctgctctagtggtatttttaggtacactttattttatgacaaggcctaggaaagtgtacttagtggatttttcatgttacaagcctgagccaaaagttatgtgtcctaaggaaatttttatggagaggtcaaaacaagccgggattttcactaaggaaaatttagcgtttcaaaagaagatactagagagatcaggattgggacaaaagacatattttccggaggcgcttatgagagtgcctgcagagcctaatatggtcgaggcgaggaaagaagctgaaatggtgatgtttggtgctattgatgaattattggcgaaaaccggtgtaaaggctaaggatattgggattcttgttgtgaattgcagtttgtttaatccaactccttcactttctgctatgattgttaaccattacaagatgagaggaaatgttatgagctataatcttggtggtatgggctgtagtgctggacttatttctattgaccttgccaaacaactattacaggtcaatcctaattcctatgcactggtagtgagtatggaaaacataacactcaattggtactttggcaacaatagatcaatgcttgtctcaaattgcatattcagaatgggaggtgcagcgattctgctatcaaacagatcatcagatcgtcgtcgttcaaaataccaactcattcacacagtacgtacacacaaaggcgcagatgacaggagctatggctgcgttttccaggaggaggacgagaataaggaggtcggtgttgccctatcgaaggacctaatggccgttgcaggggaagcgttaaaaaccaacatcactaccctcgggccattagtccttcctatgtccgagcaactcctgtttttcatgacattagtcacgagaaaaatctttaagatgaaaatcaagccttatatacctgatttcaagttggccttcgagcatttctgtattcatgctggtggaagagccgtgctggatgagctcgagaagaatctcgagctcagccagtggcatatggagccatcaagaatgacactttataggtttggtaatacttcaagtagttctttgtggtatgaattggcttattctgaagctaaagggagaataagaaagggagatagaacatggcaaattgcatttggctcaggatttaagtgtaatagtgctgtttggcaagctttgaggactattaatcctgctaaagagaagaatccttggatggatgaaattgatgatttcccagttgaagttccaagaattgtgacaattggttgattcttgaaaat

SEQ ID NO: 9151 - DNA, 2049 bp, Vinca minor
tctttcacattacataaaaaagattgaatctttaaggttccaaatgggagatgagaaaagggttccctctgaaactggaaaaatttcagttgaatcttctcagaggagaagcaataataataataataataatctcccaaattttctttcatcagttaggctcaaatatgtgaaacttgggtaccattatttgatctcacacgccatgtatttgatgttagtccctcttttaggggttgtttcagttcatctttcgaccgttacggttgaagatgtagtcatattatgggatcagcttaggttcaatctttttactgtgattttgtgctctgctttaatggtttttttgggtaccctttactttatgactaggcctaggaaagtttatttagttgattttgcttgttataagcctggacctgaatttaagtgttctaaagaacttttcatggagagatcaaaccaagctgagactttcaatgatgaaaatttagcctttcaaaagaagattttggagaggtctggtttaggtcaggatacatattttcctgaagcattgttgcaggtgccggcgaatccgtgtatggctgaggcaaggaaagaggctgaaatgatcatgtttggtgctattgatcaattgttggaaaagactggtgtgaaagctaaggatattgggattcttgtggtgaattgtagtttgttctgtccaacgccatctctttctgctatgattgttaaccattacaaacttagaggcaatattttgagctataaccttggtggtatgggttgcagtgttggactcatctcaattgatcttgccaaacaacttttacaggttcatcccaactcgtatgcattggtggtgagcatggagaacataaccttgaactggtactttgggaacaaccgatcaatgctggtctcaaattgcatcttccgtatgggaggagctgcgattcttctatcaaacaaatcatcagaccgtcgtcgctcaaagtatcaattaattcacactgttcgtactcacaagggtgctgatgatagaagttatggttgtgtattccaagaggaagacgagaacaaggaaatcggggtggccttatcaaaagaccttatggctgttgcaggagaggccttaaaaacaaacataactactctcgggccattagttcttcccatgtccgagcaactccttttctttgtaacattagtagcaagaaaggtatttaacatgaaaatcaaaccatatattccagatttcaagctcgcgttcgagcatttctgcattcatgccggaggaagagcagttttggatgagctagagaagaatcttgaacttagtcaatggcacatggagccttcaagaatgacactttacagatttggcaacacttccagtagttcattgtggtacgaattggcttactcagaggccaaagggagaatccgaaagggcgatcggacatggcaaattgcatttggttctggattcaaatgtaacagtgctgtttggagggcattgaggaccattaatccagcaaaagaaaagaatccttggatggaggaaatatatgaatttcctgtacaggtccctagagtggcaaatattggttcttgatataattctcattcttagatctcaaaacaaattgattatacacttttttttggtaatgtaaaactctattcttggtgtgtagtttgatgatttagaagccatatgaaggcaaattgtcaagccttcatctaaactatgagaatttatcataacagatgtaaggttgtttatatatatttatctgatttaaattgaaaatccctgctttatctgtcaaatgtgcaattatatacttttatgaaattgcatattcttcgacttttgatcatatcttgattccaaggaagaaccaagtcttgatgattcaatttcaatgtaatttccattgaaaagaatccacattgccagtcaaggcctctagttcaagatcatgatgtgatgcaaagattaggtgcaatattccggaagcctaagaggacattggtcca

SEQ ID NO: 9152 - DNA, 1872 bp, Panax ginseng
aagcagtggtatcaacgcagagtacatggggataacccaaaaaaaaactccaaacaaattaagcatctcacaaattctacttacacacccctcaccccaactccttttattgcttctttccttctttttctcatctgggtttccaaaattatttcacagaaatggcgaatgaagaaaatcgaaacccggaatccgagacgatttccgtcgagaaaagaccgaaaaacgcccttccaaattttctcctatcggttaaactcaagtatgtgaaacttggttaccatcatttaatctccaatgccatgtacctattgctagtacctttactaggcattttttccgtccatatttccacatttaccgtccgagattttgtccaaatttggcaccacctcaagtttaatcttgtgacggttattatttgctctgctttaatggtctttttggtgacactttactacatgagccgtcccaaaaagatttacctagtcgatttctcgtgttacaagcccgacccggcccgaatgtgcacgaaggaacttttcatgcaaagatccacacaaaatgggagttttagtgaagagaatttggcatttcaaaaaaggattattgagaggtcgggattgggccagaaaacgtattttccggaggctgttttgcaggttcctccgaatatttgtatggccgaggcgagaaaagaggccgagatggttatgtttggtgccattgatgagttgctggggaaaaccggggttaaggccaaggatattgggattttgattgtgaattgtagcttgtttaatcccacgccgtcgctatcggctatggtggtgaatcactacaagctaaggggaaatattttgagctacaatcttggtggtatgggctgcagtgctggcttaatttcaatcgacttagccaaacaacttttgcaggtgcaaccaaactcgtatgccctagtggtgagcatggaaaacataacattgaactggtactttggcaacaatcggtcaatgctcgtctcaaattgcctcttccggatgggaggagctgcaattctcctctctaaccgatcctctgatcgtcggcgttcaaaatatcaactcatccacaccgttcgtacccacaagggagctgacgatagatgttacaactgcgtgttccaagaagaggacgaaaataaaaagattggcgtcgcgctctcaaaagacctaatggctgtggcaggggaggctttaaaaacaaacattacaaccctcgggccattagtccttcccatgtccgaacaacttttattttttgccacattagtcgctagaaaaattttcaaaatgaaaattaagccctatattccagattttaagctagcgttcgagcatttctgtatccatgccggtggaagggcggtgttagacgagctagagaaaaatcttgaactaacggattcgcatatggagccttcaagaatgactttgtataggtttggtaacacttctagtagctcattgtggtatgaattggcctattccgaggccaaggggaggatccggaaaggcgatcggacctggcagattgcgttcggctcgggtttcaagtgtaacagtgcggtttggcgtgccatcaggaccattaatccggctatggagaagaatccatggattgatgagattgatgagtttccggttcatgtgcctagagtcacacaaattggttcttgaacaaaaatattcatctctttagggggtgattcgtaattagtgtaaaacatgattgtatggtctgtctattttaggataaagtcatggaaaggtatttcctaaatgttttatgtctctagattgtgcaatgaaattttttacttgttgcagtaca

SEQ ID NO: 9153 - DNA, 1882 bp, Mimulus guttatus
cacacacatacttgatcatcatcatcatctaattcttgattgatttttttttttggtcgatcaagaatggggaacggtgacgatcgaaaaatcgaacccgaaacggggcgaatttcggtcgaaagaaaactcccgaatttcctccaatcgattaggctcaaatacgtgaaactcggttaccattacttgatctcaaacgctatgtacttactactaatccccttactagctatttcctcggttcatctctcgactctcacaacgcaagacctaaccctattgtgggaccaattgaagttcaacctcgtctcggttctcgtttgctccacgctaacggtcttcttgtgcacgttgtatttcatgacgaggcctaggaaaatttacctagtcgacttcgcgtgctacaagccgaagcccgacgtcatgtgtagcaaagaaatgttcatggaaaaatcgaggcaaaccggtatcttcacggcggagaatctggagttccagaagaagattctggaaaggtccggcctgggccagaagacctactttccagaagccctcatgcgggtcccggccgagcccaacatggccgaggcccgcaaggaggccgagttggtcatgttcggcgcgatcgacgatttgctggcgaagacgggggttaaggccaaggatatcgggatcctcgtggtgaattgtagcttgttcaatccgacgccgtctctttcggcgatggttgtgaatcattacaagcttagggggaatatcttgagctataatcttggtggcatgggttgtagtgctggtttgatctccattgatcttgccaaacagctcttgcaggtgcagcctaattcgttagccctagtagtaagcatggagaacataaccctgaactggtacttcggcaacaaccgctccatgctcgtatccaactgcatcttccgtatgggcggcgccgccatcctcctctccaacaaaccctccgacaagcgccgctccaagtaccagctcatacacaccgtccgcacgcaccgaggcgccgacgacaagagctacacgtgcgtcttccaggaagaagacgacacgaaacaggtcggcgtcgccctttcaaaggacctgatggccgtcgccggcgaagccctcaagacaaacatcaccaccctgggcccactcgtcctccccatgtcggaacagctcctcttcttcgtgacattggtcgcgaggaaagtgttcaagatgaagacgataaagccgtacataccggatttcaagctggcgttcgagcatttctgtatacacgccggcgggagggcggtgctggacgagttggagaagaatctcgaactcagtgagtggcatatggagccttctagaatgacgctgtacagatacgggaatacttcgagcagctctttgtggtatgagctggcgtacaccgaagctaaagggaggatccggaaaggggatcggacctggcagattgctttcgggtcgggttttaagtgtaacagtgcggtttggcgggctttgaaacgggtcgacccggctatggagaagaatccttggatggatgaggttcatgactttcctgttgaggtgcccagagttgccactatttcttgattctttacaaattaaattgtttttcttttttttaataattatatttcatgtgaattgtaatttaattttagtttttagttttttttttgaatggtttggttcttgatacattattttaaattctcggagattttgagggttctttgtatcatagtttaattttaaagaaaaaaaagttgttatgtttcagagatttaattgaagttgtttatatgaaacatggttatcgtaacgaaatatatcaacgttatcgttttcctccata

SEQ ID NO: 9154 - DNA, 1726 bp, Solanum lycopersicum
tatctcttctctactctaaaaatcaattcttttcactcggatatctcatatttcatctaaaaacagttctttacactcaagtatctcttatttcatcaagaaaacttctcattttctcttctctaacttcattgaatttgagagtcaagctcagtttaaacaatgggggatgagaacaagaagaattcagttagctctgaaaccgcgcgaatttcggttgaagttaacaatcttcctaattttcttcaatcaatcaggctcaaatatgtgaaacttggttaccattacttgatcagcaatgcaatgtatctgtttttggttcctgttttgggagttctttgtgttcatgttatgactatttcagttgaggacctgatccaattattggataaattgaagttcaatcttatcacagtgattttatgttctgctgttgttgtttttctggggacactttatttcatgacaaggcctagaaaagtgtatttggttgacttttcatgttataagcctaagcctgatgttatgtgtagtaaagaaactttcatggagagatcaaaacaagccgggattttcactgaggagaatttggcctttcagaagaagatactagaaaggtcgggtttaggtcaaaagacgtattttcctgaggcacttttgagagtgcccgcggaacctaacatggctgaggcaaggaaagaggctgagatggtgatgtttggtgctatcgatgagttgttggcgaaaactagggtgaaggctaaggatattgggatacttgtggtgaattgtagcttgtttaatccaacaccatcactttctgctatgattgttaaccattacaagctcaggggaaatgttatgagttataatcttggtggaatgggatgtagtgctggactcatttctattgatcttgctaaacaactattgcaggtgaatcctaattcttatgcacttgtggtgagtatggaaaacataacactcaattggtactttggcaacaacagatcaatgcttgtctcaaattgcatatttaggatgggaggtgctgcaattctgctgtcgaacagatcaacagatcgtcgacgttccaagtaccaactcatccatacagtacgtacacacaagggcgcggatgacaggagctatggttgtgtgttccaggaggaggacgagaagaaggagattggtgttgccttatcgaaggacctaatggctgttgcaggggaagcactaaaaactaacatcacaacgctcgggccattagttcttcctatgtctgagcaactccttttcttcatgacattagtcgcgaggaagatctttaagatgaaaatcaagccttacatacctgatttcaagctggcattcgagcatttctgtatacacgctggtggaagggcagtactggatgagctcgagaaaaatctcgagctcagccaatggcatatggagccatcaagaatgacactttacaggtttggtaacacatcaagtagctctttatggtatgaattggcttatactgaagctaaagggaggatcaagaaaggagacagaacatggcaaattgcatttggttctggatttaaatgtaacagtgctgtgtggcgcgcgttaaagacgattaatcctgctaaagagaagaatccatggatggatgaggttcatgaattcccagttgaagtacctagaattgtcacaattaatgattcttgaaaat

SEQ ID NO: 9155 - DNA, 1711 bp, Malus domestica
tgtaacatggcggtgcagaatcagaaccagggagagaaattgaacttgggacctgagtcagcaggaagtcgcaaacctgcgcttcctaactttcttttatcagtgaagctcaaatatgtcaagctagggtaccactacttaatctccaacgccctctacctcctactagtccctctccttgccgcggcctccgcccacctctctacgctcacagccgatgacttcttccacctgtggcagcagctcaagttcaacttcgtctcggtcactttgtgctccggcctcttggttttcctaagcaccgtatacttcaccacccgccctagaaaaatatacttggtgaacttcgcatgctacaagcccgagccggcccgtacgtgcacacgtgagatgttcatggagaggtcgaagctgacgggcagcttctacgacgagaacttggcttttcagcagaagattctcgagaggtctggcctcgggcagaatacgtacatgcctgaggccgtgatgcgggtcccaccgaacccgtgcatggtggaggcgaggaaggaggcggagatggtgatgtttggagcgatcgacgagttgctggagaagactggggtgaaggctaaggatattggaattctggtggtgaactgcagcttgttcaatccgacgccgtctttgtcgtccatggttgtgaatcactacaagcttagggggaacgttgtgagctacaaccttggtgggatgggttgcagtgctggtctcatttctattgaccttgcaaagcagcttctccaggtgcaccccaactcttatgccctagtggtaagcatggagaacatcactctcaattggtactttggcaatgaccgctctatgcttctctccaactgcctctttcgaatgggcggcgccgccatcctcctctccaaccgctcctctgaccaccgccgctcaaagtaccagctcatgcacgcggtccgcacgcacaagggtgcagacgacagggcatataattgcgtattccaaaaggaggacgacacgaaaagagtcggcgttgctctctcgaaagacttgatggctgtggctggtgaagccctaaaaaccaacatcaccacacttggtccaatagtcctccccatgtcagagcaactcctgttttttgctactttggtggcaagaaaggtgttcaagatgaagaacatcaaaccctacatcccggatttcaagctggcgtttgagcacttctgcattcacgccggagggagagcggtgctggatgagattgagaagaaccttgagctcagcgactggcacatggagccatcgaggatgactctctataggtttgggaacacttcaagcagctcattgtggtacgagctggcttactctgaggccaagggaagagtccgaaagggagacaggatgtggcaaattgcgttcgggtcggggttcaagtgcaacagcgcggtgtggaaggcgttaaggactgttaaaccagccaaggagaagaacccttggattgatgagattcatgagtttcctgtagaggtgcctaaagtgtcagccgttgcttcttaactaaacctcggatattctgaggaggcaattgtgtgatttaattgtgtttctgtacgatgatttatttaaatgtaattctataacaacgttggctgttgcgtataattaaacatcactgcaactgattagtgggccaaaa

SEQ ID NO: 9156 - DNA, 1782 bp, Malus domestica
tcaaaacctcatagaaaaagtttcaaaatctttcccttttgtgagtttgactagtgtcgtgtttctgagactgtaacatggcggtgcagaatcagaaccagggagagaaattgaacttgggacctgagtcagcaggaagtcgcaaacctgcgcttcctaactttcttttatcagtgaagctcaaatatgtcaagctagggtaccactacttaatctccaacgccctctacctcctactagtccctctccttgccgcggcctccgcccacctctctacgctcacagccgatgacttcttccacctgtggcagcagctcaagttcaacttcgtctcggtcactttgtgctccggcctcttggttttcctaaccaccgtatacttcaccacccgccctagaaaaatatacttggtgaacttcgcatgctacaagcccgagccggcccgtacgtgcacacgtgagatgttcatggagaggtcgaagctgacgggcagcttctacgacgagaacttggcttttcagcagaagattctcgagaggtctggcctcgggcagaatacgtacatgcctgaggccgtgatgcgggtcccaccgaacccgtgcatggtggaggcgaggaaggaggcggagatggtgatgtttggagcgatcgacgagttgctggagaagactggggtgaaggctaaggatattggaattctggtggtgaactgcagcttgttcaatccgacgccgtctttgtcgtccatggttgtgaatcactacaagcttagggggaacgttgtgagctacaaccttggtgggatgggttgcagtgctggtctcatttctattgaccttgcaaagcagcttctccaggtgcaccccaactcttatgccctagtggtaagcatggagaacatcactctcaattggtactttggcaatgaccgctctatgcttctctccaactgcctctttcgaatgggcggcgccgccatcctcctctccaaccgctcctctgaccaccgccgctcaaagtaccagctcatgcacgcggtccgcacgcacaagggtgcagacgacagggcatataattgcgtattccaaaaggaggacgacacgaaaagagtcggcgttgctctctcgaaagacttgatggctgtggctggtgaagccctaaaaaccaacatcaccacacttggtccaatagtcctccccatgtcagagcaactcctgttttttgctactttggtggcaagaaaggtgttcaagatgaagaacatcaaaccctacatcccggatttcaagctggcgtttgagcacttctgcattcacgccggagggagagcggtgctggatgagatcgagaagaaccttgagctcagcgactggcacatggagccatcgaggatgactctctataggtttgggaacacttcaagcagctcattgtggtacgagctggcttactctgaggccaagggaagagtccgaaagggagacaggatgtggcaaattgcgttcgggtcggggttcaagtgcaacagcgcggtgtggaaggcgttaaggactgttaaaccagccaaggagaagaacccttggattgatgagattcatgagtttcctgtagaggtgcctaaagtgtcagccgttgcttcttaactaaacctcagatattctgaggaagcaattgtgtgagttaattgtgtttctgtacgatgatatattgaaatgtaattctataacaacgttggctgttgcgtataattaaacatcactgcaactgattagtgggccaaaa

SEQ ID NO: 9157 - DNA, 1527 bp, Cucumis sativus
aatggccgatcacaggctccctaatttcctcttatccgtccgccttaaatacgttaaactcggctaccattacttaatctccaacgccatgtaccttctcttactccctttcctcgccgctctctctgctcatctctccactttccaatttcaagacttcctccatctttggaacatcctcaatttcaatctcctctctgttgcactctgttcttccctcctcgttttcctcactaccctttacgttatgacccgacccagaaaagtttacctccttaacttctcttgttacaagccccatcctgctaggacttgcgaaagagggacctttcttcatagatcggagctcactgggagttttactgaggagaatttggggttccagaagaagattctcgagaggtctggtttgggggagaaaacttacttgcccgaggctgttatgagaatcccgccgaatccttgtatggacgaggcgaggaaggaggcggaggctgttatgtttggtgccattgatgaattattggagaagacgggtgtgaaggctaaggatatcgggattttggtggtgaattgtagtttgtttaatcctacaccttctttgtctgctatgattgttaatcattataagcttagagggaatattttgagttataatcttggtggtatgggttgcagtgctggtcttatctccattgatcttgctaaacaactcttgcaggtacacccaaattcgtatgccttagtagtaagcatggagaacatcacactaaattggtacttcggcaacgaccgatcaatgctggtctcaaattgcctattccgaatgggcggtgctgccatccttctctcaaaccgcccttcagaccgccgtcgttcaaagtaccaactcatccacaccgtccgaactcacaaagggtccgacgacaaatgctacaattgcgttttccaacaagaagacgacaccgggcgtgtaggcgtacgtctctccaaagacttaatggccgtggctggagaagctctgaaaacaaacatcacaacgctcggcccactggtcctcccaatgtcagaacaactgctgttcttcgcaacactggtagccaagaaaatcttcaaaatcaagaaaataaagccgtacatcccggatttcaagctggcgttcgagcatttctgcatccacgcgggagggcgggcggtgttggacgaactggagaagaaccttgatctgagtgaatggcatatggagccgtcgagaatgacgctgaacagatttgggaatacgtcgagcagttcgttgtggtatgaattggcttatagtgaagcgaaagggaggatccggaaaggggataggacatggcagattgcgttcgggtcgggattcaagtgtaacagtgcggtgtggagggcgttgaggacggttaatccggcgaaggagaagaatccatggatggatgagattcatgagtttcctgtggaggttccaagagtggcccccattcataaaccttgaatgaagaaacaaacaat

SEQ ID NO: 9158 - DNA, 1706 bp, Helianthus annuus
ggactcataacaataataacttcattaataaagcatgaatacacacgcacacatatcaaccaaccgatttgagttcgaacattaacaatggcggatctcccaaacttcctgttatcagtgaaactgaaatacgtgaaattaggttaccattacctgatctcacatttcatgtacctcctcttaatcccactcctcgcagtcgtctccgttcatctctcaaccctcacatcacaagatctcatcaacctatggcaccacctccgcttcaatttactcaccgtcatcatatgctcaacgctcatcgtgtttctcgccacactctacttcatgagccgcccaaacaaggtttatttggtcgatttcgcctgttacaaaccgaacgattccaacaccgtcagtcgcgaaacattcatgcagcattcgggtctggcaggtacgtttaacgacgagaatttggcgtttcagaagaagattctggaacgatctggattaggtcagaagacgtattttcctgatgcggtgttgcaggttccaccgaatccgtgtatggccgaggctcggaaggaggcggagatggtgatgttcggtgcgattgatgacttgttgaggaaaaccggagtgaaggccaaggatatcggtgttttgatcgtgaattgtagcttgttttgccctacaccttctttgagttctatggttgtgaatcattacaagcttagaggtaacattttgagctataatcttggagggatgggttgcagtgctggattgatctctattgatcttgccaaacaacttttacaggtgaacccaaattcatatgctttggtggttagcatggaaaacataacattgaactggtactttgggaacaatcgatctatgctcttgtcaaactgtcttttccgtatgggcggtgctgcgattctcttgtctaacaggtcgagtgaccgtcgacgctcaaagtatcaactagtgcataccgttcgcacccataagggtgcggacgacaaatgctacagttgtgtattccaagaagaggacaacgagaaaaagattggagtcgctctttctaaagatcttatggctgttgcgggtgaggccttgaaaaccaacatcacgactcttggcccgttagtgttacccatgtctgaacagctcttgtttttcgtgacactagtcgcgaggaaagtattcaaaatgaaaattaaaccgtatatcccggatttcaagcttgcatttgagcatttttgcattcacgcgggaggaagggcggtcctagacgagttagaaaagaatctcgagttatcggagtggcacatggaaccatcccgaatgacgctctatagatttggtaacacttcaagtagctctttgtggtatgaactagcatactgtgaagctaaaggtagaataaagaagggagaccgatcgtggcaaattgctttcgggtcaggtttcaagtgtaacagtgcggtttggagagctctacggactatcgacccgacaaaagagaaaaacccatggacaagtgagatccatgagttcccggtacatgttccgaagatcgcccaaatcgacttgtaagatgtggtcttttgatgtttgcttaaatcagtgagtggcatgtatgttactttctttcttgtaatgtatggggatattgaattttaaaactagattttaaccaataagatattttctttatt

SEQ ID NO: 9159 - DNA, 1669 bp, Citrullus lanatus
ttcccccacaatttcatttcatctcaaatttcaatcctttcttcttcttcttcttcttcttcttcctcatcaacaatggcagaccacagacttcctaatttcctcttatccgttcgcctaaagtacgtcaaactcggctaccattacttaatctccaacgccatgtaccttcttttactccctttccttgccgccgtctccgctcacctctccacccttcaatttcaagacttcctccatctttggaaccacttcaatttcaatctcctctctgttacactctgttcttccttactcgtttttctcgctaccctttatgttatgactcgacccagaaaagtttaccttcttaatttctcttgctacaagcctgaaccggctaggacttgcgaaagagggacgtttctccagagatcagagctgactgggagttttacagaggagaatttggcgtttcagaagaagattcttgagaggtcgggtttgggagagaagacttacttgccggaggcggtgatgagagtgccgccgaatccttgtatggcggaggcaaggaaggaggcggaggcggttatgtttggagcgattgatgagcttttggagaagacgggtgtgaaggctaaggacattgggattttggtggtgaattgtagtctgtttaatccaactccttctttgtctgccatgatcgttaatcattataagcttagaggtaacgttttgagttataatcttggtggtatgggttgcagtgctggacttatctccattgatcttgccaaacaactcttgcaggtgcacccaaattcgtatgctctagtggtaagcatggagaacatcacactaaattggtactttggcaacgaccgatcgatgctagtttcaaattgcctcttccgaatgggcggcgccgccatcctcctctccaaccgcccatcggaccgccgtcgttcaaaataccaactcatccacaccgtccgaactcacaaaggctccgacgacaagtgctacaattgcgtattccagcaagaagacgataccggccgcgtcggcgtccgtctctccaaagacctaatggccgtcgccggagaagccctaaaaacaaacatcacaacactcggcccactcgtcctcccaatgtcagagcaactcctgttcttcgcaaccctagtcgctaaaaaaatcttcaaaatcaagaaaatcaagccctacatccccgatttcaagctggcgtttgaacatttctgcatccatgccggaggccgggcagtgttggacgaactggagaagaatcttgatctgagcgaatggcatatggagccgtcgagaatgacgctgaaccgatttgggaatacttcgagcagttctttgtggtacgaattggcttatagtgaagcgaaagggcggatccggaaaggggatcggacctggcagatcgcgttcgggtcgggtttcaagtgtaatagtgcggtgtggcgagcattgaggaccgttgatccagcgaaggagaagaatccatggatggacgagattgacgagtttcctgtggaggttccacgagtggcccccattcataaaccttgaatcaagggattgaacaagaacaacaatatcaaaattcttttgactctttcaaggataattcatttttattagtcttttaattctt

SEQ ID NO: 9160 - DNA, 2177 bp, Eucalyptus grandis
gttaaacttgcgagagcataagaagagactattattttatacgataatgtcgcagtatatgaaccaaaatccgccagtcagttggcacatttcatgaataccaattaaacagttcgttggtggtagttgcatcctccctccaatctctgtctctctcgctttaaattcactacgtttctgcgagtctttgcgaggcagaacttataactcttgtcccttcttgtgtttgtggcgtggagcaatcgcagcttcattgcttgtgctcggatccctctccaatggctgacaaagaaagcaaaaacaaccatgaccctggggcggtgtcgccgtctgcaagagtttctgtcgaccctcaaccggcgacgaggcgaagcacccgcaatcttcccaactttctcttatccgtcaagctcaaatatgtcaagctaggttaccactacttgatttccaacgccatgtacatcttcctcttgccgctgctcctcgtggcctcggcccacttgtcgacgctcaccgccgacgacctcaccaacctgtgggaccagctcaagtttaaccttgttgctgttgtcctcagctcggccttcgtagtcttcctcatcaccctccacttcatgacccggccgcggcgggtgtacctggtggactttgcgtgctacaagcccgagccggcccagaagtgcacacgggaggtgttcatggagcgttccgccctcacggggaacttcacggcagagaacctcacgttccagaggaagatcctcgagcgggcggggctgggccaggacacgtacctgcccgacgccgtgatgcgggtcccgcccaacccgtgcatggccgaggcgaggaaagaggccgagaccgtgatgtttggggcgatcgaccagctgctggcgaagaccggggtcaagcccaaggacatcgggatcttggtggtgaattgtagcttgtttaatcccacaccatcactctctgccatggtggtgaatcactacaagctcagaggcaacattctgagctataatcttggtgggatgggttgcagtgcaggcttgatctccatagatttggccaaacagctcttgcaggtgcaacccaactcttatgctcttgtagtgagcatggagaacatcaccctcaactggtacttcggcaatgaccgggcgatgctcctctcgaactgtctcttccggatgggtggggccgcgatcctcctgtcgaaccgatcctccgacagacgactttccaagtaccagctcgtccacactgttcgcacccacaagggcgcggatgacaaatgctacggctgcgtcttccagcgggaggatgacaccaagcggattggggtctcgctctcgaaggacctgatggccgtggccggggaagccctcaagaccaacatcaccacgctcggccctctagtccttcccatgtccgagcagctcctgttcttcgtcactctagtggcccggaaagtgctccagatgaagatcaagccttacattccggacttcaagctggcctttgagcacttctgcatccacgccggaggcagggcggtgcttgacgagctcgagaagagcctcgaattgaccgagcatcacatggagccctcgagaatgaccctatacagattcgggaacacttcaagcagttccttgtggtatgagctggcttactccgaggccaaagggaggatcaggaagggcgataggacgtggcagatcgcgttcggatctgggttcaagtgcaacagcgctgtgtggcaggcgctgaggacaatcgacccggcgaaggagaagaacccttggatggatgagattgacaagttccctgttgatgtcccaaaagtggcatccattagttaaaagtcctcaagaatcatgcatgtcttcatctttcaggggaacagaaagggagagagagatttcactgggggaatcattacacagtagaagtcaattcaatctctcagtacatttgttagagaagttgaagcctgattgattctttttgtattatgtctattgagagggtgtgtctgatttgtgtctttgagggttggtttataagcatttgctgttttttagctctaccatagtgatagagcacattcatattcaagatcacttcatttatgtagctatgatctcccaactgcttttgccttcctttca

SEQ ID NO: 9161 - DNA, 3046 bp, Solanum lycopersicum
  misc_feature (452)..(1178): n is a, c, g, or t
aacacatttacaactctattttttgttcaatctttctcactcaggtctctcttatttcgtctaaaaagattattttttactcatatttcatctaaaaatcttttttttttcacttgaatatctcttatttcatctaaaaatcaattcttgacaatcgggtatctcttatcaaaatcagttcttgtcatttagatatatcttattttgtctaaaaatcagttcttgtcatttcggtgtcttctacttcacttaaaaaatgaattttttttacttagatatctcttatttcgtctaaaagttcattattttcactcgggtatatcttattttattgaaaaatccattcttttcactcgggtatctcttctttcctctaaaaatcaattcttttcactcggatatctcttctttcatctaaaaatcagttcttttcactcggatatctcttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatctcttctttactctaaaaatcaattcttttcactcgggtatctcatatttcattaaaaaaaacagttctttacactcaagtatctcttatttcatcaagaaaacttctcatttactcttctctaacttcattgaatttgagagtcaagctcagtttaaacaatgggggatgagaacaagaagaattcagttggctctgaaaccgcgcgaatttcggttgaagttaacaatcttcctaattttcttcaatcaatcaggctcaaatatgtgaaacttggttaccattacttgatcagcaatgcaatgtatctgtttttggttcctgttttgggagtactttgtgttcatgttatgactatttcagttgaggacctaatccaattattggataaattgaagttcaatcttatcacagtgattttatgttctgctgttgttgtttttttggggacactttatttcatgacaaggcctagaaaagtgtatttggttgatttttcatgttataagcctaagcctgatgttatgtgtagtaaagaaactttcatggagagatcaaaacaagccaggattttcactgaggagaatttggcctttcaaaagaagatactagaaaggtcgggtttaggtcaaaagacgtattttcctgaggcacttttgagagtgcctgcggaacctaacatggctgaagcaaggaaagaggctgagatggtgatgtttggtgctatcgatgagttgttagcgaaaactagggtgaaggctaaggatattgggatacttgtggtgaattgtagcttgtttaatccaacaccatcactttctgctatgattgttaaccattacaagctcaggggaaatgttatgagttataatcttggtggaatgggatgtagtgctggactcatttctattgatcttgctaaacaactgttgcaggtgaatcctaattcttatgcacttgtggtgagtatggaaaacataacactcaattggtactttggcaacaacagatcaatgcttgtctcaaattgcatatttaggatgggaggtgctgcaattctgctgtcaaacagatcaacagatggtcgacgttccaagtaccaactgatccatacagtacgtacacacaagggcgcggatgacaggagctatggttgtgtgttccaggaggaggacgagaagaaggagattggtgttgccttatcgaaggacctaatggctgttgcaggggaagcactaaaaactaacatcacaacgctcgggccattagtccttcctatgtctgagcaactccttttcttcatgacattagtcgcgaggaagatctttaagatgaaaatcaagccttacatacctgatttcaagctggcattcgagcatttctgtatacacgctggtggaagggcagtactggatgagctcgagaagaatctcgagctcagccaatggcatatggagccatcaagaatgacactttacaggtttggtaacacatcaagtagctctttatggtatgaattggcttatactgaagctaaagggaggatcaagaaaggagacaggacatggcaaattgcatttggttctggatttaaatgtaacagtgctgtgtggcgcgcgttaaagacgattaatcctgctaaagagaagaatccatggatggatgaggttcatgaattcccagttgaagtacctagaattgtcacaattaatgattcttgaaaataattttaaattttcctccagtaaatgttactatgtaatagtagtattatcattctttgttaccttaaagattgcaatgcacaatgtaatttgatttgattatttataaaaagtgatatcaaatattctattttctagcaa

SEQ ID NO: 9162 - DNA, 1805 bp, Tropaeolum majus
agtggattacggccgggaacccattccattctcccaccaaatttttttcttccaatttcttcatcgcacgttttagcaattcgcaaaccaaacatccatatcttcttatccaatttgttcgatcattcattttggattaaaaaatggcggatgctaaagatcatactatccacccagcagagacaataggaaacgatgaacgtaagctcccaaactttctactctctgtaaagctaaaatacgtgaagcttggataccactacttgatctccaacgccatgtatttgttaatggtgccgcttctagcagtagcctttgctcatctctccacgttgacgattcaagatctggttcatctttgggaacagcttaagttcaatttactgtcagtaactctctgctcgagccttatggtgtttttagggactctgtatttcatgagccgaccgacgaagatttacttggtggatttctcttgttacaagccggaaaaagagcgtatatgcacgagagagattttctatgagagatcgaaactaactgggaattttaccgatgataatttaactttccaaaagaaaattatcgaaagatctggattaggtcagaacacgtacttacctgaggccgttctacgggttccgcccaatccgtgtatggcggaggctagaaaggaggctgagatggttatgttcggtgcgatcgatgaattgttggagaaaaccggggttaaacctaaggatatcggtattcttgtggtgaattgcagcttgttcaatccgacgccgtctctgtccgcaatggtggttaatcggtacaagcttagagggaatatcctaagttataatctcggtggaatgggttgtagtgctggacttatctctattgatcttgccaaacagctccttcaggtgcatcctaattcatatgcactagttgtaagcatggagaacataactctaaactggtacttcggcaacgaccgatccatgctcgtctcaaactgtctattccgattaggtggtgccgcaatcctcctttccaaccggtcctccgatcgtcgtcgtgcgaaataccaactcatgcatacagtacgtacacacaaaggtgcagacaacaagtcttacagctgcgtattccaaagagaagacgaccaaaccaaaatcggtgtctccctctccaaagacctgatggccgtcgccggagaagctcttaaaaccaacatcacgacgttaggtccgatcgtccttccaatgtccgaacaactcctgttcttcattacattagtcgctagaaaagtattcaagatgaagataaagccgtatattcctgatttcaaattagctttcgagcatttctgtattcacgccgggggaagagcggttctggatgaaatggagaaaaatctcgagctaacggattggcatatggaaccttctagaatgactttgaaccgatttgggaacacttcgagtagctcgttgtggtatgagttggcttactcggaagcgaaagggagaatcagaaagggtgatcggacatggcagatagcttttgggtctgggtttaaatgtaatagtgctgtttggaaggctttgagatctgttaatccgggaaaggagaagaatccatggatggatgaaattgatcaatttcctgttcatgttcctaaagtttctgcagttgtttcttcgaagtgatgttctatttatgggagagaaaaatgatttgtgtacgtaatttaatataatttgtctgtacaacatttgtttgaaggtttaattaattaaaaggatcattttcgt

SEQ ID NO: 9163 - DNA, 1507 bp, Glycine max
agagggttggcatataaagtaaccagtgtgtaaaagaaaactcaagctcccagattctgttccaatgcctcccgtacctatttcccccatcaaagttgggcatattgatgatgtccaagagctaagaaaaaccaagccaaggacaattcctcaaagatttgtacgagacatgacagaaagaccaacactcactacacctcttcccccaccatatagtgacatgccagtcattgatttctataagcttagcaaagggaacaaagaggaagtcctcactgaacttttcaatcttgcaactgcttgtgaagagtggggattttttcaggtaattaatcatgaaattgacctcaatctgctggagagcatagagaacctgagcagggagtttttcatgctacctttggaagagaaacagaaataccctatggctccaggaacagtccaagggtatggacaagcttttgttttctcagaggaccaaaaactggactggtgcaacatgtttgctcttggaattgaacctcaatatgttaggaacccaaatctatggccaaagaaacctgaaaaattcagtgaaactgtggaagaatactcaggagaaataaggaaactctgctataatctgttgacatacatagctttaggccttggtttaaaaggggatgagtttgagaagatgtttggaatatcagtgcaagctgtaaggatgaactactacccaccatgttcaagacctgaccttgttttgggtctgagtccccattcagatggaagtgccctcactgtactgcagcaagcaaagggaggcccagtgggacttcagatactcaaggacaatacatgggttcctattcaaccaattccaaatgctcttgtcatcaacattggagacacaatagaagttcttacaaatggaaaatacaggagtgtggagcatagagctgtggctcatgaggagaaagatagactctcaattgtgacattttttgctcctagctatgaagtagagcttggtccaatgccagagtttgtggatgaaaaccacccatgcaagtataaaagatacagtcatggagagtacagtaaacactatgtaacaaacaagttacaaggaaaaaagaccctggactttgccaagatccaaaccaaaaacaaaaactaggaaggtccccaacttgctaggagtactataattagactaagtgactaactatgtgtgtgtatagaattatctaccacataaaagcatcatggtcaaatctctcaattctatttttgttgaaaagtaggcaaaggaaattagttgggtgatgtaggaggggtgtgattgtgggtcacatacagaaggctcactgtttcttattccaaatttgtatatgccatctctcaatggaaactagtgacatcttattttataagctttatttccaaactgtcttgatatgtggacgttaatggtctaaagcacataaaaaaccaagaacaaagtagaattaaatgacagtac

SEQ ID NO: 9164 - DNA, 1498 bp, Glycine max
gcatataaagtaaccagtgtgtaaaagaaaactcaagctcccagattctgttccaatgcctcccgtacctatttcccccatcaaagttgggcatattgatgatgtccaagagctaagaaaaaccaagccaaggacaattcctcaaagatttgtacgagacatgacagaaagaccaacactcactacacctcttcccccaccatatagtgacatgccagtcattgatttctataagcttagcaaagggaacaaagaggaagtcctcactgaacttttcaatcttgcaactgcttgtgaagagtggggattttttcaggtaattaatcatgaaattgacctcaatctgctggagagcatagagaacctgagcagggagtttttcatgctacctttggaagagaaacagaaataccctatggctccaggaacagtccaagggtatggacaagcttttgttttctcagaggaccaaaaactggactggtgcaacatgtttgctcttggaattgaacctcaatatgttaggaacccaaatctatggccaaagaaacctgaaaaattcagtgaaactgtggaagaatactcaggagaaataaggaaactctgctataatctgttgacatacatagctttaggccttggtttaaaaggggatgagtttgagaagatgtttggaatatcagtgcaagctgtaaggatgaactactacccaccatgttcaagacctgaccttgttttgggtctgagtccccattcagatggaagtgccctcactgtactgcagcaagcaaagggaggcccagtgggacttcagatactcaaggacaatacatgggttcctattcaaccaattccaaatgctcttgtcatcaacattggagacacaatagaagttcttacaaatggaaaatacaggagtgtggagcatagagctgtggctcatgaggagaaagatagactctcaattgtgacattttttgctcctagctatgaagtagagcttggtccaatgccagagtttgtggatgaaaaccacccatgcaagtataaaagatacagtcatggagagtacagtaaacactatgtaacaaacaagttacaaggaaaaaagaccctggactttgccaagatccaaaccaaaaacaaaaactaggaaggtccccaacttgctaggagtactataattagactaagtgactaactatgtgtgtgtatagaattatctaccacataaaagcatcatggtcaaatctctcaattctatttttgttgaaaagtaggcaaaggaaattagttgggtgatgtaggaggggtgtgattgtgggtcacatacagaaggctcactgtttcttattccaaatttgtatatgccatctctcaatggaaactagtgacatcttattttataagctttatttccaaactgtcttgatatgtggacgttaatggtctaaagcacataaaaaaccaagaacaaagtagaattaaatgacagtac

SEQ ID NO: 9165 - DNA, 1406 bp, Cajanus cajan
agaggggggagatatagagtaactagtgttaggaaaaactgaagctgagattcttttgccatgcctcccgtacccattactccaattagagttggtcacattgatgatgtccaagagctaaggaaaactaagccaaggacaattcctcaaagatttgtacgagacatgccagaaagaccaacacttactactacacctcttcccccaccacatagtcacatgcctatcattgatttctctaagcttagcagagggaacaaagaggaagtcctcactgagattttcaatcttgcaactgcttgtgaggactggggattttttcaggtaattaatcatgaggttgacctcaacctgctacatagcatagagaacctgagtagggagtttttcatgctacctttggaagagaaacagaagtaccctatggttccaggtacagtccaagggtatggacaagcttttgttttctcagaggaccagaagttggactggtgcaacatgtttgctcttggaattgaacctcagtatgttaggaacccaaatctgtggccaaagagaccagaaagatttagtgaaactgtggaagagtactcaggagaaataagaaaactgtgctataatctgttgacatacatagctttaggccttggtttaaagggggatgtgtttgagaagatgtttggtttatcagtgcaagccataaggatgaactactaccctccgtgttccagaccagaccttgttctggggctgagtccccattcagatggaagtgccctcactgtgctgcagcaagcaaagggaggcccagtggggcttcagatactcaaggacaatacatgggttcctattcacccaattccaaatgctcttgtcataaacattggagacacaatagaagttcttacaaatggaaaatacaggagtgtggagcatagagctgtagctcatgaggaaaaagatagactctcaattgtgacattttttgctcctagctatgatgtagagcttggtccaatgcaagaatttgtagatgaaaaccacccatgcaagtttagaagatacaatcacggggagtacagtaaacactatgtaacaaacaagttacaaggaaaaaagaccctggactttgccaagatccaaaccaaaaacacaaactagcttggagtactataattggactgactaagctgtgtgtgtatataattatctgccacataaaagtatcaaggtcaaatttctcaactctattttgttgaaaaataggcaaaggaattaattagttgggtgatgtaggagagtgtgattgtgggtcacatacagaagactcactgtttcttattctaaatatgcatatgctatctttcaatggaaactagtgacattattttatatttactaccaaa

SEQ ID NO: 9166 - DNA, 1440 bp, Glycine max
gggtttggcatatagagtaaccagtagtgtgcaaaagaaaactcaagctcccagattctgttccaatgcctcccgtaccaatttcccccatcaaagttgggcacattgatgatgtccaagagctaagaaaaaccaagccaaggacaattcctcaaagatttgtacgagacttgacagaaagaccaacactcactacacctcttcccccaccacatagtgacatgccagtcattgatttctctaagcttagcaaagggaacaaagaggaagtcctcactgaacttttcaatcttgcaactgcttgtgaagagtggggattttttcaggtaattaatcatgaaattgacctcaatctgctggagagcatcgagaacctgagcagggagtttttcatgctacctttggaagagaaacagaaataccctatggctccaggaacagtccaagggtatggacaagcttttgttttctcagaggaccaaaaactggactggtgcaacatgtttgctcttggaattgaacctcaatatgttaggaacccaaatctatggccaaagaaaccagaaaaattcagcgaaactgtggaagaatactcaggagaaataaggaaactctgctataatctgttaacatacatagctttaggccttggtttgaaaggggatgagtttgaggagatgtttggcgtatcggtgcaagccgtgaggatgaactactaccctccatgttcaagacctgaccttgttttgggtctgagtccccattcagatggaagtgccctcactgttctgcagcaagcaaagggaggcccagtgggacttcagatactcaaggacaatacatgggttcctattcaaccaattccaaatgctcttgtcatcaacattggagacacaatagaagttcttacaaatgggaaatacaggagtgtggagcatagagctgtggctcatgaggagaaagctagactctcaattgtgacattttttgctcctagctatgaagtggagcttggtccaatgcctgagtttgtggatgaaaaccacccatgcaagtataaaatatacaatcatggagagtacagtaaacactatgtaacaaacaagttacaaggtaaaaagaccctggaatttgccaagatccaaaccaagaacacaaactaggaagttccctaactagttaggagaactataattagactgactaatgactgtgtgtgtagaattaattatctaccacataaaagcatcatggtcaaatctctcgattctatttttgttgaaaaagtaggcaaagtaattagttggagtgatgtaggagggtgtgattgtgggtcacatacagaagactcactgtttcttattccaaatatgtatatgctatatatctctcaatggaaactagtggcatcttattttataagctttatttccaaactgt

SEQ ID NO: 9167 - DNA, 1427 bp, Glycine max
atatagagtaaccagtagtgtgcaaaagaaaactcaagctcccagattctgttccaatgcctcccgtaccaatttcccccatcaaagctgggcacattgatgatgtccaagagctaagaaaaaccaagccaaggacaattcctcaaagatttgtacgagacttgacagaaagaccaacactcactacacctcttcccccaccacatagtgacatgccagtcattgatttctctaagcttagcaaagggaacaaagaggaagtcctcactgaacttttcaatcttgcaactgcttgtgaagagtggggattttttcaggtaattaatcatgaaattgacctcaatctgctggagagcatcgagaacctgagcagggagtttttcatgctacctttggaagagaaacagaaataccctatggctccaggaacagtccaagggtatggacaagcttttgttttctcagaggaccaaaaactggactggtgcaacatgtttgctcttggaattgaacctcaatatgttaggaacccaaatctatggccaaagaaaccagaaaaattcagcgaaactgtggaagaatactcaggagaaataaggaaactctgctataatctgttaacatacatagctttaggccttggtttgaaaggggatgagtttgaggagatgtttggcgtatcggtgcaagccgtgaggatgaactactaccctccatgttcaagacctgaccttgttttgggtctgagtccccattcagatggaagtgccctcactgttctgcagcaagcaaagggaggcccagtgggacttcagatactcaaggacaatacatgggttcctattcaaccaattccaaatgctcttgtcatcaacattggagacacaatagaagttcttacaaatgggaaatacaggagtgtggagcatagagctgtggctcatgaggagaaagctagactctcaattgtgacattttttgctcctagctatgaagtggagcttggtccaatgcctgagtttgtggatgaaaaccacccatgcaagtataaaatatacaatcatggagagtacagtaaacactatgtaacaaacaagttacaaggtaaaaagaccctggaatttgccaagatccaaaccaagaacacaaactaggaagttccctaactagttaggagaactataattagactgactaatgactgtgtgtgtagaattaattatctaccacataaaagcatcatggtcaaatctctcgattctatttttgttgaaaaagtaggcaaagtaattagttggagtgatgtaggagggtgtgattgtgggtcacatacagaagactcactgtttcttattccaaatatgtatatgctatatatctctcaatggaaactagtggcatcttattttataagctttatttccaaa

SEQ ID NO: 9168 - DNA, 1474 bp, Lotus japonicus
tttttaagttccaagttctgttctgtttccatggctcctgtacctatttctaccctcaatgttggacacattgatgatgtccaagaactgagaaaaactaagccaaagacaattcctcaaagatttgtaagagacatgacagaaagaccaacacttgatgacactgctctttcctcaccacagagtgacctgcctgtcattgatttctctaagcttagcaaagggaacaaagaggaagtcctcagtgaactttgcaagcttgcaattgcttgtgaagagtggggattttttcaggtaatcaatcatgagattgacctcaatctgttggagagcatagagaatatgagcagggagtttttcatgcaacctttggaagaaaaacagaaatatccaatggctccagggacagtccaagggtatggacaggcttttgttttctcagaggaccagaagctggactggtgcaacatgtttgctcttggaattgaacctcactatgttaggaacccaaatctatggccaaagaagccagcaagattaagtgaaacaattgaagagtactctgaaggaatcaggaaactttgccagtatctgctagaatacatagctttaggcctgggattgaaaggggacgcatttgagaaagtgtttggtgcagcagtgcaagccataaggatgaactactacccaccatgttccaggcctgaccttgtcttgggcctgagcccccattcagatggaagtgccctcactgtgctgcagcaagcaaagggaagcccagttgggcttcaaatactaaagaacagcacatgggttcctgttcagccaattccaaatgctcttgtcatcaacattggagacacattagaagttcttaccaatggaaaatacaggagtgtggagcacagagctgtggctcatgaggagcaagataggctttcaattgtgacattttatgctcctagctatgaagtggagcttggaccaatgcaagaattttttgatgaaaaccacccatgcaagtatagaagatacaaccatggagagtacagtaaacattatgtgacaaacaagttacaaggaaaaaagaccctggactttgccaagatccaagtagaaaatacaaactaggaagtttcacttcacttagttccccaactagctagaagtactatgattaaactataagtagatataagaatcaaccacataaactgataaaagtatcaaggttaatcttctcaattattttttattcaaaagtaggtaaaaatattagttgggtgatgtacaagagtgtgattgtgggccacatacagaagacagctcactgttcttattctatgcatgtatttgctttttcaatggaaattaaatttgtgtcatctcatgttaatggtgtttgatttagccaagatgaatagaaaaagtagtcattattgggttatgtagatttaacttgtaactctgttga

SEQ ID NO: 9169 - DNA, 1441 bp, Lupinus angustifolius
tttttatgatttttttaatatataacgtcacaaaggtctaaattccgctataaatatgaagttaagggtaaagagtagagacatagatcaatcaatcaatttgtagagaaaactgtaactccaaattatttctgttttcatggctcctgtacccatttctctcatcaacgttggccatattgatgatgtccaagaactaaggaaaactaagccaaagacaattcctcaaagatttgtaagacacatgacagaaagaccaacacttgttacatcagtatcacaacacaacagtgacatgccagtcattgatttctctaagcttagcaaaggtaacaaagaggaagttctcactgaacttttcaaccttgcaactgcttgtgaggagtggggattttttcaggtaattaatcatgaggtggacctcaatttgctggagagtatagagaagattagcaaggattttttcatgctacctttggaagagaaacagaaatatcaaatggttccaggtacagtacaagggtatggacaagcttttgttttctcagaggaccagaagttggactggtgcaacatgtttgctcttggaattgaacctaactatatgaggagtccaaatctatggccgaagagaccagaaaaatttagtgaaacagtggaagtgtactcaagagaagtaaggaaattatgcaagaatctgctgaaatacataggtctaggtctagagttggaaggggatgcatttgagaagatttttggtggggcagtacaagcaatgaggatgaattactacccaccatgttcaagacctgaccttgtgttgggtcttagccctcattcagatggaagtgcccttactgtgctgcagcaagcaaaaggaagcccagtgggacttcaaatactcaaggacagtaaatgggttcctgttcaaccaattccaaatgctcttgtcatcaacattggagacacaatagaagttcttacaaatggaaaatacaagagtgtggagcatagagctgtggctaataaagagaaagatagactatcaattgtgacattttatgctccaagctatgaagtagagcttggtccaatgcaggaatttatagatgaaaaccatccatgcaagtatagaagatacaaccatggagagtacagcaagcactatgtaacaaacaagttgcaaggaaaaaagaccttagactttgccagaatccaaaccaaaaacacaaagtagctagataggcccactcaagttccccaactaggagtactataattattaggctgtctatagaaatcagccacataagaatatcaatgtcaagcttctcaattctttttaattacataagattcactgttcttattaaaacatgtatatgctataattcaatggaaactagtgacatctttatattttatgacctttattgccaaa

SEQ ID NO: 9170 - DNA, 1490 bp, Cicer arietinum
acattattcttttgaatattttaatgtgtacgtcacaagagtctaatgttcatttccactataaatacatgcttggtgaggaaggtagagatataaaataatcacttgtagtgaaaaatcttagatcaaaatttctgtttcaatggctcctgtaccaatttctaccttaaacgtaggacacattgatgatgtacaagaattaagaagaactaagcctaagacaattcctcaaagatttgtaagaaacatgacagaaagaccaacacttcaaacacctctttccccaccaaatagtgacatgcctgtcattgatttctctaagcttagtaaagggaccaaagaagaaatcctcaatgaactttataagcttgcaactgcttgtgaagagtggggattttttcaggtgattaatcatgagattgacctcaatctgatggagaacttagaggatttgagcagggagttttttatgctacctttggaagagaaacagaaataccctatggctccaggcacagtccaagggtatggacaagcttttgttttctcagaggatcagaagcttgactggtgcaacatgtttgctctaggaattgaacctcactatgtaaggaaccaaaatctttggccaaagaagcctgcaagactcagtgaaacagtggaattgtactcaagagaaataaggaaactatgtcaaaatttgctgaaatacatagcaatagggctgagtttggaagaagatgtgtttgagaagatgtttgatgaagcagtacaagccataaggatgaattattatccaccatgttcaagacctgaccttgttttgggtctgagtcctcattcagatggaagtgctctcactgtgctgcaacaagcaaagggaagtccagtgggacttcaaatactcaaaaacaacacatgggtccctcttcaaccaattccaaatgctcttgtcatcaacattggtgacacaatagaagttcttacaaatggaaaatacaagagtgtggagcatagagctgtggctaatgaggataaagatagactctcaattgtgacattttatgctcctagctatgaaattgaggttggaccaatggatgaatttgttgatgaaaagcacccatgcaagtttagaagatacaatcatggagagtatagtaaacactacgtaacaaataagttacaaggaaagagggccctggactttgccaagatggaaatcatgaataatacaaactaggaactattttttagtctgttctccaactacctaggagcacttaattagactattcagtatatataaatatcaaccacatataatttttttttttttgttttttttgcaaagtatcactgttcttattccaaatatgtattattatatgctagctttcaattggaaactaatgaaagctctattcaatactaaatattttatttccaaagttgtgttgtgtatctcaacactaatggcttaaagcatg

SEQ ID NO: 9171 - DNA, 2253 bp, Gossypium raimondii
tttttcttttttcttttttaaattttatttttcagaatcaataattagatctcctccataaagattatcgatatcaaccttcaacaagaaacaactagaaaaattaagaaagaaaaacacacatccccattaataccgaggaagaggaagttgaaaacccttgggctgtcccttggtgggtgtttctttaggttttcttggtcgcgacgattttcagtggcttgtaaatggcagcgtataggctcctgattttctccctctttttggccctagttttcaccaagattggagccgatgcctcaactgaaccgctgcttgaatcggacgccgccgattcttctgctcttaagatggagttggatcaactgaagtctaagatccgtcttcttgaatcaaatgttgaggagaaaattcgagaattgaaaaccaaggatgagatgataaagcagaaagataaaattatagaagaaaaatctgacagcatggcatcgttgcactctgaattatcatctcttcagaaaaaaggaacctcagatgctgaggaacgggtgggaaaagctcatgcgaaagctcttgaattgcagaaacaggttgataaacttaaaactgaactagaagcaaaattgaaggataaagattatttggaatcccgtgcaactaaagctgagaacaagttgaatgaattgaatttgcagctagagaatcttcaaaagatcaataaggaacaggagaacaaactagcaaaaactgagcgagctctaaaaattgcagaggaagaactgataaaggcaaagtttgaggccacttcaaaggcaaatgagttgatggaggttcacagcgcatggctcccaccttggcttgctacacagttaattcgtggtcaggccttcattcagacacattggaatcagcatggaaaaccaaacatggatatggtgatccagaaggctctagagagaaaggccttagctaaaaagtgggctgaaccccacatggaagcaattaaaaccaaatgggttccagctgctaaggatcagtgggtggcggtaactacatatgctgaaccacatgtgcaatcgctaactgcaaaaactgttgaaatttatgaggtatcgaaggctacaataactcctcatattatcaaagttcaagaaacagttgatccttacttccaggaagccaagaagttcagtaagccatatattgatcaggttgctactttagcaaagcctcatgttgataaaatttctgtggtgatgaagccctatacaaaggaggtagttaaagcttatgggaggtttttggaatcagcaacaacataccatcaacaggttcaagcctctgtgcaagaaactttgaagaagcatgagctgacaagacctcttgcaaccaaagagcttgagtggttttcggcatctgctctattggctctacctattattattttgttcagaatattttcagcaattttctgcaaaaagacaaagaagcgtgttcgacatactaatgcagtccaccatggtcgtcgtaagggcaaaagggggcacacagacaagtagactgcgtgtatttaggttttggtctctgaatgttgggaaatattagaggctaactggacgtatgtttttactttttaggggctctaggtgatcatgttgggtagggagctgtggtgttgcaattggaagtatttaatcttctcttacccctcaaggtccctggttttaatattattattattttttggggagggtgtggaattagaaaaagttaagaaccctagtgacgctacaaggttgaaatcttgagattcctagttgtaggagttgtgtattttatttatgttagtgtaatttttttttttcttctggattcacaaacgaaacaactcagtctctgtttcagaaatcatcatactttttaagttgagacatccaaggggttttatactctatcttgtctttgtctccaaggattactgtttgtttattgcctactttagctagtctctggatgggatcccatgggagagcgttgcaatttcaactttccaccgactctatatgcatagacatagcccattctaatttctaagggattggcatgactagccaggccatctgcttcggcaagcttctgtattcaatagctgtttttgctatgatccattatccatgtttgaaagagtagtatcttgaactatataattaactaattataaaatttaaatataatatggtgagctagttgaaa

SEQ ID NO: 9172 - DNA, 1927 bp, Gossypium hirsutum
gaaaaaaattttatttttcagaatcaataattagatctccgccataaagattatcgatatcaaccttcaacaagaaacaactagaaaaattaagaaagaaaaacacacatccccattaataccgaggaagaggaagttgaaaacccttgggctgtcccttggtgggtgtttctttaggttttcttgttcgcgacgattttcggtggcttgtaaatggcagcgtataggctcctgattttctccctctttttggccctagttttcaccaagattggagccgatgcctcaactgaaccgctgcttgaatcggacgccgccgattcttctgctcttaagatggagttggatcaactgaagtctaagatccgtcttcttgaatcaaatgttgaggagaaaattcgagaattgaaaaccaaggatgagatgataaagcagaaagataaaattatagaagaaaaatctgacagcatggcatcgttgcgctctgaattatcatctcttcagaaaaaaggaacctcagatgctgaggaacgggtgggaaaagctcatgcgaaagctcttgaattgcagaaacaggttgataaacttaaaactgaactagaagcaaaattgaaggataaagattatttggaatcccgtgcaactaaagctgagaacaatttgaatgaattgaatttgcagctagagaatcttcaaaagatcaataaggaacaggagaacaaactagcaaaaactgagcgagctctaaaaattgcagaggaagaactgataaaggcaaagtttgaggccacttcaaaggcaaatgagttgatggaggttcacagcgcatggctcccaccttggcttgctacacagttaattcgtggtcaggccttcattcagacacattggaatcagcatggaaaaccaaacatggatatggtgatccagaaggctctagagagaaaggccttagctaaaaagtgggctgaaccccacatggaagcaattaaaaccaaatgggttccagctgctaaggatcagtgggtggcggtaactacatatgctgaaccacatgtgcaatcgctaactgcaaaaactgttgaaatttatgaggtatcgaaggctacaataactcctcatattatcaaagttcaagaaacagttgatccttacttccaggaagccaagaagttcagtaagccatatattgatcaggttgctactttagcaaagcctcatgttgataaaatttctgtggtgatgaagccctatacaaaggaggtagttaaagcttatgggaggtttttggaatcggcaacaacataccatcaacaggttcaagcctctgtgcaagaaaatttgaagaagcatgagctgacaagacctcttgcaaccaaagagcttgagtggtttgcggcatctgctctattggctctacctattattattttgttcagaatattttcagcaattttctgcaaaaagacaaagaagcgtgttcgacatactaacgcaacccaccatggtcgtcgtaagggcaaaagggggcacacagacaagtagactgcgtgtatttaggttttggtctcttaatgttgggaaatattagaggctaactggacgtgtgtttttactttttaggggctctaggtgatcatgttgggtatggagctgtggtgtcgcaattggaagtatttaatcttctcttacctctcaaggtccctggttttaatattattattattttttggggagggtgtggaattagaaaaagttaagaaccctagtgacgctacaaggttgaaatcttgagattcctagttgtaggagttgtgtattttatttatgttagtgtaattttattttattttgtttttctttctactggattcacaaacgaaacaactcagtctctgtttcagaaatcatcatatactttttgaga

SEQ ID NO: 9173 - DNA, 1748 bp, Gossypium hirsutum
aaacccttgggctgtcccttggtgggtgtttctttaggttttcttgttcgcgacgattttcggtggcttgtaaatggcagcgtataggctcctgattttctccctctttttggccctagtttcaccaagattggagccgatgcctcaactgaaccgctgcttgaatcggacgccgccgattcttctgctcttaagatggagttggatcaactgaagtctaagatccgtcttcttgaatcaaatgttgtggagaaaattcgagaattgaaaaccaaggatgagatgataaagctgaaagataaaattatagaagaaaaatctgacagcatggcatcgttgcactctgaattatcatctcttcagaaaaaaaggaacctcagatgctgaggaacgggtgggaaaagctcatgcgaaagctcttgaattgcagaaacaggttgataaacttaaaactgaactagaagcaaaattgaaggataaagattatttggaatcccgtgcaactaaagctgagaacaagttgaatgaattgaatttgcagctagagaatcttcaaaaagatcaataaggaacaggagaacaaactagcaaaaactgagcgagctctaaaaattgcagaggaagaactgataaaggcaaagtttgaggccacttcaaaggcaaatgagttgatggaggttcacagcgcatggctccaccttggcttgctacacagttaattcgtggtcaggccttcattcagacacattggaatcagcatggaaaaccaaacatggatatggtgatccagaaggctctagagagaaaggccttagctaaaaaagtgggctgaaccccacatggaagcaattaaaaaccaaatgggttccagctgctaaggatcagtgggtggcggtaactacatatgctgaaccacatgtgcaatcgctaactgcaaaaactgttgaaatttatgaggtatcgaaggctacaataactcctcatattatcaaagttcaagaaacagttgatccttacttccaggaagccaagaagttcagtaagccatatattgatcaggttgctactttagcaaagcctcatgttgataaaatttctgtggtgatgaagccctatacaaaggaggtagttaaagcttatgggaggtttttggaatcagcaacaacataccatcaacaggttcaagcctctgtgcaagaaactttgaagaagcatgagctgacaagacctcttgcaaccaaagagcttgagtggttttcggcatctgctctattggctctacctattattattttgttcagaatattttcagcaattttctgcaaaaagacaaagaagcgtgttcgacatactaatgcagtccaccatggtcgtcgtaagggcaaaagggggcacacagacaagtagactgcgtgtatttaggttttggtctctgaatgttgggaaatattagaggggctctaggtgatcatgttgggtagggagctgtggtgttgcaattgggaagtatttaatcttctcttacctctcaaggtccctggttttaatattattattattttttggggagggtgtggaattagaaaaagttaagaaccctagtgacgctacaaggttgaaatcttgagattcctagttgtaggagttgtgtattttattaatgttagtgtaattttattttattttgtttttctttctactggattcacaaacgaaacaaatcagtctctgtttcagaaatcatcata

SEQ ID NO: 9174 - DNA, 2602 bp, Theobroma cacao
aggtgtggcttaacttgtcccacctaccctacccgccttgatttgtgcaccattcgaattcaattgccatcaaatcagccctccctccttcatcatacgccacgcgctcttctttagagatacttagaatcttcgacagccacgtgtcggtctgcgtcctttagttgttctttcctcaaggattctttcatggaccggctgggactagttcgctcataacaaaaaaaaatctggattcgacaatccgactattctatttcttcaacgattgcttttgtatggggataaaataattgccacgtttcgtgagggagagcgaaaatccaagtttaaacaatttaataatattattttattcagaaggggaagaaagaaaaggatttgcaaattgttgaatcgatcaatcagtcagaagttgaaaccgccccttgcttctgtttggcctgtgcgggtgttagtttttcctcctcggcgagttttggtggctaagtaactggctgatggcggcctcaaagctcgtgattttctccctctttgtagccctaattttcgcccaagttagagcggatgcctcgatcgaacccgtgcctgaatcggccggcgccgattcctctgctcgtaagattgagttggatcaactcaaggctaagatccgtcttcttgaatcaaatgatgaggaaaaaactcgagaattgaagaccaaggatgagttgataaagcagaaagagaaaatcattcaagagaaatccgacagcattgcatccttgaacactgaaatatcatctcttcagaaaaaggggacttcagatgccaaggagcaagtggggaaagctcacgcgcgggctcttgaattgcagaaacaggttgatacacttaaaagtgaattagaagcaaaattaaaggacaaagattccttggaagcccgtgcaactgatgctgagaacaagttgactgagttgaatctaaagctagagaatcttcaaaagatcaataacaagcagaagagcaaaatagcaaaaactgagagagctcttaaagttgctgaggaagaattgatgaaggcaaagtttgaggccacttcaaaaacaaacgagttgatggaggttcatggtgcgtggctcccaccttggcttgctgtgaagttaatccattgtcaggcctttgttcagacacattggaatgagcgcggaaaaccggccatggatatggtgatccagaaggctctggagaaaaaggccttagctgaaaagtgggctgaaccccgcatggaaacaattaaaactaaatgggttccagctgtaaaggatcagtggttggttgtaactacatatgctgaaccacatgtgcaattgctaactgcaaaaacagttgaagtttatgaggtatcaaagagtgctataactcctcatattatcaaagttcaagaaatagttgatccttacttccaggaagctaagaagttcagtaagccatacattgatcaggtggctactttagcaaagcctcatgttgataaagttcgtgtggtgatgaagccctatacgaaggaggtagttaatgcttatgggaagtttttggaattggcaacaacataccatcatcaggttcaagcctctgtccgggaaatgctcaagaagcatgagctgacaagacctcttgcaaccaaagagcttgagtggtttgcagcatcagctttattggccctacctattatcattttgtttagaatatgttcagcaattttctgcaaaaaggcaaagaaacctgttcgacatgctaataccaaccagggtcgtcgtaaggccaaaagggggcacccagacaagcagactgcatgagtttactttctagtctctttattttgggaaatctagagactggacgtgtgttcgttggggttagaagtttcatcttggatacgaagctttgattttgcatttgaagctatggaatcttttcttaaccccccgacttccctctttttctttttgaggaaaaattgaaaaaaagctcagaaccctttcccgctacacagttgaatcttgagatatctcaaatctaggagtttgtgtatcatggccgatgttggttatttctgttagtgtaattttattttttattcttctagattcacaaaggagagaagttttacgttttagaaaccatacttttagttgcaacaccaatgggacgtgctaccgttgtgtccatacacgtttagtcaaaaggttaatgctaaacaagttattttagatttgatttcttattgcctgcatcattcgttcattcattcattgattttccggattggcctctggcgtctgcttgcgcttggttctggatttgttagctgttaaaacattggcttgcgtgatattttggacaaaagatggcaaaacaaaggtcaaaaggttagacaaaacaaaagaggatactgatattcctagttttcagggtagtgactgtttgacccgatgaacttcccagcgtgatgcaggggagtgaagaagtattccaaactaaacagatactcgtgattaactagtctagcagatactcgtgattaactagtctattactggaacaaacttggaggaaattt

SEQ ID NO: 9175 - DNA, 1024 bp, Gossypium raimondii
ctcatttttctttggaaacaaaaaacaaaaaatagaaaaaataaagagcaagagatatggcaagcacattctcttataattcttttggattccttctcattcttgtcgcctttagttcattgataaatataagttcagctggtaggcaaattgcccctaaaactagcattgagtttatcagaacatcttgtagttcaacgacttaccctaaactttgttacgaatctctcttaacacaggctagcatgatccaaacaagcccccaactcatcgcccatgcagccctaaacgtgaccctttcaaccgccaagtcaacctcggccatgatggtgaagcttgccaaaagccaaggattgaagcctacagaggtgggcgccatgcaagattgcgtggaggaattggaggacacgatagatgagctgagaaagtcaatcagcgagatgggtcagattaaaggctccaattttggactaatgattaacgatatacagacatgggttagcgctgctttgacggatgagaacacctgcgccgacgggtttggagggaaaaacatgaacggcagtataaagactgctgtgagatccaagattgtcacaatcgctcatttgacaagtaatgccttggctttggtcaacagctatgcttcatttcatggttagctatttaatcaactgtacaggggaaatttagtcattatttacggtagcaattgtatttatggatttttagaaactacttctgttttcctggtaaatgtaaaatatatatgtggtccaaagaagggaatggagatgtgtgtgtgtgtgtgtgatcttggtgtcttaatgaaaatgaacggagtgatctatattatgtgcacacgttgtatctgtacaataaattgctttttgtgaacatagtaaaagtaaagttgatgaagcctctgttgcagcatacaagcagaggttttagtttgttgcaagtacatctggtcttgatgttgtatagacatagtagtattattttgatctcatatttttgt

SEQ ID NO: 9176 - DNA, 2483 bp, Gossypium raimondii
cgatttgtgttacctcgtgaacacaacttgtccctaatttttccaataagggttggcccttaaggcctagttaggaccaattacatcacgaatgctagaattacgcacatgcacatgcacatgcggtaacattttccctataaatcgcaggcctttgcctccaccattttcatcattccagttgctctcatttttctttggaaacaaaaaacaaaaaatagaaaaaataaagagcaagagatatggcaagcacattctcttataattcttttggattccttctcattcttgtcgcctttagttccttgataaatataagttcagctggtaggcaaattgcccctaaaactagcattgagtttatcagaacatcttgtagttcaacgacttaccctaaactttgttacgaatctctcttaacacaggctagcatgatccaaacaagcccccaactcatcgcccatgcagccctaaacgtgaccctttcaaccgccaagtcaacctcggccatgatggtgaagcttgccaaaagccaaggattgaagcctacagaggtgggcgccatgcaagattgcgtggaggaattggaggacacgatagatgagctgagaaagtcaatcagcgagatgggtcagattaaaggctccaattttggactaatgattaacgatatacagacatgggttagcgctgctttgacggatgagaacacctgcgccgacgggtttggagggaaaaacatgaacggcagtataaagactgctgtgagatccaagattgtcacaatcgctcatttgacaagtaatgccttggctttggtcaacagctatgcttcatttcatggttagctatttaatcaactgtacaggggaaatttagtcattatttacggtagcaattgtatttatggatttttagaaactacttctgttttcctggtaaatgtaaaatatatatgtggtccaaagaagggaatggagatgtgtgtgtgtgtgtgtgatcttggtgtcttaatgaaaatgaacggagtgatctatattatgtgcacacgttgtatctgtacaataaattgctttttgtgaacatagtaaaagtaaagttgatgaagcctctgttgcagcatacaagcagaggttttagtttgttgcaagtacatctggtcttgattttgtatagacatagtagtattattttgatctcatatttttgtaactcatttaagactacttaataactttactaaatgcaaattttgtttcaaacgtcaagattaatttggtattcaaaaatatcttgtacttgaaattatgagaattttcgatattaatatattcgagcattcaacttccactacaaattctgggcccttagtccctacccaatgatgattgcctaccccgtacttagttgcatactttcttggtttaattattagaataaatatctgtccttagtttattagttgtttttttcttcggtaaaaatatgctcacacttgactcgattgttggatccaaatataagtacaacatttgttgtccaagtaactcaaagtgacttccacttcaattgcaattttgaacatcaattattcgttactcatttcaatactaagtgattaaaaacaatttcaattcatttaaaatgaatcaaaaacattttaaaatgaattctaggtgttcggaggtgatcgggaccaagttcgagtctcaagtgttaaaatgagcccatttaaaatgaattagaaacacacctgtaaggctataatgagcccatttaggcataacactctcaactgattgaaaacatagtagaatgagtctcatgatataggctcataattttcctttgcacatttagtgggattgaatgcttatcccaccacgtcacgctaatggataaagagacctctcttataaataacctgatgaacaaggaagaaaggatcgatggccaacaccctaaaattacatcttgatcttgatcgacatatcctcttgtccctattctgactcttgacatctttaagtgaaccgacctccatttctcctccttattctcctcccttattctacactgtatcaacacaaatattcaccattcaatccaagaccaataagaggtggtaagtggtgttggactctaatatcgtttgtattctattaatccaatcattacgggattaagtaatcagacattgggtacttgtatccttcaaaaaataaccccaataattaacttaaaaagagagagaaaaactaaccctgtaatcattttccggtggggaattttggcatccaaaataggagtatcctctccttacgttatgttttcaataaaaatcataaatgaaaaaaataatgtatataatatattgttggtatatcagtctgtacaataaccataaattttgaagaattcatttcatataaatagttttttttaaatttatttaatgtgttatgaacaaataaaaaacaaaa

SEQ ID NO: 9177 - DNA, 1276 bp, Gossypium hirsutum
tctcattcttgtcgcctttagttcattgataaatataagttcagctggtaggcaaattgcccctaaaactagcattgagtttatcagaacatcttgtagttcaacgacttaccctaaactttgttacgaatctctcttaacacaggctagcatgatccaaacaagcccccaactcatcgcccatgcagccctaaacgtgaccctttcaaccgccaagtcaacctcggccttgatggtgaagcttgccaaaagccaaggattgaagcctacagaggtgggcgccatgcaagattgcgtggaggaattggaggacacgatagatgagctgagaaagtcaatcagcgagatgggtcagcttaaaggctccaattttggactaatgattaacgatatacagacatgggttagcgctgctttgacggatgagaacacctgcgccgacgggtttggagggaaaaacatgaacggcagtgtaaagactgctgtgagatccaagattgtcacaatcgctcatttgactagtaatgccttggctttggtcaacagctatgcttcatttcatggttagctatttaatcaactctacaggggaaatttagtcattatttacactagcaattgtatttatggatttttagaaattacttctgttttcctggtaaatgtaaaatatatatgtggtccaaagaagggaatggagatgtgtttgtgtgtttgtgtgtgatcttggtgtcttaatgaaaatgaatggagtgatctatattatctgcacacgttgtatctgtacaatacattgctttttgtgaacatagtaaaagtaagttgatgaagcctctgttgcagcatagaagcagaggttttagtttgttgcaagtacatctggtcttgatgttgtatagacatagtagtattattttgatctcatatttttgtaactcatttaaaactacttaataactttactaaatgcaaattttgtttcaaacgtcaagattaatttggtattcaaaaatatcttgtacttgaaattatgagaattttcgatattaatatattcgagcattcaacttccacttcaaattctgggcccttagtccctacccaatgatgattgcctagcccgtacttagttgcatactttcttggtttaattattagaataaatatctgtccctagtttattagttgtttttcttcggtaaaaatatgctcacacttgactcgattgttggatccaaatataaggtacaacatttgttgtccaagtaactcaaag

SEQ ID NO: 9178 - DNA, 4103 bp, Theobroma cacao
catgatccaacgcaccgcattatcccaagcttaaaacgcaaccgtcttgcctaatgttgacgctgaactgaggaaaaggaaagaaaaagacagcgagggaaacacgatcacaagaagcgctgatgaacaatccagaagagtgcgaggccaacgacctgcaacaacgaaaacaacaagaaccagagatggcagcctcatcggcggcgatggatggggtggcagcagcggctatccggtctgtactccagagagtccaccaggccgctgaacggtcgggtcgggaatcgcagcggatccgcgtggttgccgtcagcaagacgaaacccgtctctatccttcgccaagtctacgacgctggtcatcgctgtttcggagaaaattacgtccaagaactagtcgaaaaagcccctcagcttccaggtgacactgagtggcatttcgttgggaatttacagagcaataaagtgaagcctttgattgctggagtgccaaaccttgcgatggtggagactgtagatgatgagaagattgcaaatcatcttaatcgtgtagttggcagctttgaaagaaagcctttgaaggtcttagtccaggtgaataccagtggagaggaatcaaaatctggtgttgagccttcaggttgtgtggaacttgtgaaacatgttagtttgaactgcccgaaccttcagttttgtggattgatgacaattgggatgcttgattatacatcaaccccagagaacttcatgacattagcaaattgcagaagtgaggtctgcaaggcacttggaatacctgaagagcaatgtgaactatcaatgggcatgtctggtgactttgagcaagctattgaaatgggcagtaccaatgtcagaattggatcaaccatctttggggtgagggaatatccaaagaaaacatgaaactagcttactagttacatgacaagcacgttcctttgatcgtcattgcattgttatagaaagggttgtactcaactcgatcctcaggatgttattttttacactgggttgatgtggttcaatcccagcctgtacggtggttgtaaccatatattgaaaatgagaaagtacactgatcttggaagccatggaacttgtttattccatccaaatgatgctaataaactgtattcaattgatctgaaattcaattcttgtagttcaattgaacatttaaccctctggcttggtgtagcgtttaccttactaacatgatgaaacgggtataaaccatgaactagacatacaagcaaagaactagtctttgtaaaaccttcccaagattcaactttgggtgcctttcaaaaagataggatgagtgatgaacaaaataagatccgttcctaccagcagcactaaatccttcaattccatcatcaacaacctctcgtcacaagggtcctaccatgaagtcctcgtcacctacacgaccatgctcaactctagcactcctgactcctacacgttccccagcctcctcaaagcgtgcacgtctctaaacctcttctccattggcctttccgtacaccaacaagttatacttcgtgggttttcttcagattcttacactgcatcttctttgatcaatttttactcgaaattcggtcacacgaaacacgctcgcaaggtttttgataaaacgctaaacagagatgttgttccctggactgccatcattggctgctatggtcgtggtggtgacgtgggcaatgcgttttctatgcttaatgaaatgcgatacaatggggttgagcctagtccggttactttcttaagcttgctctctggagcattggaggtagcacaagtgcaggctttgcatggatgtgcggttttatatggctttgagtccgatatagctgtgggaaattcgttattaaatgcgtatagtaaatgtgggagcattggggaagcaagaggtttgtttgaattgatggaccaaaaagataaaatttcatggaattctttgatttcaggttatgctcagttagggaatgttgaagaaattttgcaacttttatatgcaatgaagatagaaaatatgggacctgatcagcaaacttttggttctttggttactgctgttgcagcgcagagtacgcttgatataggaagggtggtgcatgggcagattttaagaagtgggtttgattcagatgcgcatattgaaacagcacttatggttatgtatttaaaatgtgggacaactgatgctgcatatcagatttttgaaggggtatcacaaaaagatgtggttttatggacagcaatgatctctgggctagtgcaaaataattttgcggacaaggcactgacagttttctatcagatgatgaagtcaagagtagagccatctactgccaccctaactagtgctcttgctgcatgtgcacagttgggttcttttgatttagggacctccatccatgcttacattttaaggcatggattgacaatagacattccagtccaaaactctctggttaccatgtatgccaagtgtggtcatttggagcaaagttgtgcagtttttgagaggattaataaaagggatttggtttcttggaatgcaataatttctggatgtgcccaaaatgaccatttatctaaagccttgttcttcttcaataaaatgaggttaacccttcaaaaacctgattcattaactgctgtcaccctgcttcaagcctctgcatctactggggctctccatcagggaaagtggttccacaactttgtaattagaagttgtcttaggccatgcatcttggtggatacagctctggtggacatgtactgtaaatgtggtgatttagacgctgccgttaagtgctttagggtgatgtcacaacaggacttaatctcatggagcacaatcattgcaggatatggtagtcatggcaaaggggagatggctttaaacatgtattttgagtttctgcactctggaatggaaccaaataaggtgattttcctttcagttctctctgcctgcagtcacaatgggcttgtggatgagggtctgagcatattccagtcaatggctagagattttgggattcaaccagaacttgagcaccgtgcttgcattgttgatctcctttgtcgagctggaagggtggaggaagcttacaacttctacaaggggaacttttcagagcccgctgttgatgttttaagcatactccttgatgcctgtcgggcaaatgataacctggaacttggtgatgttattgcccaagatgtcatcaggttgaggcctgcaagtgcagcgaactatgttcagatagcacactgttatgcttccatgagtagatggaatagcgtgggggaagcatggtcccaaatgaggtctcttggcttgagaaaactaccaggatggagtttcattgacctgcatggtacagttacttcatttttgtctggtcaaaatgcacatccaaaacatgaagaaatagttgcaacactgaaaactttgagctgggaaatgagtgaagtgtgcatgaacttcaagatgcatcaaattcttgatatattcttagaaactcagtcgatattaaatgcctctgagtgcattcacttggtcaaaactgaacagcaacaagattctcgtactcagttgttcaacttccgtgaacagggagagaacagagagatgaaaatgacactggaacacaacaaaagcggtgacaatggcaaaggttaatatgtacgacaggacacattatgggactgtactggcagtgaagtaaggttggtatttttggctccaatgcttctaaacccaaataggtcttttctttatttattagggatcataaatttcaatttctactgtcaaattgaagaacattttagcgttcggtggtcgggtaggaagatcgaattaatttccaaggttggaatttactgatatagttctgtattctaaaaaattaattgcagtaataaattagtctgaaacatccacacacatgagggctaagacttttttccggggtatatggtgaatcacatgtaatcctttccttatttgttatacaaaattggatgttgcaataacagatttagaaagttttc

SEQ ID NO: 9179 - DNA, 1114 bp, Theobroma cacao
aatgttgacgctgaactgaggaaaaggaaagaaaaagacagcgagggaaacacgatcacaagaagcgctgatgaacaatccagaagagtgcgaggccaacgacctgcaacaacgaaaacaacaagaaccagagatggcagcctcatcggcggcgatggatggggtggcagcagcggctatccggtctgtactccagagagtccaccaggccgctgaacggtcgggtagggaatcgcagcggatccgcgtggttgccgtcagcaagacgaaacccgtctctatccttcgccaagtctacgacgctggtcatcgctgtttcggagaaaattacgtccaagaactagtcgaaaaagcccctcagcttccaggtgacactgagtggcatttcgttgggaatttacagagcaataaagtgaagcctttgattgctggagtgccaaaccttgcgatggtggagactgtagatgatgagaagattgcaaatcatcttaatcgtgtagttggcagctttgaaagaaagcctttgaaggtcttagtccaggtgaataccagtggagaggaatcaaaatctggtgttgagccttcaggttgtgtggaacttgtgaaacatgttagtttgaactgcccgaaccttcagttttgtggattgatgacaattgggatgcttgattatacatcaaccccagagaacttcatgacattagcaaattgcagaagtgaggtctgcaaggcacttggaatacctgaagagcaatgtgaactatcaatgggcatgtctggtgactttgagcaagctattgaaatgggcagtaccaatgtcagaattggatcaaccatctttggggcgagggaatatccaaagaaaacatgaaactagcttactagttacatgacaagcacgttcctttgatcgtcattgcattgttatagaaagggttgtactcaactcgatcctcaggatgttattttttacactgggttgatgtggttcaatcccagcctgtacggtggttgtaaccatatattgaaaatgagaaagtacactgatcttggaagccatggaacttgtttattccatccaaatgatgctaataaactgtattcaattgatctg

SEQ ID NO: 9180 - DNA, 918 bp, Gossypium raimondii
aaaccacgctaatggagaagctcctgccacgtctccgtgtcagaaaccatggccatctctcatgttccatattacttgtcaaaattgccttctccattgttcaattgccgtttggcggccaagagaatctcagaattttccatggagaatccgcaacaccctgaaggcaaagaagcatgtgaatccaatccaaccaacgtgaagcgtgtatccgatgatataatgcctcaccttcttaacttatatggatctcgtgccacaccacgcgactttgaaatatatgccgcggacgcttcttttgaagaccctctcatgtgtgctcatggagtgaaacaaatcaaatcatcattttattcgctttctaaggtttttagtgaatcaagaatcgttgaatatagcattactgaaaaagaaatttcagccggaaagcatgaggtattagttgacaacaaacaacaatacaagttcttgggaagaaacatagatatgatatcattgatcaggttgtatgttaaggacggaaaagttgttcgtcacgaagattggtgggataagaagcctcttcggaatagagaaacagttaagcttccatgtgtcggccgaatgattgaactgactcgtaggggttcgatgttcgtaactcatgctttaatggggttcggaaaggatcctcctaccggatgatgctacaagtcgactgtatgcaagtccgtctcgatgtcatattcttagttatattcatatcaaatttcatgttgttaaacttttttctattctgatcacgtgttaatcttgagattttaatcaacatttccgctaaaaagaataaggattaaattgataaaaaatgtaaacatacgaactaaattttgcattatgccaatatgaaaatgcttagcttaagccaatctacccgtt

SEQ ID NO: 9181 - DNA, 828 bp, Gossypium hirsutum
ctcctgccacgtctccgtgtcagaaaccatggccatctctcatgttccatattacttgtcaaaattgccttctccattgttcaattgccgtttggcggccaagagaatctcagaattttccatggagaatccgcaacaccctgaaggcaaagaagcatgtgaatccaatccaaccaacgtgaagcgtgtatccgatgatataatgcctcaccttcttaacttatatggatctcgtgccacaccacgcgactttgaaatatatgccgcagacgcttcttttgaagaccctctcatgtgtgctcatggagtgaaacaaatcaaatcatcattttattcgctttctaaggtttttagtgaatcaagaatcgttgaatatagcattactgaaaaagaaatttcggccggaaagcatgaggtattagttgacaacaaacaacaatacaagttcttgggaagaaacatagatatgatatcattgatcaggttgtatgttaaggacggaaaagttgttcgtcacgaagattggtgggataagaagcctcttcggaatagagaaacagttaagcttccgtgtgtcggccgaatgattgaactgactcgtaggggttcgatgttcgtaactcatgctttaatggggttcggaaaggatcctcctaccggatgatgctacaaatcgactgtatgcaagtccgtctcgatgtcatattcttagttatattcatatcaaatttcatgttgttaaacttttttctattctgatcacgtgttaatcttgagattttaatcaacatttccgctaaaaagaataaggattaaattgataaaaaa

SEQ ID NO: 9182 - DNA, 978 bp, Gossypium raimondii
tactaacgtaaaaaaagaaaaaccacgctaatggagaagctcctgccacgtctccgtgtcagaaaccatggccatctctcatgttccatattacttgtcaaaattgccttctccattgttcaattgccgtttggcggccaagagaatctcagaattttccatggagaatccgcaacaccctgaaggcaaagaagcatgtgaatccaatccaaccaacgtgaagcgtgtatccgatgatataatgcctcaccttcttaacttatatggatctcgtgccacaccacgcgactttgaaatatatgccgcggacgcttcttttgaagaccctctcatgtgtgctcatggagtgaaacaaatcaaatcatcattttattcgctttctaaggtttttagtgaatcaagaatcgttgaatatagcatcactgaaaaagaaatttcagccggaaagcatgaggtattagttgacaacaaacaacaatacaagttcttgggaagaaacatagatatgatatcattgatcaggttgtatgttaaggacggaaaagttgttcgtcacgaagattggtgggataagaagcctcttcggaatagagaaacagttaagcttccgtgtgtcggccgaatgattgaactgactcgtaggggttcgatgttcgtaactcatgctttaatggggttcggaaaggatcctcctaccggatgatgctacaagtcgactgtatgcaagtccgtctcgatgtcatattcttagttatattcatatcaaatttcatgttgttaaacttttttctattctgatcacgtgttaatcttgagattttaatcaacatttccgctaaaaagaataaggattaaattgataaaaaatataaacatacgaactaaattttgcattatgccaatatgaaaatgcttagcttaagccaatctacccgtttggttcagcaatctcgacccgcatgaactaggccttgaatg

SEQ ID NO: 9183 - DNA, 776 bp, Gossypium hirsutum
ccgttgtgtcagaaaccatggccatctctcatgttccatattacttgtcaaaattgccttctccattgttcaattgccgtttggcggccaagaaaatctcagaattttccatggagaatccgcaacatcctgaaggcaaagaggcatgtgaatccaatccaaccaacgtgaagcgtgtatccgatgatataatgcctcaccttcttaacttatatggatctcatgccacaccacgcgactttgaaatatatgccgcggacgcttcatttgaagaccctctcatgtgtgctcatggagtgaaacaaatcaaatcatcattttattcactttctaaggtttttagtgaatcaagaatcgttgaatatagcatcactgaaaaagaaatttcagccggaaagcatgaggtattagttgacaacaaacaacaatacaagttcttgggaagaaacatagatatgatatcattgatcaggttggatgttaaggacggaaaagttgttcgtcacgaagattggtgggataagaagcctcttcggaatagagaaacagttaagcttccgtgtgtcggccgaatgattgaactgactcgtaggggttcgatgttcgtaactcatgctttaatggggttcggaaaggatcctcctaccggatgatgctacaagtcgactgtatgcaagtctgtctcggtgtcatattcttacttatattcatatccaatttcatattgttaaactttttcttttctgatcacgggttaatcttgagattttaatcaa

SEQ ID NO: 9184 - DNA, 3979 bp, Trigonella foenum-graecum
attagtccatatctgttaggagagagaaagtttaagaatcaagagactttgtgttgtgggtttggtactttggttccattttcggagttttctttgttgttggtgttattctcatgtttgtttgatgtgtttggtttttcaagccaagatctagttcagtattgcagattttagtgtggttaagatgtcatctctgagtagggaattggtgttcttgatcttgcagtttctggatgaggaaaagttcaaagaaactgttcacaagcttgagcaagagtcaggatttttcttcaacatgaaatattttgaggatgaagttcataatgggaattgggatgaagttgaaaagtacttatctggtttcacaaaagtagatgataataggtattctatgaagatattttttgagataaggaagcaaaaatatcttgaggcattggataagcatgatcggtcgaaagctgtagagatactagtgaaggatttgaaagtgtttgctacgtttaatgaagaattgttcaaggaaatcacacagcttttgacactggagaattttagggaaaacgaacagttgtcgaagtatggtgatactaagtctgcacgggcaatcatgttggttgagcttaaaaagctcattgaagcaaatcccttatttcgcgacaaattgcaatttcctaaccttaaaaattcaaggttaaggacactcatcaatcaaagcttgaattggcagcatcaactatgtaagaatccgcgtccgaatcctgatataaaaactctttttgtggatcactcatgcggacaaccaaatggtgcacgagctccttcgcctgctaacagtccgctattaggatccttaccgaaagcagctggtggatttcctcctcttggtgctcatgggccttttcaacctaatccggcagcagtgccaacacagcttgctggttggatgtcaaatcctaccactgtagcacatgctgcagtttctggtgcaggagctataggtcttggtgctccatcaatgcccggtgctttgaagcatccgcggacgcctccgattaatccttctgtcgactatccatccggtgattcagatcatgttgctaagagaacaaggccaatgggaataacagatgaggtaaatctacctgtcaatgtgttgtcgggaacattcccaggtcatggtcatagtcaggcttttaatgcacctgatgacttgccgattccaaaaactgtcatgcgaactctgaatcagggctcatctcctatgagcatggactttcatccagttcaacaatctttacttctagttggtacaaatgtgggggacattgccttatgggaggtgggttctagggagcggttggtctcgaggaacttcaaagtttgggatcttagtgcatgtacaatgccatttcaggctgctcttgtcaaagatccaagtgtttctgttaaccgtgtgatttggagtcccgatggtgccttatttggcgttgcatactcgaggcacattgttcagatatactcttaccacggtagtgatgaagttcgacagcacttggagattgatgctcatgttggtggagtaaatgatctagcattttcccatccaaataagcaattgtgtgtgataacctgtggtgatgataagaccattaaggtgtgggatgctgctacgggaacaaagcagtatacatttgaaggtcacgaggctccagtttattctgtctgtccgcattataaagaaaacattcagttcatcttttcaacagcgctagacggcaaaataaaagcatggttgtatgacaatttgggatcacgtgttgattatgatgctcctggtcggtggtgcacaaccatggcttatagtgctgatggtacaaggctcttttcatgtggaacaagcaaagatggagaatcctctattgtggagtggaatgaaagtgaaggagctgtgaaaagaacttaccaagggtttcgtaaacgatctatgggggttgtgcagttcgatactaccaaaaatcggtttttggctgctggtgatgatttctccattaaattctgggatatggacaatattcagcttatgacaacagttgatgctgatgggggtcttcctgcaagtccacgtattcgtttcaacaaggatggaactcttttagccgtctcagcaaatgataatggaatcaaaattatagcaaatgctgatggtattcgtttattgcgtacattagagaattcgatgtacgatgcatcaagagcatcagaattggcaaagcctactataaattcaatgtcttctgctgccgctgcaactagtgccgcactagcggagagagcctcttctgtagcagctattactggaatgaatggtgattctcgaaacatggccgatgttaaacctagaataagtgaagaatccaatgacaagtcaaagatatggaaactcactgaaatcaatgaaccatctcattgtagatccttgaagctaccagagaatgttagagtaaacaagatatcaaggttgatatacacaaattcaggtaatgctattctagcattagcatcaaatgccattcatcttctctggaaatggccacgaaatgaacgtaactcaactggcaaggctaatgcttctgtgcaagctcagttgtggcaaccatcaagcggcatcctgatgactaatgacaccgctgatagcaatcctgaagattctgttccgtgctttgctctgtccaaaaatgattcgtatgtaatgtctgcatcaggagggaagatatccttgttcaacatgatgacttttaagacaatgacaactttcatgcctgcaccacctgcagcaacctttcttgctttccatcctcaggataacaatattatcgctataggcatggatgattcctccattcagatatataatgtccgtgttgatgaggttaaaagtaaactcaaaggtcatacaaaaagaataactggtcttgctttctctcatgtattgaatgttcttgtttcatctggagcggatgctcagatttgtgtgtggaatactgacggatgggaaaaacagaagactagattcttgcagctacctcctgggaggactccatcagcacagtcggatacgcgtgtacagtttcatcaggatcagatacagttcttggttgtacacgaaactcagcttgccatttttgaagcaactaaactagaatgtctaaagcagtgggcaccacgggattcttctgcaccaatatcgcatgcaaccttttcgtgcgacagccagttgatatatgcaagctttttagacgcaaccgtctgtgtatttaatgcttcaaatctcagattacggtgtcgtatcactccttctgcttatctgcctgcaagtgtcagcaattcaaacgtacaaccactggtaattacagcacatccacatgaaccaaatcagtttgctgtaggactatcagatggtggagttcatgtgtttgagccactcgaatccgaaggcaaatggggtgtgccgcctccgaacgagaacggatcatctagcaataatgtagcagtagctacttcagttggactttcttcagaccaagcacaaacatgaaatgataaattgaatccattttcagccaaaagacaagtttcttttacatacttggcttgttggtcattttcaagaactaaattaatcttgtacttttgtttatgcagctggattttatccaaattagtatatgttctaatgaagcataatcatgtcatgctggaacagctaatttggttgaaaccaaaactacattgtgattttccaatagatgtgaattttttagttttttatagtttaatttaatgctacaggtgtagaaatgtttgaagtattttaagctgtttcattacttagtgccttttatttgttccattcaattatggcatgtaacttatttactaggccataatatttttaaggcaaagctggttctttgac

SEQ ID NO: 9185 - DNA, 4092 bp, Cicer arietinum
tatcttatcaagttattttgataagtggtttaacttatcacctcctcattctgtcgcctcctatataaaaaaaaacctatttctgcaagttcaaatgtccccttctctctctatttatatttaggagtttctagagagagaaagagtagattagtccatttgtgtgaagtgagagaaagtgttaagaattagaaaaaagagagagtttttggtctttttgggtgactttgtgtggtgggtttggttccatattcggagtcttctttgttgttgttctcatgtttgtgttctgtgaagacaagatctagttgagtgttggtgattttagtgtggttaagatgtcatctctgagtagagaattggtattcttgatcttgcagtttctggatgaggaaaagttcaaagagactgttcacaagcttgagcaggagtctggatttttctttaacatgaaatattttgaggaagaagttcataatggaaattgggatgaagttgaaaagtacttatctggtttcacaaaagttgatgataatagatattctatgaagatattttttgagataaggaagcaaaagtatcttgaggcattggataagcatgaccggtctaaagcggtagagatattagtgaaggatttgaaagtgttttctacatttaatgaagaattgttcaaggaaatcacacagcttttgacattggagaattttagggaaaacgaacagttgtctaagtatggtgatacaaagtctgcgcgagcaatcatgttggttgagcttaaaaagctcattgaagcaaatcccttgtttcgcgacaaattgcaatttcctaaccttaaaaactcgaggttaaggaccctcatcaatcaaagcttgaattggcagcatcaactttgtaagaatccgcgtccgaatcctgatataaaaaccctttttgtggatcactcatgtggacaacaaccgaatggtgcacgagcgccttcacctgccaacagtccgctattaggatccttaccgaaggctggaggatttcctcctcttggtgctcatgggccatttcaacctacaccggcgccagtgccaacacctattgctggttggatgccaaatcctacaactatagcacatgctgcggtgtctggcggaggagctataggtcttggtgctttgaagcatcctaggacccctccaactaatccttcagccgactatccatcgggagactcggatcatgttgctaagagaacaaggccaatgggaataacagatgaggtaaatctacctgtcaatgtgttgtcaccaacattccaaggtcatggacatggtcatggtcagtcgtttaatgcacctgatgacttgccgttgccgaagactgtcatgcgaacattgaatcaaggctcatctcctatgagcatggactttcatccggttcaacaatctttacttctagttggtacaaatgtgggggacattgccttatgggaggtgggttctagggaacggttagtctcgaggaacttcaaagtttgggatcttagtgcatgttcaatgccatttcaggcttctcttgtcaaagaaccgagtgtttctgttaatcgtgtgatttggagtcctgacggtgctttatttggagttgcttactcgaggcacattgttcagatatactcttaccatggtggttatgaagtacgacaacacttggagattgatgctcatgttggtggagtaaacgatctagcattttcccacccaaataagcaactatgtgtgataacttgcggtgatgataagaccattaaggtgtgggatgctgcttcgggagcaaagcagtatacgtttgaaggtcacgaggctccggtttattctgtctgtccacattataaagaaagcattcagttcatcttttcgacagcgctagacggaaaaataaaagcatggttgtatgacaatttgggatctcgtgttgattatgatgctcctggtcgatggcgcacaaccatggcttatagtgcagacggtacaaggctcttttcgtgtggaacaagcaaagatggggaatcttcaattgtggagtggaatgaaagtgaaggagctgtgaaaagaacttaccaaggttttcgtaaacaatctttaggtgtagtgcaattcgatactaccaaaaatcggtttttggctgccggcgatgatttctccattaaattctgggatatggacaatattcaacttttgacaacagttgatgctgatggtggtctcgctgcaagtccgcgtattcgtttcaacaaggatggaactcttttagcagtctcatcaaacgataatggaatcaaaattttagccaatgcagatggtattcgtttattgcgtacattagagaattctatatacgatgcgtcaagagcatcggaagccttggcaaagccaacaataaattcaatttcttccgcttccgccgcaactagcgctgccttagcagagagagcctcatctgcagcagctattgctggaatgaacggggatgcacgaaacatgggcgatgttaaaccgagaataagcgaagaatccaatgacaagtccaagatatggaagctcactgaaatcaatgaaccatctcattgtagatccttgaagctaccagagaatgttagagtaaacaagatatcgaggttgatatatacaaactcaggtaatgctattcttgcattagcatcaaatgccattcacctgctctggaaatggccgcgtaacgagcgtaactcgtctggcaaggccaatgcctcggtgcaacctcagttgtggcaaccgtcgagtggcatcctgatgactaatgacattgctgatagcaatccggaagattctgttccgtgctttgctctgtcgaaaaatgattcgtatgtaatgtcggcatcaggaggaaagatatccttgttcaatatgatgacttttaagacgatgacaactttcatgcctccgccacctgcggctacctttcttgctttccatcctcaggataacaatattattgctataggcatggatgattcctccattcagatatacaatgtccgtgttgatgaggttaaaagtaaactcaaaggtcatacaaaaagaataactggtcttgctttctcccatgtattgaatgttcttgtttcatccggagcagatgctcagatttgtgtgtggaatactgatggatgggaaaaacagaagacgagattcttgcagcttcctcccgggaggactccgtcagcacagtcagatacgcgcgtacagtttcatcaagatcaaatacagttcttggtcgtacatgaaactcagctcgccattttcgaagcaactaaactcgagtgtctaaagcagtggttcccgcgggattcttctgcaccaatatcgcatgcaaccttttcgtgcgacagccaactgatatatgcaagctttttagacgcaacggtctgtgtatttaatgcttcaaatctcagattacggtgtcgtatcagtccttctgcttatcttccttcaagtgtcagcaattcaaatgtacaaccactagtaattgcagcacatccacaagaaccaaatcagtttgccataggattatccgacggcggagttcacgtgtttgagccgctcgaatccgaaggcaaatggggcgtgccgcctccggtcgaaaacggatcaactagcaataatgtagcagtagctacttcagttggactaccttcagatcaagctcaaagatgatatgatgaaattgaatccattatcagccaaaaagacaagtttcttttacatacttggcttgctggccattttaattaatcttgtactttatagttaatgcaacttatttggttgaaaccaaaaactacattgtgatatttaccaatagatgtgaatttttttttaaagtttaatttaatgatacagatgtagaaatttgtttgagtactttttgaagctgttttattagattggttaatgttaacttattgctttttattagttccatttaagccttgcatataatgtaacttttactactaggtcaaacttcatcttcttataataatattgttatacttaaatatta

SEQ ID NO: 9186 - DNA, 4113 bp, Glycine max
cttatcacctccactatctgtcgcctcctatataaaaaacaccctatttctgcaagttcaaatgacctctttctctctctctatatattttcgagtttctagagagcgagcgagtagattagttcatttccgcgaggagagagaaagtgcaagaattggaagagagagagagagagaggtttggtttgtgatgtggtagctttgaagatctagttcactgttgctcattttagtgtgtatctaatcgaagacgagggggttccgatgtcttctctcagtagggaattggtgttcctgatcttgcagtttctcgatgaggaaaagttcaaggagactgtgcacaagcttgagcaggagtcagggtttttctttaacatgaaatattttgaggatgaagtgcacaatggcaattgggatgaggtggagaaatacctctctggtttcacaaaggtggatgataataggtattccatgaagatattttttgagataaggaagcagaagtatctggaggctttagataagcatgaccggtccaaggctgtagaaatattagtgaaggatttgaaagtgtttgctacatttaatgaagaattgttcaaggaaatcacacagcttcttacattggaaaatttcagggaaaatgagcaattgtctaagtatggtgatacaaaatctgcacgagcaatcatgttggttgagctcaaaaagctaattgaagcgaatcccttatttcgtgacaaactgcaatttcccaaccttaaaaactcaaggttacggactctcatcaatcaaagcctaaattggcagcatcaactttgcaagaatccacggccaaatcccgacataaaaactctttttgtggatcactcatgtggacaaccaaatggtgcacgagctccatcacctgctaataacccgctattaggtgccttaccaaaggctggaggatttcctccacttggtgcacatgggccttttcagcctactccagcaccggtgccaacacccctggctggttggatgtcaaatcctaccactgtagcacatgccgcagtttctggaggtggagctataggtcttggtgctccatctatgcctgctgctttgaagcatcctaggacccccccaactaatccttctgttgactatccatctggagactcagatcatgttgctaagagaacaaggccaatgggaatatcagatgaggtaaatcttcctgtcaatgtgttgtcagctacattcccaggtcatggtcaacatagtcaagcttttaatgcacctgatgacatacctaagactgttgtgcgaactcttaatcagggttcatctcctatgagcatggactttcatccaatgcaacaatctttacttcttgttggtacacatgtgggggacattgctttgtgggaggtgggttctagggagcggttggtctcaaggaatttcaaagtttgggatcttagtgcatgttcaatgccatttcaggctgctcttgtcaaagatccgggtgtttctgtcaatcgtgtaatttggagtcctgatggtgctttatttggagttgcttactcaaggcacattgttcagatatactcttaccatggtggggatgaaatacgacagcacctggagattgatgctcatgttggtggagtaaatgatctggcattttcccatccaaataagcaactatgcgtgataacttgtggtgatgataaaaccattaaggtatgggatgctgcttcgggtgcaaagcagtatacttttgaaggtcatgaggctcctgtttattctgtctgcccacattataaagaaaacattcagttcatcttttcaacagcattagatggaaaaataaaagcatggttgtatgacaatttgggatctcgtgttgattatgaagctcctggtcgttggtgcacaaccatggcttatagtgctgatggtacaaggctcttttcatgtgggacaagcaaagatggggaatcctccattgttgaatggaatgaaagtgaaggagctgttaaaaggacttatcaaggatttcgcaagcgatctttgggtgttgtgcaatttgatactaccaaaaatcgatttttggctgctggtgatgatttctccatcaaattctgggatatggataatgttcagcttttgactactgttgatgctgatgggggtctccctgcgagcccacgcattcgcttcaacaaggatggaacacttttagctgtctctgcaaatgagaatggaattaaaattttagccaatggggatggtattcgtttgttgcgtacgctagagaattctttatatgaagcatcaagagcatctgaagccttgacaaagcctacaattaatccaatttctgctgctgccgctgctgcaaccagtgctgcactggcagagagggcttcatctgtagtagctattgctggaatgaatggggatacccgaaacttgggtgatgttaaacctagaataagtgaagaatccaatgacaagtcaaagatatggaagctcactgaaatcaatgaacaatctcaatgtagatccttgaaactaccggagaatgtaagagtaaccaagatatcaaggttgatatatacaaattcaggtaatgctattctggcattagcatcaaatgccattcacctgctctggaaatggcagcgaaatgagcgtaactcatctggcaaggccactgctaccttgcaacctcagttgtggcaaccatcgagtggcatcctgatgacaaatgacattgctgatagcaatcctgaggatgctgtaccctgctttgcgttgtccaaaaatgactcgtatgtaatgtctgcatcaggagggaagatatctctgtttaatatgatgacttttaagactatgacaactttcatgcctccgccacctgcggcaacctttctagctttccatcctcaggataacaatattatcgctataggcatggatgattcctctattcaaatatataatgtccgtgttgatgaggttaaaagtaaactcaaagggcatactaaaagaattactggtcttgctttctctcatgtattgaatgtattagtttcatctggagctgatgctcagatttgtgtttggaatactgatggatgggaaaagcagaagtctagattcttgcagcttcctcctgggagaacaccaccagcacagtcagatacccgtgtacaatttcatcaagatcaaatacagttcttggttgtacatgaaactcagctcgccatttatgaagcaactaaattagaaggactaaagcagtggttcccgcgagactcatctgcaccaatatcgtatgcaactttctcatgtgatagccagctggtatttgccagctttttagatgcaacaatctgtgtatttagtgcttcaaacctcagattacgttgtcggatcaatccttcttcatatcttcctgcaagtgtcagttccaacatacaaccacttgtaatcgctgcacacccacaagaaccaaatcagtttgctttaggactgtcggacggtggagttcatgtttttgaaccccttgaatctgaaggcaagtggggtgtgcctcctccgattgagaatgggtctgcaagcaatgtggcagctacttcagttggaccttcagatcaagctcaaagatgatccatgtcagccgaaggcaagtttcttttacatacttggcttgctggccattttaagaactaaatttgtacttaagttaatgcagggcactctctccaattcagttgatccagctaagttaaatccatccatcgtacatgccaaaggtttggagcaactcatttggttggaagaccaaaatcacattgtaatttgccaatagatgtgaaaaattcttgttaagtttaatgctaagatgatgtacaagttcttttgagtactttcaagttgcttctagctatttaattagattggttgatcctaacatgttgccttttgtgagttccatttcagccttaccgtgctattcttgtccgcgtcgtcttcatcgttcccatattctctatttaaataacttttgaagaataaatcgtcagtttggttcctaaagtatagttctctccttaa

SEQ ID NO: 9187 - DNA, 4106 bp, Phaseolus vulgaris
aaatgacctctttctctctctatatatattttcgagttttctagagagagagcgagtagattagtccatttccgcgaggagagagaaagtgcaagaatcggaagagagacagagagcgtttggtttgtgatgtgttagctttgaagatctagttcactgttgctcatttcagtgtgtatctaatcgaagacgagggggttccgatgtcgtctcttagtagggaattggtgttcttgatcttgcagtttctcgatgaggaaaagttcaaagagactgtacacaagcttgagcaggaatccgggtttttctttaacatgaaatattttgaggatgaagtgcacaacgggaattgggacgaggtggagaaatacctctccggtttcaccaaggtggatgataataggtattctatgaagatattttttgagataaggaagcagaagtatctggaggctttagataagcatgaccggtctaaggcagtagaaatattagtgaaggatttgaaagtgtttgctacatttaatgaagaattgttcaaggaaatcacacagcttctgacgttggaaaactttagggagaatgaacaattgtctaagtacggtgatacaaagtctgcacgagcaatcatgttggttgagctcaaaaagctcatcgaagcaaatcctttatttcgtgacaaattgcaatttcccaaccttaaaaactcaaggttgcggactttaatcaatcaaagcctaaattggcagcatcaactttgcaagaatccacggccaaatcctgatataaaaacactttttgtggatcattcatgtggacaaccaaatggtgcacgagctccttcacctgctaataacccgttactaggtgccttaccaaaggctggaggatttcctccacttggtgcacatgggccttttcaacctacgccagcaccagtgccaacacccctggctggttggatgtcgaatcctaccactgtagcacatgccgcggtttctggaggtggagctataggtcttggtgctccatctatgcctgctgctttgaagcatcctaggacccctccaactaatccttctgactatccatctggagactcagagcatgttgctaagagaacaaggccaattggaatttcagatgaggtgaatctacctgtcaatgtgttatcagcaacattcccaggtcatggtcaacatagtcaagcatttaatgcacctgatgacatacctaaggctgttgtgcgaactcttaatcagggttcatctcctatgagcatggactttcatccagttcaacaatctttacttcttgttggtacaaatgtgggggacattgctttgtgggaggtgggttctagggagcgcttggtctcaaggaacttcaaagtgtgggatcttagtgcatgttcaatgccatttcaggctgctcttgttaaagatccgggtgtttctgtcaaccgcgtgatttggagtcctgacggtgctttatttggagttgcttactcaaggcacattgttcagatatactcttaccaaggtggggatgaaatacgacatcacttggagattgatgctcatgttggtggagtgaatgatctagcattttcccacccaaataaacaactatgcgtgataacttgtggtgatgataagaccatcagggtatgggatgctgcttcgggtgcaaagcagtatacatttgaaggtcatgaggctcctgtttattctgtctgcccacatcataaagaaaacattcagttcatcttttcaacagcattagatggaaaaataaaagcatggctatatgacaatttgggatctcgtgttgattatgaggctcctggtcgttggtgcacaaccatggcttatagtgctgatggtacaaggctcttttcatgcgggacaagcaaagatggagaatcctctattgttgagtggaatgagagtgaaggggctgtgaaaaggacttatcaaggatttcgtaagcgatctttgggtgttgtgcaatttgataccaccaaaaatcgatttttggcagctggtgatgatttctccatcaaattctgggatatggataatgttcagcttttgacaactgttgatgctgatgggggtctccctgcaagcccacgtattcgtttcaacaaggatggaacacttttagctgtgtctgcaaatgagaatggaatcaaaattttagccaatggggatggtattcgtttgttgcgcacactagagaattcattatatgatgcttcaagggcatcagaagccttgacaaagcctacaattaatccaatttctgccgccgctgccgccgctgccgccgctgcaaccagtgctgcactggcagagagggcttcatctgtagtagctattgctggaatgaatggggatacccgaaacatgggtgatgttaaacccagaataagcgaagaatcaaatgacaaatcaaaggtatggaagctcactgaaataaatgaacaatctcaatgtagatccttgaagctaccggagaatgtaagagtaactaagatatcaaggttgatatatacaaattcaggtaatgctattctggcgttagcatcaaatgccattcacctgctgtggaaatggcagcgaaatgagcgtaactcatctggcaaggccactgctaccttgcaaccgcagttgtggcaaccatctagtggcatcctgatgacaaatgacattgctgatagcaatcctgaggatgctgtaccctgctttgcattgtccaaaaatgactcatacgtaatgtcggcatcaggagggaagatatctctgttcaatatgatgacttttaagactatgacaacattcatgcctccaccacctgcggcaacctttcttgctttccatcctcaggataataatattattgctataggcatggatgattcctctattcaaatatataatgtccgtgttgatgaggttaaaagtaaactcaaaggccatactaaaagaattactggtcttgctttctctcatgtattgaatgtattagtttcatctggagcagatgctcagatttgtgtttggaacactgatggatgggaaaagcagaagtctagattcttgcagcttcctcccgggaggacaccaccggcacagtcagatacccgtgtacagtttcatcaagatcaaatacagttcctggttgtacatgaaactcagcttgccatttatgaagcaacaaaactagaaggtctaaagcagtggtgtccgcgagattcatctgcaccaatatcgcatgcaacattctcctgtgatagccagcttatatatgccagctttttagacgcaacaatctgtgtatttagtgcttcaaatctcagattacgttgtcgtatcaatccttctgcatatcttcctgcaagtgtcagttccaacgtacaaccacttgtaattgcggctcacccacaagagccaaatcagtttgctgtaggactgtcggatggtggagttcatgtttttgaaccccttgagtctgaaggcaagtggggtgtgcctcctccgattgagaatgggtcagcaagcaatgtggcagctacttctgtcggaccttcttcagatcaagctcaaagatgatccatgtcagccaaagacaagtttcttttacatacttggcttgctggccaattttaagaactaaatttgtacttaacttaatgcagggcactcttcaatttagttgatccaactaagttaaatccatcgatcgtgctgtgcacaaaatcatatcatgccagagccctggagcaactcatttggttgaaggccaaaaccacattgtaatttgccgatagatgtgaaaaattctttttaagtttaatgctacagatgatgtacaagttcttttcagcgctttcaaactgcttctggctatttaattagattgattgatcctaacttgttaccctgtgttagttccattccagtcttgcatgtaaattactgtgctaatctttcatcttcatcgttcccatattttctgtatgattttttaatggacaccttgttttatctcgtgtcacgtagtgtacccaagaaaaaggtctaaagcactaaatctgtagg

SEQ ID NO: 9188 - DNA, 4098 bp, Phaseolus vulgaris
acaccctatttctgcaagttcaaatgacctctttctctctctatatatattttcgagttttctagagagagagcgagtagattagtccatttccgcgaggagagagaaagtgcaagaatcggaagagagacagagagcgtttggtttgtgatgtgttagctttgaagatctagttcactgttgctcatttcagtgtgtatctaatcgaagacgagggggttccgatgtcgtctcttagtagggaattggtgttcttgatcttgcagtttctcgatgaggaaaagttcaaagagactgtacacaagcttgagcaggaatccgggtttttctttaacatgaaatattttgaggatgaagtgcacaacgggaattgggacgaggtggagaaatacctctccggtttcaccaaggtggatgataataggtattctatgaagatattttttgagataaggaagcagaagtatctggaggctttagataagcatgaccggtctaaggcagtagaaatattagtgaaggatttgaaagtgtttgctacatttaatgaagaattgttcaaggaaatcacacagcttctgacgttggaaaactttagggagaatgaacaattgtctaagtacggtgatacaaagtctgcacgagcaatcatgttggttgagctcaaaaagctcatcgaagcaaatcctttatttcgtgacaaattgcaatttcccaaccttaaaaactcaaggttgcggactttaatcaatcaaagcctaaattggcagcatcaactttgcaagaatccacggccaaatcctgatataaaaacactttttgtggatcattcatgtggacaaccaaatggtgcacgagctccttcacctgctaataacccgttactaggtgccttaccaaaggctggaggatttcctccacttggtgcacatgggccttttcaacctacgccagcaccagtgccaacacccctggctggttggatgtcgaatcctaccactgtagcacatgccgcggtttctggaggtggagctataggtcttggtgctccatctatgcctgctgctttgaagcatcctaggacccctccaactaatccttctgactatccatctggagactcagagcatgttgctaagagaacaaggccaattggaatttcagatgaggtgaatctacctgtcaatgtgttatcagcaacattcccaggtcatggtcaacatagtcaagcatttaatgcacctgatgacatacctaaggctgttgtgcgaactcttaatcagggttcatctcctatgagcatggactttcatccagttcaacaatctttacttcttgttggtacaaatgtgggggacattgctttgtgggaggtgggttctagggagcgcttggtctcaaggaacttcaaagtgtgggatcttagtgcatgttcaatgccatttcaggctgctcttgttaaagatccgggtgtttctgtcaaccgcgtgatttggagtcctgacggtgctttatttggagttgcttactcaaggcacattgttcagatatactcttaccaaggtggggatgaaatacgacatcacttggagattgatgctcatgttggtggagtgaatgatctagcattttcccacccaaataaacaactatgcgtgataacttgtggtgatgataagaccatcagggtatgggatgctgcttcgggtgcaaagcagtatacatttgaaggtcatgaggctcctgtttattctgtctgcccacatcataaagaaaacattcagttcatcttttcaacagcattagatggaaaaataaaagcatggctatatgacaatttgggatctcgtgttgattatgaggctcctggtcgttggtgcacaaccatggcttatagtgctgatggtacaaggctcttttcatgcgggacaagcaaagatggagaatcctctattgttgagtggaatgagagtgaaggggctgtgaaaaggacttatcaaggatttcgtaagcgatctttgggtgttgtgcaatttgataccaccaaaaatcgatttttggcagctggtgatgatttctccatcaaattctgggatatggataatgttcagcttttgacaactgttgatgctgatgggggtctccctgcaagcccacgtattcgtttcaacaaggatggaacacttttagctgtgtctgcaaatgagaatggaatcaaaattttagccaatggggatggtattcgtttgttgcgcacactagagaattcattatatgatgcttcaagggcatcagaagccttgacaaagcctacaattaatccaatttctgccgccgctgccgccgctgccgccgctgcaaccagtgctgcactggcagagagggcttcatctgtagtagctattgctggaatgaatggggatacccgaaacatgggtgatgttaaacccagaataagcgaagaatcaaatgacaaatcaaaggtatggaagctcactgaaataaatgaacaatctcaatgtagatccttgaagctaccggagaatgtaagagtaactaagatatcaaggttgatatatacaaattcaggtaatgctattctggcgttagcatcaaatgccattcacctgctgtggaaatggcagcgaaatgagcgtaactcatctggcaaggccactgctaccttgcaaccgcagttgtggcaaccatctagtggcatcctgatgacaaatgacattgctgatagcaatcctgaggatgctgtaccctgctttgcattgtccaaaaatgactcatacgtaatgtcggcatcaggagggaagatatctctgttcaatatgatgacttttaagactatgacaacattcatgcctccaccacctgcggcaacctttcttgctttccatcctcaggataataatattattgctataggcatggatgattcctctattcaaatatataatgtccgtgttgatgaggttaaaagtaaactcaaaggccatactaaaagaattactggtcttgctttctctcatgtattgaatgtattagtttcatctggagcagatgctcagatttgtgtttggaacactgatggatgggaaaagcagaagtctagattcttgcagcttcctcctgggaggacaccaccggcacagtcagatacccgtgtacagtttcatcaagatcaaatacagttcctggttgtacatgaaactcagcttgccatttatgaagcaacaaaactagaaggtctaaagcagtggtgtccgcgagattcatctgcaccaatatcgcatgcaacattctcctgtgatagccagcttatatatgccagctttttagacgcaacaatctgtgtatttagtgcttcaaatctcagattacgttgtcgtatcaatccttctgcatatcttcctgcaagtgtcagttccaacgtacaaccacttgtaattgcggctcacccacaagagccaaatcagtttgctgtaggactgtcggatggtggagttcatgtttttgaaccccttgagtctgaaggcaagtggggtgtgcctcctccgattgagaatgggtcagcaagcaatgtggcagctacttctgtcggaccttcttcagatcaagctcaaagatgatccatgtcagccaaagacaagtttcttttacatacttggcttgctggccaattttaagaactaaatttgtacttaacttaatgcagggcactcttcaatttagttgatccaactaagttaaatccatcgatcgtgctgtgcacaaaatcatatcatgccagagccctggagcaactcatttggttgaaggccaaaaccacattgtaatttgccgatagatgtgaaaaattctttttaagtttaatgctacagatgatgtacaagttcttttcagcgctttcaaactgcttctggctatttaattagattgattgatcctaacttgttaccctgtgttagttccattccagtcttgcatgtaaattactgtgctaatctttcatcttcatcgttcccatattttctgtatgattttttaatggacaccttgttttatctcgtgtcacgtagtgtacccaag

SEQ ID NO: 9189 - DNA, 4201 bp, Glycine max
actaggttataagtaattctacttatcatctcccttccttgtcgcctcctatataaaaaacacctactatttgagcaagttcatgtgtcctatatatatatttagagagagagagaaagaggtaattagagatagagtgagtgagagtatattaggacatttcttgcaggagagagaaagtggaatagaagagaagagagagaaagagaaaggtttggtcttttggtgtttttggtctcttctctagttgtgttgtggagtggtggtggtggtggtggtgcgttctatattcttcgggggacctttctttccgtgtgtgtgagagagctttgaagatctagtttatagttgctcattttggtgctggtctaatcgaagacgaggcggttacgatgtcatctctaagtagggagttggtgttcttgatcttgcagtttctggatgaggaaaagttcaaagaaactgttcacaagcttgagcaggagtctgggtttttctttaacatgaaatatttcgaggatgaagtgcacaatggtaattgggatgaggttgagaggtacctctctggtttcaccaaagtggatgataataggtattctatgaagatattttttgaaattaggaagcagaagtacctggaggcattagataagcatgatcggtctaaggctgtagaaatattagtgaaggatttgaaagtctttgccacatttaatgaagaactgtttaaggaaatcacacagcttttgacattggagaattttagggaaaatgagcaattgtctaagtatggtgatacaaagtctgcaagggcaatcatgttggttgagctcaaaaagttgattgaggccaatcccttatttcgtgacaaattgcaatttcctaaccttaaaaactcaaggctacggactctaatcaatcaaagcttgaattggcagcaccaactttgtaagaatccacggccaaatccagatataaaaactctttttgtggatcattcatgtggacaaccaaatggtgcacgggctccatcacctgctaataatccactactaggatcattaccaaaggctggaggatttcctcctcttggtgcacatgggccttttcaacccactccagctcctgtgccaacacccctggctggttggatgtcaaatccaaccactgtagcacatcctgcagtttcgggaggagctataggtcttggtgcgccatcaatccctgctgctttgaagcaccctaggacccctccaactaatccttctgttgactatccatctggtgattcagatcatgtttctaagagaacaagaccaattggaatgtcagatgaggtaaatctgcctgtcaatgttttgtcagcaacgttccctggtcatggtcatggtcaggcttttaatgcacctgatgacttgccaaagactgccatgcgaagtctgaaccaaggctcatctcctatgagcatggactttcatccagttcaacagacactgcttcttgttggtacgaatgtgggggacattgctttatgggaagtgggctctagggagcgattgctcatgaggaactttaaagtttgggatcttagtgcttgttcaatgccctttcaggctgctcttgtcaaagatccaggtgtttctgtcaaccgtgtgatttggagtcctgatggggctttattcggagttgcttactcaaggcacatcgttcagatatactcttaccatggcggggatgatgttggacagcatctggagattgatgctcatgttggtggagtaaatgatctagcgttttctcacccaaataagcaactatgtgtcataacctgtggtgatgataagaccattaaggtttgggatgctgctacgggtgcgaaacagtatactttcgaaggtcatgaggctccagtttattctatctgtccgcattataaagaaaacattcagttcatcttttcaacggcattagatggaaagataaaagcatggttgtatgataatttgggatctcgtgttgattatgaagctcctggacgatggtgtacaaccatggcctatagtgctgatggtacaagactcttctcatgtgggacaagtaaggaaggggaatcctctattgttgagtggaatgaaagtgaaggagctgtgaaaaggacttatcaaggatttcggaaacgatctttgggtgttgtacaatttgatacaaccaaaaatcgatatttggctgcaggcgatgatttctccattaaattctgggatatggacaatattcagcttttgacaactgttgatgctgatgggggtctccctgcaagcccacgaatccgttttaacaaggatggagctcttttagctgtttctgcaaatgagaatggaattaaaatcttagccaatgcagatggtattcgtttgttacgcacattagaaaattctttatatgatacatcaagaacatcggaagccatgacaaagcctacaataaatccaatttcagcagccgccgctgctgcaactagtgctgcacttgcagagagggcctcgtctgtggtagcgattactgcgatgaacggggatgcccgaaacttgggtgatgttaaacctagaataagtgaagaatccaatgataagtcgaagatatggaagctcactgaaatcaatgaaccatctcaatgtagatccttgaagctgcctgagaatgtcagggtgaacaagatatcaaggttgatatatactaattcaggtaatgctatcctggcgttagcttcaaatgccattcatctgctctggaaatggcagcgaaatgaccgtaattcaactggcaaggccactgccagtgtgcaaccccagttgtggcaaccttctagtggcatcctgatgactaatgacattactgataacaataccgaggatgccgtcccctgctttgctctgtcgaaaaatgattcttatgtaatgtcagcatcaggagggaagatttctctgttcaatatgatgacttttaagacaatgacgacattcatgcctccgccacctgcagcaacttttcttgcttttcatcctcaggataacaatattattgctataggcatggatgattcttccattcaaatatataatgtccgtgtagatgaggttaaaagtaaactcaaaggccatactaaaagaataactggtcttgctttttctcatgtgttgaatgtgctagtttcatctggggctgatgctcagatttgtgtgtggaatactgacggatgggaaaagcagaagtctagattcttgcaacttcctgctgggaggactccaccagcacaggcagatacccgtgtacaatttcatcaggaccagatccgcttcttggttgtacatgaaacacagcttgccatttatgaagcaacaaagctagaatgtttaaagcagtggttcccacgggattcatcagcaccaatatcacatgcaactttctcatgtgatagccagctcatatatgccagctttttagatgcaacagtctgtgtattgagtgtttcaaaccttagattacgttgtcgaatcaatccttctgcatatctttctgcaagtgtcagttctaacgtacaaccacttgttattgctgcacatcctcaagaaccaaaccagtttgctgtaggactgtcggatggcggagttcatgtctttgagccccatgagtctgaaggaaaatggggtgtgcctccacccattgagaatgggtcaacgagcaatatggcagctacttcagttggagcttcttcagatgaagctcagagatgatccatgtcagccaaagacaagtttcttttacatacttggcttgctggccatttcaagaactaggtatgtatttgagataatgccattgtgttgtctggcctttgtgcagtcacataccagaacaatggaccaaacccgaaaccaaaatctaaaccttgtaattgctaaaatatgtgaaaatttctttttagtctaatgctacagaagcagcagttctcgagtttaaaccttttctggctatttatttagattggtttatcctaacttctcttttgtaatcccatccagtctaaatgtaacttgctaggataatcttgtcttcatcgctcacagtttatctatatataaatatataaattttttaaatggtgtagtttgttgttcatggcatgtagtttgtaacacgaaga

SEQ ID NO: 9190 - DNA, 3963 bp, Phaseolus vulgaris
ggtttctctctcttgttgtggtgtggtgtggtggtgcgttctatattcgggggaccttgcttcccatgtgactgagggttgaagatctagtttatagttgctcactttggttcttgtctgatcgagggcgaggcagttacgatgtcatctctcagtagggagttggtgttcttaatcctgcagtttctcgatgaggaaaagttcaaagaaactgttcacaagcttgaacaggagtctgggtttttctttaacatgaaatattttgaggatgaagtgcacaacggtaattgggatgaggttgagagatacctatctggtttcaccaaagtagatgacaataggtattctatgaagattttttttgagataaggaagcagaagtacctggaggcattggataagcatgatcggtccaaggctgtagaaatattagtgaaggatttgaaagtgtttgccacatttaatgaagaactgtttaaggaaatcacacagcttttgacattggagaattttagggaaaacgagcagttgtccaagtatggtgatacgaagtctgcaagggcaatcatgttggttgaactcaagaaattgattgaggccaatcccttgtttcgcgataaattgcaatttcccaaccttaaaaactcaaggttacggactctcatcaatcaaagcttgaattggcagcatcaactttgtaagaatccgcggccaaatccagatataaaaacactttttgtggatcactcgtgtggacaaccaaatggtgcacgggctccatcccctgctagcaatccacttctaggatcattaccaaaggctggaggatttcctcctcttggtgctcatgggccttttcaacctactccagcaccggtgccaacacccctggctggttggatgtcaaatccaacaactgtagcacatcctgcagtctctggtggagctataggtcttggtgcaccatcaatccctgctgctttgaagcaccctaggacccctccaactaatccttctgttgactatccgtctggtgattcagatcatgtttctaagagaacgagaccaatgggaatatcagatgaggtaaatctgcctgtcaatgttctgtcagctacattccctggtcatggtcatggtcaggcttttaatgcgcctgacgacttgccaaagactgtcatgcgaactctgaaccaaggctcatctcctatgagcatggactttcatccagttcaacagacactgcttcttgttggcacgaatgtgggggacattgctttgtgggaagtgggctctagggagcggttgctcatgaggaactttaaagtgtgggatcttagtgcttgttcaatgccctttcaggctgctcttgtcaaagatccaggcgtttctgtcaaccgtgttatttggagtcctgatggggctttattcggagttgcttactcaaggcacattgttcagatatactcttaccatggtggggatgaagctagacagcatttggagattgatgctcatgtcggtggagtaaatgatctagcattttcccaccccaataagcagttatgtgtcattacctgtggtgacgataagaccattaaggtttgggatgctgcttcgggtgcaaaacagtatacttttgaaggtcatgaggctccagtttattctgtctgtccgcattataaagaaaacattcagttcatcttttccacagcattagatggaaagataaaagcatggctgtatgataatttgggatctcgtgttgattatgaagcccctggtcgttggtgtacaaccatggcctacagtgctgatggtacaagacttttttcatgtgggacaagtaaggagggggaatcctctattgttgagtggaatgaaagtgaaggagctgtgaaaaggacttatcaaggatttcgcaaaagatctttgggtgttgtacaatttgatacaaccaaaaatcgatatttggctgcaggtgatgatttctccattaaattctgggacatggacaatattcagcttttgacaactgttgatgctgatgggggtctccctgcaagcccacgcatccgttttaacaaggatggagctcttttagctgtttctgcaaatgaaaatggaatcaaaatcttagccaatggagatggtattcgtttgttacgtactttagagaattctttatatgatacatctagaacgtcagaagccatgacaaagcctgcaataaatccaatttcagccgccgccgccgctgcagcaactagtgctgcacttgcagagagggcttcatctgtcgcgattactgcgatgaatggggatgctcgaaacatgggtgatgttaaacctagaattagtgaagaatccaatgacaaatcaaagatatggaagctcactgaaatcaatgaacaatctcaatgtagatccttgaagctacctgagaatgttagagtgaacaagatatcaaggttgatatatactaattcaggtaatgctattctagcattagcttcaaatgccattcatctgctctggaaatggcagcgaagtgaccgtaattcaactggcaaggcctctgctactgtgcagccccagttgtggcaaccttctagtggcattctgatgaccaatgaccttactgatagcaatactgaggatgccgttccctgctttgctctgtcaaaaaatgattcttatgtaatgtcagcatcaggagggaagatttctctgttcaatatgatgacttttaagacaatgacaacattcatgcctccaccacctgccgcaacttttcttgctttccatcctcaggataataatattattgctataggcatggatgattcttccattcaaatatataatgtccgtgtggatgaggttaaaagtaaactcaaaggtcatactaaaagaataactggtcttgctttttctcatgtattgaatgtgctagtttcatctggggcagatgctcagctttgtgtgtggaatactgacggatgggaaaagcagaaatctagattcttgcaacttccggccggcagaactccaccagctcaggcagatacccgtgtacagtttcatcaggatcagatccgcttcttggttgtacatgaaactcagcttgccatttatgaagcaacaaaactagaatgtttgaagcagtggttcccgcgagaatcagctgccccagtatcacatgcaactttctcatgtgatagccagctcatatatgccagctttttagacgcgacagtgtgtgtatttagtgcttcaaaccttagattacgttgtcgaatcaatccttctgcttatctttcagccagcgtcagttctaatgtacaaccacttgttattgctgcacatcctcaagaaccaaatcagtttgctgtaggattgtctgatggtggagttcatgtctttgaaccccttgagtctgaaggcaaatggggtgtgcctccacccaatgagaatggatcaacaagcaatatggcagctacttcagttggagcttcttcagatgaagctcagagatgatccatgtcagccaaagacaagtttcttttacatacttggcttgctggccatttcaagaactaggtatgtacttatgttaatgcaggacagtctctgaattagttgatccaacatttctctctatccattgtgttgtcaggcctctgtgaacactcacatgccagaacaatggaccaaccttgtaattgccaaaaaatatgtgaaatttttcttcaagtctaatgttgcagaggcagaagttctcaagtttgaactttttctggttatttatttagattggtttatcctaactttactcttcatgtaacttactaggataatcttgtcttcggcttctcaacttttattcatatataaatatataaattttttaaacagtgtagtttctgattcatgaaacatgaagaatgaagtgcatagtga

SEQ ID NO: 9191 - DNA, 4112 bp, Phaseolus vulgaris
tcttatataaaataacctatttgagcaagttcatgtgtcctatatatatatatatatatatattgagagtgagagagagagagagattggtaattagagatagagagtgagtgttaggacatttgttgcaggagagagaaagtggaatagaagagaaaggtttggtctttggtgttggggtttctctctcttgttgtggtgtggtgtggtggtgcgttctatattcgggggaccttgcttcccatgtgactgagggttgaagatctagtttatagttgctcactttggttcttgtctgatcgagggcgaggcagttacgatgtcatctctcagtagggagttggtgttcttaatcctgcagtttctcgatgaggaaaagttcaaagaaactgttcacaagcttgaacaggagtctgggtttttctttaacatgaaatattttgaggatgaagtgcacaacggtaattgggatgaggttgagagatacctatctggtttcaccaaagtagatgacaataggtattctatgaagattttttttgagataaggaagcagaagtacctggaggcattggataagcatgatcggtccaaggctgtagaaatattagtgaaggatttgaaagtgtttgccacatttaatgaagaactgtttaaggaaatcacacagcttttgacattggagaattttagggaaaacgagcagttgtccaagtatggtgatacgaagtctgcaagggcaatcatgttggttgaactcaagaaattgattgaggccaatcccttgtttcgcgataaattgcaatttcccaaccttaaaaactcaaggttacggactctcatcaatcaaagcttgaattggcagcatcaactttgtaagaatccgcggccaaatccagatataaaaacactttttgtggatcactcgtgtggacaaccaaatggtgcacgggctccatcccctgctagcaatccacttctaggatcattaccaaaggctggaggatttcctcctcttggtgctcatgggccttttcaacctactccagcaccggtgccaacacccctggctggttggatgtcaaatccaacaactgtagcacatcctgcagtctctggtggagctataggtcttggtgcaccatcaatccctgctgctttgaagcaccctaggacccctccaactaatccttctgttgactatccgtctggtgattcagatcatgtttctaagagaacgagaccaatgggaatatcagatgaggtaaatctgcctgtcaatgttctgtcagctacattccctggtcatggtcatggtcaggcttttaatgcgcctgacgacttgccaaagactgtcatgcgaactctgaaccaaggctcatctcctatgagcatggactttcatccagttcaacagacactgcttcttgttggcacgaatgtgggggacattgctttgtgggaagtgggctctagggagcggttgctcatgaggaactttaaagtgtgggatcttagtgcttgttcaatgccctttcaggctgctcttgtcaaagatccaggcgtttctgtcaaccgtgttatttggagtcctgatggggctttattcggagttgcttactcaaggcacattgttcagatatactcttaccatggtggggatgaagctagacagcatttggagattgatgctcatgtcggtggagtaaatgatctagcattttcccaccccaataagcagttatgtgtcattacctgtggtgacgataagaccattaaggtttgggatgctgcttcgggtgcaaaacagtatacttttgaaggtcatgaggctccagtttattctgtctgtccgcattataaagaaaacattcagttcatcttttccacagcattagatggaaagataaaagcatggctgtatgataatttgggatctcgtgttgattatgaagcccctggtcgttggtgtacaaccatggcctacagtgctgatggtacaagacttttttcatgtgggacaagtaaggagggggaatcctctattgttgagtggaatgaaagtgaaggagctgtgaaaaggacttatcaaggatttcgcaaaagatctttgggtgttgtacaatttgatacaaccaaaaatcgatatttggctgcaggtgatgatttctccattaaattctgggacatggacaatattcagcttttgacaactgttgatgctgatgggggtctccctgcaagcccacgcatccgttttaacaaggatggagctcttttagctgtttctgcaaatgaaaatggaatcaaaatcttagccaatggagatggtattcgtttgttacgtactttagagaattctttatatgatacatctagaacgtcagaagccatgacaaagcctgcaataaatccaatttcagccgccgccgccgctgcagcaactagtgctgcacttgcagagagggcttcatctgtcgcgattactgcgatgaatggggatgctcgaaacatgggtgatgttaaacctagaattagtgaagaatccaatgacaaatcaaagatatggaagctcactgaaatcaatgaacaatctcaatgtagatccttgaagctacctgagaatgttagagtgaacaagatatcaaggttgatatatactaattcaggtaatgctattctagcattagcttcaaatgccattcatctgctctggaaatggcagcgaagtgaccgtaattcaactggcaaggcctctgctactgtgcagccccagttgtggcaaccttctagtggcattctgatgaccaatgaccttactgatagcaatactgaggatgccgttccctgctttgctctgtcaaaaaatgattcttatgtaatgtcagcatcaggagggaagatttctctgttcaatatgatgacttttaagacaatgacaacattcatgcctccaccacctgccgcaacttttcttgctttccatcctcaggataataatattattgctataggcatggatgattcttccattcaaatatataatgtccgtgtggatgaggttaaaagtaaactcaaaggtcatactaaaagaataactggtcttgctttttctcatgtattgaatgtgctagtttcatctggggcagatgctcagctttgtgtgtggaatactgacggatgggaaaagcagaaatctagattcttgcaacttccggccggcagaactccaccagctcaggcagatacccgtgtacagtttcatcaggatcagatccgcttcttggttgtacatgaaactcagcttgccatttatgaagcaacaaaactagaatgtttgaagcagtggttcccgcgagaatcagctgccccagtatcacatgcaactttctcatgtgatagccagctcatatatgccagctttttagacgcgacagtgtgtgtatttagtgcttcaaaccttagattacgttgtcgaatcaatccttctgcttatctttcagccagcgtcagttctaatgtacaaccacttgttattgctgcacatcctcaagaaccaaatcagtttgctgtaggattgtctgatggtggagttcatgtctttgaaccccttgagtctgaaggcaaatggggtgtgcctccacccaatgagaatggatcaacaagcaatatggcagctacttcagttggagcttcttcagatgaagctcagagatgatccatgtcagccaaagacaagtttcttttacatacttggcttgctggccatttcaagaactaggtatgtacttatgttaatgcaggacagtctctgaattagttgatccaacatttctctctatccattgtgttgtcaggcctctgtgaacactcacatgccagaacaatggaccaaccttgtaattgccaaaaaatatgtgaaatttttcttcaagtctaatgttgcagaggcagaagttctcaagtttgaactttttctggttatttatttagattggtttatcctaactttactcttcatgtaacttactaggataatcttgtcttcggcttctcaacttttattcatatataaatatataaattttttaaacagtgtagtttctgattca

SEQ ID NO: 9192 - DNA, 3933 bp, Lotus japonicus
ttcggagtttctagagagagaaagagtagattagtccatttcagacaggagagagaaagtgaagaagggatcggaagagatagatagagaaaggtttggcctttttgttgtggttgctgtttccttcttcccccatgtgaagatctagttcactggtgctcattttagtgtgtatctaatttattggaagagggattgagatgtcttctctcagtagggaactggtgttcttgatcttgcagtttctggatgaggaaaagttcaaagagacagttcacaagcttgagcaagagtctgggtttttcttcaacatgaagtattttgaggatgaagtgcataatgggaattgggaagaggttgagaaatacctctctggattcacaaaagtagatgataataggtattccatgaagatatttttcgagataaggaaacagaagtatctggaggcattagacaagcatgaccggtccaaggctgttgaaatattagtgaaggatttgaaagtgtttgctacattcaatgaagaactgttcaaggaaatcacccagctcttgacattggagaattttagggaaaatgaacaattatcaaagtatggtgatacaaagtctgcacgagcaatcatgttggttgagctcaaaaagctcattgaagcaaatcccttgttccgtgacaaattgcaatttcccaaccttaaaaactcgaggttacggactctgatcaatcaaagcttgaattggcagcatcaactttgcaagaatccacgtccaaatcctgatataaaaactctctttgtggatcactcatgtggacaaccaaatggtgcacgagctccttcacctgctaatagcccgctactagggtccttacccaaagctggaggatttcctcctcttggtgcacacgggccttttcaacctactccagcacaagtgccaacacccctggctggttggatgtcaaatcctacccctgtaacacatgctgcagtttctggaggaggaggtataggtcttggtgctccatcaatccctgctgttttgaagcatcctaggacccctccaactaatccctctgtcgactatccgtctggagattctgatcatgttgctaagagaccaaggccaatgggaatttcagatgaggtaaatctacctgtgaatgtgttgtcagcatcattctcgggtcatggtcatggtcatggtcaggcttttagtgcacctgatgatttaccaaagactgtcgtgcgaactctgaaccagggttcaactcctatgagcatggactttcatccagttcaacaaactttgcttcttgttggtacgaatgtgggggacattgctttatgggaagtcggttcaagggataggttggtctcaaggaacttcaaagtttgggatctaagtgcatgttcaatgacgtttcaggctgctcttgtcaaagatcctggtgtttctgttaaccgagtgatttggagtcctgatggtgctttatttggggttgcttactctaggcacattgttcagatatactcttaccatggtggggatgaagtgcgacaacatctggagattgatgctcatgttggtggagtaaatgatcttgcattttcccacccaaataagcaactatgtgtgataacctgtggtgatgataagaccattaaggtgtgggatgcagcttcaggtgcaaagcagtatacttttgaaggtcatgaggctccagtttattctgtctgcccacattacaaagagaacattcagttcatcttttcaacagcattagatggaaaaataaaagcatggttgtatgacaatttgggatctcgcgttgattatgatgctcctggtcgatggtgcacaaccatggcttacagtgctgatggtacaaggctcttttcatgtggaacaagcaaagagggggaatcctctattgtggagtggaacgaaagtgaaggagctgtaaaaaggacttatcaaggattccgtaagcgatctatgggtgttgtgcaatttgatactaccaaaaaccgatttttggctgctggtgatgatttctccatcaagttttgggatatggacaatgttcagcttttgactactgttgatgctgatgggggtctcgctgcaagcccacgtattcgtttcaacaaggacggaactcttttagctgtctctgcaaatgagaatggaattaaaattttagccaatggagatggtaatcgtttattgcgtacattagagaattctatatatgatgcatcaagaacatcagaagccttggcaaagcctacaataaatccaatttctgctgcggctgcggctgcaactagtgctgcacttgcagagagagcctcatctgtagtagctattactggaatgaatggggatccccgaaacttgggcgacgttaaacctagaataagcgaagaatccaatgacaagtcaaaaatatggaagctcactgaaattaatgaaccatctcaatgcagaaccttgaagctagtggagaatcctagagtaaacaagatatcaaggttgatatatacaaattcaggtaatgctattctagcattagcatcgaatgccattcacctgctctggaaatggcagcgaactgaccgcagctcatctggcaaggccaatgccaccgtgcaacctcagttgtggcaaccatcaagtggcatcctgatgactaatgacattgctgatggcaatccggaggaagctttagcctgttttgctctgtccaaaaatgattcatatgtaatgtctgcatcaggagggaaggtatccttgttcaatatgatgacgtttaagacaatgactactttcatgcctccgccgcctgcagcaacctttcttgctttccatcctcaggataacaatattattgctataggcatggatgattcctctattcagatatataatgtccgtgttgatgaggttaaaagtaaactcaaaggccatacaaagaaaataactggtcttgctttctcacatgtattgaatgttctagtttcatctggggctgataatcagatttgtgtgtggaatactaatggatgggagaaacaaaagactaggttcttgcagcttccgcacgggaggactccaccagcacaatctgatactcgtgtacagtttcatcaggatcagatacacttcttggttgtacatgaaactcagcttgccatttatgaagcaacaaaactggaaggactaaagcagtggttcccacaagattctgcggcaccaatatcgcatgcaactttctcatgtgatagccagctgatatacgccagctttttagacgcaacaatctgtgtatttagtgcttcaaatctcagattacgctgccgtatcaatccttctgcttatctcccatcaagtgtcagttccaacgtgcaaccacttgtaatcgccgcacatccgcaagaaccgaatcagtttgctacaggactgtcagatggtaccgttcatgtgtttgagcccctcgagtctgacggcaagtggggtgtgcctcctccgattgagaatggttcagcaagcaatgtggcagctgcttcaggtggaccttcttcggaacaagctcaaagatgatgatgatgatccatgtcagctggaggcaagtttcttttacatacttgtgctgctggccatttcaagaatccatccttttgtcagggctgaccacaatcacatcattctagagctgtggagctactcatctggttaaaaccaaaaaccacattgtaatttgccaatagatgtgaaaaattctttttatttaatgctacagtttagaagttctttggagagtactttcaattcaaccttcttcttgtggctatttaatgtgtttggataaatagtttaattaagcgcccatggtaataagtgttttttcataagttaatttgagaac

SEQ ID NO: 9193 - DNA, 4166 bp, Glycine max
cctatttgagcaagttcatgtgtcctatatatatctagagagaggtaattagagacagagagtgagtgagaagtatattaggacatttcttgcaggagagagaaagtggaagagaagagaagagaaggtttggtcttttgtgttttggtctctcttctcttgtggtgtgttggtggtggtggtggtggtggtggtggtggtggtgcgttccatattcgggggacctttcttcccatgtgtgtgtgtgagctttgaagatctagtctatagttgctcattttggtgctggtctaatcgaagacgaggcggttacgatgtcatctctaagtagggagttggtgttcttgatcttgcagtttctggatgaggaaaagttcaaagaaactgttcacaagcttgagcaggagtctgggtttttctttaacatgaaatattttgaggatgaagtgcacaatggtaattgggacgaggttgagaggtacctctctggtttcaccaaagtggatgataataggtattctatgaagatattttttgaggtaatgaagcagaagtacctggaggcattagataagcatgatcggtccaaggctgtagaaatattagtgaaggatttgaaagtctttgccacatttaatgatgaactgtttaaggaaatcacacagcttttgacattggagaattttagggaaaacgagcaattgtctaagtattgtgatacaaagtctgcaagggcaatcatgttggttgagctcaaaaagttgattgaggccaatcccttatttcatgacaaattgcaatttcccaaccttaaaagctcaaggttacggactctaatcaatcaaagcttgaattggcagcaccaactttgtaagaatccacggccaaatccagatataaaaactctttttgtggatcattcatgtggacaactaaatggtgcaccggctccatcacctgctaataatctgctacttggatcattaccaaaggccggaggatttcctcctcttggtgcacatgggccttttcaaccttctccagcccctgtgccaacacccctggctggttggatgtcaaacccaaccactgtagcacatcctgaagtttcaggaggagctataggtcttggtgtgccatcaattcctgctgctttgaagcaccctaggacccctccaacttatccttctgttgactatccatctggtgattcagatcatgtttctaagagaacaagaccaatgggaatgtcagatgaggtaaatctgcctgtcaatgttttgtcagcaacgttccctggtcatggtcatggtcatggtcatggtcaggcttttaatgcccctgatgatttgccaaagactgccatgcgaactctgaaccaaggctcatctcctatgagcatggactttcatccggttcaacagacactgcttcttgtcggtacgaatgtgggggacattgctttgtgggaagtgggctctagggagcggttgctcatgaggaactttaaagtttgggatcttagtgcttgttcaatgccctttcaggctgctcttgtcaaagatccgggtgtttctgtctaccgtgtgatttggagtcctgatggggctttatttggagttgcttactcaaggcacatcgttcagatatactcttaccatagtggggatgatgttcaacagcatctggagattgatgctcatgttggtggagtaaatgatctagcgttttctcacccaaataagcaactatgtgtcataacctgtggtgatgataagaccattaaggtttgggatgctgctacgggtgcgaaacagtatactttcgaaggtcatgaagctccagtttattctgtctgtccgcattataaagaaaacattcagttcatcttttcaacggcattagatggaaagataaaagcatggttatatgataatttgggatctcgtgttgattatgaagctcctggacgttggtgtacaaccatggcctatagtgctgatggtacaagactcttttcatgtgggacaagtaaggatgcggaatcctctattgttgagtggaatgaaagtgaaggagctgtgaaaaggacttatcaaggatttcggaaacgatctttgggttttgtacaatttgatacaaccaaaaaccgatatttggctgcaggtgatgatttctccattaaattctgggatatggacaatattcagcttttgacaactgttgatgcggatgggggtctccctggaagcccacgaatccgttttaacaaggatggagctcttttagctgtttctgcaaaagagaatggaattaaaatcttagccaatgcagatggtattcgtttgttacgcacattagaaaattctttatatgatacatcaagaacatcggaagtcatgacaaagcctacaataaatccaatttcagcagccgccgccgctgcaactagtgctgcacttggagagagggccttgtctgtggtaggtattaatgcgatgaatggggatgcccggaacttgggtgatgttaaacctagaataagtgaagaatccaatgataagtcaaaaatatggaagctaactgaaatcaatgaaccatctcaatgcagatccttgaagctacctgagaatgtcagagtgaacaagatatcaaggttgatatatactaattcaggtaatgctatcctggcattagcttcaaatgccattcatctgctctggaaatggcagcgaaatgaccgtaattcaactgtaaaggcctctgccagcgtgcaaccccagttgtggcaaccttctagtggcatcctgatgactaatgacattactgatagcaatactgaggatgccgttccctgctttgctctgtcgaaaaatgattcttatgtaatgtcagcatcaggagggaagatttctctgttcaatatgatgacttttaagacaatgacgacattcatgcctccgccacctgcagcaaattttcttgcttttcatcctcaagataacaatattattgctataggcatggatgattcttccatacaaatatataatgtccgcgtagatgaggtaaaaagtaaacttaaaggccatactaaaagaataactggtcttgctttttctcatgtgttaaatgtgctagtttcatctggggcagatgctcagatttgtgtgtggaatactgacggatgggaaaagcaaaagtctagattcttgcaacttcctgctgggaggactccaccagcacaagcagatacccgtgtacagtttcatcaggatcagatccgcttcttggttgtacatgaaactcagcttgccatttatgaagcaacaaagctagaatgtttaaagcagtggttcccacgggattcatcagcaccaatatcacatgcaactttctcatgtgatagccagctcatatatgccagctttttagatgcaacagtctgtgtatttagtgtttcaaaccttagattacagtgtcgaatcaatccttctgcttatctttctgcaagtgtcagttctaacgtacaaccacttgttattgctgcacatcctcaagaaccaaaccagtttgctgtaggactgtcagatggcggagttcatgtctttgagccccttgagtctgaaggcaaatggggtgtgcctccacccattgagaatgggtcaacgagcaatatggcagctacttcagttggagcttcttcagatgaagctcagagatgatccatgtcagccaaagacaagtttcttttacatacttggcttgctggccatttcaagaattaggtatgtacttatgataatgcagggcaccctctgaattagttgatccaactattctcttgatccattgtgttgtctggcctttgtgcagtcacataccagaacaatggaccaaaccccaaaccaaaaactaaaccttgtaattgtcaaaatatgtgaaaatttctttcaagtttaatgctactgaagcagaagtttaagtaaagaggatccctgtgatgagatgacatccatccaagcatcaaccacaattgcagcagcagcaccaccaccaccatatgcatttgcatattctcccaagtaactatcctataaaacaacaacaacaacaacaacataataataataataataataataagagtaagacctgtaaggaaa

SEQ ID NO: 9194 - DNA, 4061 bp, Medicago truncatula
ctatagatacatgctatatagagagagagagagagagaaacatttaggagagagaaagttgttcttgttgtgttgtgtttggtctcttggtcttggtcttgtgaagtggttgttgttttctttctccatgtttgaagcttttacctttggatttcaagatctagtttagtctttgctcattttgattttcatctgatccaagacaaaggggttgccatgtcatcactcagtagggagttggtgttcttgatcttgcagtttcttgaggaggaaaagttcaaagaggctgttcataagctagaacaggaatcagggttttactttaacatgaagtattttgaagaggaagtgcataatgggaattgggatgaggttgagaagtacctatctggtttcactaaagttgatgataataggtattctatgaagatatttttcgagataaggaagcagaagtatctcgaggcattggacaagcatgatcggtccaagggtgtcgaaatactagtgaaggatttgaaagtgttttctacatttaatgaagagttgttcaaggagatcacacagcttttgacactggagaattttagggaaaatgaacaattgtcgaagtatggtgatacgaagtctgcaagagcaatcatgttggttgagctcaaaaagttgattgaggcaaatcccttatttcgtgacaaattgcaatttcccaaccttaagaactcaaggttgcgaactctcatcaatcaaagcttgaattggcagcatcaactttgtaagaatccacggccaaatccagatataaaaactctttttgtggatcactcttgtggacaaccaaatggtgcacgggctccatcacctgctaatatgccgctactaggatccttgccgaaggttggagggtttcctcctcttggtgcacatgggccttttcaaccaactccagcacctgtgccaatgccgctggctggttggatgtcaaatcctactaccgtggcacatccatcagtttctggaggaggagctataggtcttggtgttggtggaccttcaatgcccgctgctttgaagcatcctaggacacctccaactaatccttctgttgactacccatctggggattcagatcacatttctaagagaacaagaccaataggaatgtctgatgagggaaatctacctgttaatgttttgtcagcgacgtttccgggtcatggtcatggccaggcttttaattcacctgatgacttgccaaagacagtcttgcgaactctaaatcaaggctcttctcctatgagcatggacttccatccagttcaacagactttacttcttgttggtacaaatgtggcagacattggtttatgggaattgggctctagggaacggttggtcttaaggaacttcaaagtttgggatctgagtgcttgttcaatgccatttcaggctgctcttgtcaaagatccagctgtttctgtcaaccgtgtgacttggagtccagacggggctttgttcggagttgcttattcaaggcacattgttcagatatactcttaccatggtggggatgaagtacgacagcacttggagattgatgctcatgttggcggagtaaatgatctagcattttctcacccaaataagcagctatgcgtgatcacctgtggtgatgataaaactattaaggtgtgggatgctgctacgggtttaaaacagtacacttttgaaggtcacgaggctcccgtttattctgtctgcccacattataaagaaaacatccagttcatcttttcaacggcattggatggaaagataaaagcatggttgtatgacaacttgggatctcgtgttgattatgatgctcctggtcggtggtgtacaaccatggcttatagtgctgatggcacaaggctcttttcatgtgggactagcaaggatggtgaatcctctattgttgaatggaatgaaagtgaaggagctgtgaaaaggacttaccaaggatttcgaaagcgatctttgggtgttgtacaatttgatacgaccaaaaatcggtatctggctgctggtgatgatttctccattaaattttgggatatggacaatattcagcttttgacaactgttgatgctgatgggggtctcccggcaagcccacgcatccgtttcaataaggaaggatctcttttagctgtctctgcaaatgagaatggaattaaaatcttggccaatggagatggtgttcgtttgttgcgctcgttagagaattcctcatatgatgcatcaagaacaccagaaaccatgacaaagcctataataaatccgatgtcagttgctactgcggcaactagtgctgcacttgagagagcctcatctgtggccgctattactggaatgaatggtgatgtccggaacttaggtgatattaaacctagaataagtgaagaatccaatgacaagtcaaagatatggaagctcactgaaatcaatgaaccatctcattgtagatccttgaagctacctgagaatgcaagagtcacaaagatatcgaggttgatatatactaattcaggtaatgctattctggcattagcttcaaatgccattcatcttctctggaagtggcaacgaaatgatcgcaattcatctggcaaggccactgctagtgtgccacctcagttgtggcaaccttcaagtggcatcctgatgactaatgacattaatgataacaatactgaggatgcagtcccatgctttgctctttccaaaaatgattcttacgtaatgtcggcatcgggtgggaagatttctctcttcaatatgatgacttttaagacaatgacaacgttcatgccaccaccacctgcggcaacgtttctggctttccatcctcaagataacaatattattgctataggcatggatgattcttccattcagatatataatgtccgcgtagatgaggttaaaagtaaactcaaaggccatactaaaagaataactggtcttgcattttctcatgtactgaatgtgctagtttcatctggggctgatggtcagatttttgtatggaatactgatgggtgggagaagcagaagaatagattcttgcaatttcctgctgggaggactccacctgcacaggcagatacacgggtacaatttcatcaggaccagttccgcttcttggtggtacatgaaactcagcttgccatttatgaagcaacaaaactggaatgtttaaagcagtggttcccgcgagatgctgctgcaccaatatcacatgcaactttctcatgtgatagcaacttgatatttgccagctttttagatgcaacaatctgtgtgttcagtgcttcaaaccttcgattgcgatgccgtatcaatccttctgcttatctttccgcaaatgtcagttctaacattcaaccacttgtaattgctgcacatccacacgaaccaaatcagtttgctgttggactgtcagatggcatagttcatgtgtttgagccccttgagtccgaaggcaagtggggtgtgcctccacctattgagaatgggtcagcaagcaatgcggtagctaattcggttggtgcttcttctgatgaagtccaaagatgattgatccagttccatccgatgacaagttttttttacaaactttaacttgctggccatcacaagaagtaggtatatataatatacttaaaatgcggggcactcaccaaatcagttgattcagctactctctagaaaatgcagtgcaaacaaaaccaagaccaacttatgtaaatttaatgaatttaatgatacggacgtagtagaagttcgttcttagggtacttctaccttttcctggatgtttatttagattggtttatcttaacttcttcctatttagcattcagttttatttagtctgcatgtactatggcaatcttgcctcccttacccacatttatatgtaaattatcaaacgttttcagtttgtgattcatgacatgtggatagataatgcttcaccttaaaaaattcaagaaatagccattagatataactgattt

SEQ ID NO: 9195 - DNA, 3967 bp, Medicago truncatula
gagagaaagagagagaaacatttaggagagagaaagttgttcttgttgtgttgtgtttggtctcttggtcttggtcttgtgaagtggttgttgttttctttctccatgtttgaagcttttacctttggatttcaagatctagtttagtgtttgctcattttgattttcatctgatccaagacaaaggggttgccatgtcatcactcagtagggagttggtgttcttgatcttgcagtttcttgaggaggaaaagttcaaagaggctgttcataagctagaacaggaatcagggttttactttaacatgaagtattttgaagaggaagtgcataatgggaactgggatgaggttgagaagtacctatctggtttcactaaagttgatgataataggtattctatgaagatatttttcgagataaggaagcagaagtatctcgaggcattggacaagcatgatcggtccaagggtgtcgaaatactagtgaaggatttgaaagtgttttctacatttaatgaagagttgttcaaggagatcacacagcttttgacactggagaattttagggaaaatgaacaattgtcgaagtatggtgatacgaagtctgcaagagcaatcatgttggttgagctcaaaaagttgattgaggcgaatcccttatttcgtgacaaattgcaatttcccaaccttaagaactcaaggttgcggactctcatcaatcaaagcttgaattggcagcatcaactttgtaagaatccgcggccaaatccagatataaaaactctttttgtggatcactcttgtggacaaccaaatggtgcacgtgctccatcacctgctaatatgccgctactaggatccttaccgaaggttggaggatttcctcctcttggtgcacatgggccttttcaaccaactccagcacctgtgccaatgcccttggctggttggatgtcaaatcctactcctgtggcgcatccctcagtttctggaggaggagctataggtcttggtgttggtggaccatcaatgcccgctgctttgaagcaccctaggacacctccaactaatccttctgttgactacccatctggggattcagatcacatttctaagagaacaagaccaataggaatgtctgatgagggaaatctacctgttaatgttctgtcagcgacatttccgggtcatggtcatggccaggcttttaattcacctgatgacctgccaaagacagtcttgcgaactctaaaccaaggctcgtctcctatgagcatggacttccatccagttcaacagactttacttcttgttggtacaaatgtggcggacattggtttatgggaattgggctctagggagcggttggtcttaaggaacttcaaagtttgggatctgagtgcttgttcaatgccatttcaggctgctctcgtcaaagatccagctgtttctgtcaaccgtgtgacttggagtcctgacggggctttgtttggagttgcttattcaaggcacattgttcagatatactcttaccatggtggggatgaagtacgacagcacttggagattgatgctcatgttggcggagtaaatgatctagcattttctcacccaaataagcagctatgcgtgatcacctgtggtgatgataaaactattaaggtgtgggatgctgctacgggtttaaaacagtacacttttgaaggtcacgaggctcccgtttattctgtctgcccacattataaagaaaacatccagttcatcttttcaacggcattggatggaaagataaaagcatggttgtatgacaacttgggatctcgtgttgattatgatgctcctggtcggtggtgtacaaccatggcttatagtgctgatggcacaaggctcttttcatgtgggactagcaaggatggtgaatcctctattgttgaatggaatgaaagtgaaggagctgtgaaaaggacttaccaaggatttcgaaagcgatctttgggtgttgtacaatttgatacgaccaaaaatcggtatctggctgctggtgatgatttctccattaaattttgggatatggacaatattcagcttttgacaactgttgatgctgatgggggtctcccggcaagcccacgcatccgtttcaataaggaaggatctcttttagctgtctctgcaaatgagaatggaattaaaatcttagccaatggagatggtattcgtttgctgcgctcattagaaaattcctcatatgatgcatcaagaacatcagaagccatgacaaagcctataataaatccgatgtcagttgctactgcggcaactagtgctgcacttgagagagcctcatctgtggccgctattactggaatgaatggtgatgtccggaacttaggtgatattaaacctagaataagtgaagaatccaatgacaagtcaaagatatggaagctcactgaaatcaatgaaccatctcattgtagatccttgaagctacctgagaatgcaagagtcacaaagatatcgaggttgatatatactaattcaggtaatgctattctggcattagcttcaaatgccattcatcttctctggaagtggcaacgaaatgatcgcaattcatctggcaaggccactgctagtgtgccacctcagttgtggcaaccttcaagtggcatcctgatgactaatgacattaatgataacaatactgaggatgcagtcccatgctttgctctttccaaaaatgattcttacgtaatgtcggcatcgggtgggaagatttctctcttcaatatgatgacttttaagacaatgacaacgttcatgccaccaccacctgcggcaacgtttctggctttccatcctcaagataacaatattattgctataggcatggatgattcttccattcagatatataatgtccgcgtagatgaggttaaaagtaaactcaaaggccatactaaaagaataactggtcttgcattttctcatgtactgaatgtgctagtttcatctggggctgatggtcagatttttgtatggaatactgatgggtgggagaagcagaagaatagattcttgcaatttcctgctgggaggactccacctgcacaggcagatacacgggtacaatttcatcaggaccagttccgcttcttggtggtacatgaaactcagcttgccatttatgaagcaacaaaactggaatgtttaaagcagtggttcccgcgagatgctgctgcaccaatatcacatgcaactttctcatgtgatagcaacttgatatttgccagctttttagatgcaacaatctgtgtgttcagtgcttcaaaccttcgattgcgatgccgtatcaatccttctgcttatctttccgcaaatgtcagttctaacattcaaccacttgtaattgctgcacatccacacgaaccaaatcagtttgctgttggactgtcagatggcatagttcatgtgtttgagccccttgagtccgaaggcaagtggggtgtgcctccacctattgagaatgggtcagcaagcaatgcggtagctaattcggttggtgcttcttctgatgaagtccaaagatgattgatccagttccatccgatgacaagttttttttacaaactttaacttgctggccatcacaagaagtaggtatatataatatacttaaaatgcggggcactcaccaaatcagttgattcagctactctctagaaaatgcagtgcaaacaaaaccaagaccaacttatgtaaatttaatgaatttaatgatacggacgtagtagaagttcgttcttagggtacttctaccttttcctggatgtttatttagattggtttatcttaacttcttcctatttagcattcagttttatttagtctgcatgtactatggcaatcttgcctcccttacccacatttatatgtaaattatcaaacgttttcagtttgtg

SEQ ID NO: 9196 - DNA, 4189 bp, Quercus alba
atataatttcctagagagagaaagagagagaagagtttgttttttagagagagagagagagaatggttctctaaagctctatctctctttgttcggttctgtttgtgttctttggttttcaagatctagtggtgtttttggtgattttggtttgttgggaatcgaacaagaggtgggcagctactatgtcgtcgcttagtagagagctcgtgttcttgatcttacagtttctagatgaggaaaagttcaaagagactgttcacaagcttgaacaggaatctgggtttttctttaatatgaaatattttgaggatgaggtgcataatgggaattgggatgaggttgagaagtacctttctgggttcacaaaagtggatgacaatcggtattcaatgaaaatcttttttgagataaggaagcagaagtatcttgaggcattggataagcatgaccggtccaaggctgtggatatattagtaaaggatttgaaagtttttgctacatttaatgaagagcttttcaaggagatcactcagctcttgacattggagaattttagggagaatgagcaactttccaagtatggagataccaagtctgcaagagcaatcatgttggtggagctcaagaagctgattgaagcaaatcctttattccgtgataaattacaattccccaatcttaaaaattcaaggttacggaccctcatcaatcaaagcttgaattggcagcatcaactgtgtaaaaaccaaggccaaatccagatataaaaactctttttgtggatcactcatgtggacaaccaaatggtgcacgagctccatcacctgcaaacaatccactgcttggatcattaccaaaagctgggggcttccctaacttaggtgctcatgggccttttcaacctacaccagcaccagttccaacgccccttgcaggttggatgtccaatccttccactgttactcatccggcagtttctggaggagctattggtcttggtgctccatcaatcccagctgctttaaaacatccaaggactcctccgaccaacccttctgtagactacccgtctggggattctgatcatgtttctaaaagaacgagaccaatggggatttctgatgaggtaaacctgcctgttaatgtgttaccagtaacatttccgggtcatgggcatggtcaggcttttaatgctccagacgacttgccaaagaatgtcgcacggactttaaatcaaggatcttctcctatgagcatggattttcatcctattcaacagactctacttcttgttggtaccaatgttggggacatagcgttgtgggaagttggctctagggagcgattggttttgaggaacttcaaagtttgggatcttagtgcatgttcaatgcctctgcagtcagctctagttaaagatcctggtgtatctgttaaccgcgtgatttggagccctgatggtactttatttggagttgcatactccaggcacattgttcaaatatattcttatcatgggaatgatgaagtacgacagcatctggagattgatgctcatgttggtggagtaaatgatatagcattctcccacccaaataagcaactttgtgtgataacctgcggtgatgataagaccatcaaggtgtgggatgctgcaacgggaacaaagcagtatacttttgaaggtcacgaggctcctgtttattccgtctgtcctcactataaggaaaacattcagtttatcttttctacggcactggatggaaaaataaaagcatggctgtatgacaacttgggatctcgagttgattatgatgctcctggtcgctggtgcacaacaatggcgtacagtgctgatggtacaagactcttttcatgtggtacaagtaaggatggggattcatttattgttgaatggaatgaaagtgaaggggctgttaaaaggacctatcaaggattccgcaagcgttctttgggtgttgtgcaatttgatacaactaaaaaccggtttttggctgctggtgatgatttctctatcaaattctgggatatggacaatgttcaacttttgttaactattgatgcggacggaggcctcccagcgagcccacgcatccgcttcaacaaggatggctctctcttggccatttctgccaacgaaaatggaattaaaatattatccaatacagatggcattaggttgttacgcacatttgagaatctatcttatgatgcatcaagagcgtctgaagctgttgcaaagcctacgatcaacccaatttcagctgcggcagctgctgctactagtgctggacttgcagacagaggtgcctctgtggttgctattgccggaatgaatggggatgcccgtaatttgggggatgtgaaaccaagaataatggaagaatccaatgacaaatccaagatttggaagctcactgaaatcaatgaaccatctcaatgccgatccctaaggctacctgaaaacctaagagtaactaagatttcgaggttaatctacacaaattcaggtaatgctgttctggcattagcatcaaatgccattcatctgctctggaaatggcagagaagtgatcgcaattcttctggcaaggcaactgccagtttgttacctaatttatggcaaccaccaagtggcattttaatgaccaacgatattgctgacactaatcctgaagattctgttccctgttttgctttatccaagaatgattcttatgtaatgtcagcatctggagggaagatttccttgttcaatatgatgacatttaagaccatgacaactttcatgccaccaccacctgcagcaacatttcttgctttccatcctcaagataataacatcattgccattggaatggatgattccacaattcaaatatataacgtccgtgtagatgaggttaaaagcaaacttaaaggacactctaaaagaattactggccttgccttttctcatgtactgaatgtgctggtttcatctggagcagatgctcagctttgtgtatggaactctgagggatgggaaaagcagaaggcaagaatcttgcagcttccaactggaaggactccagcacagtcagacacacgtgtacagtttcatcaggaccagatacactttctggttgtacatgaaactcagcttgccatatatgaaacaacaaaactagaatgtgtaaagcagtgggtcccacgtgaatctgcccccatttcacatgctacattctcatgtgatagcctgttggtatatgcctgcttcttagatgcgacagtctgtgtgttcaatgctgcaaatcttagactacgttgtcgaataaatccttctgcttatcttcctgctaatgtcagcagttctagtgtacaaccactcgtgattgcagcacatccacaagaaccaaatcaatttgcaataggactatcagatgggggggttcatgtctttgagcctcttgaatctgaaggcaaatggggtgtgcttccacctgttgagaatgggtcagtgagcagtgtgccagctactccttcagttggagcttcaggttctgatcaagcccagagatgatccagatagctgccagtgacaagttcttttacatgcttgcttgctggctcatctcaaacttaggtatgctttacaaggcttcttattctgttcgttatgggcagcatagttctatagcacctccagccagtaatgctaggcacacaacagttcacaatctttccacaattgttgacgtggcaaattgtgattggagcaacattactttcacgtgggcccactattgacttcacttttattggcactgatcacaccatatcacctcagcagatgtgaaaattgttgtcactagacttgctgatcttcagaacttcgattttaacatgatatgtcttcctcattcatgtttgatttttgtgttgtgcagtttgcaggtcatgatatgtaatttattcttaaggaaggacactgcaaaaagatgtagattttaacatgtttaatcaaaattatgaggtaaatgttgtaggagtattaaatagtggaatgtcagtttacttttgggaaggaatttcttctaaaatgactgtttatacttatcaggctatcttactcctaatgatttaatatcaattgtgttatgcatcaaatttcaatagagacacg

SEQ ID NO: 9197 - DNA, 3977 bp, Lupinus angustifolius
catgagagagaaaatcagaatgatttgagtttgaactatatctctgatctctcttgtgttggtggtgttgtcttttttgggttacatattcttcttcccatgtgacagagctttcaagatctagtttaaggttgctaattttggtgtgtatcttcaatagaagaaaaggttgactgcgatgtcatatctcagcagggagttggtgttcttgatcttgcagtttttggatgaggaaaagttcaaagagactgttcataagcttgagcaagagtcagggtttttctttaacatcaaatattttgaggatgaagtgcacaatggcaattgggatgaggttgagaggtacctctccggtttcacaaaagtagatgataatagatattctatgaagatatttttcgagataaggaagcagaagtacctggaagcactagataagcatgaccggtccaaggctgtagaaatattagtgaaagatttgaaagtttttgccacatttaatgaagaactcttcaaggaaatcacacagctcttgacattggagaactttagggaaaacgaacaattgtctaagtatggcgatacgaagtctgcaagagcaatcatgttggttgagctcaaaaagttgattgaggcaaatcccttatttcgcgacaaattacaatttcccaatcttaaaagctcaagattaaggactctcatcaaccaaagcttgaattggcagcatcaactttgtaagaatccacggccgaatccagatataaaaactctttttgtggatcactcatgtggacaaccaaatggtgcacaagcgccatcacctgcttatagtccgctactaggatccttaccaaaagctggaggatttccttctcttggtgctcatgggccttttcaacctactccagcacctttgccaacacccctggctggttggatgtcgaatcctaccactgtagcacatcctgcagtttctggaggaggagctataggtcttgctgcattgaagaacactagggtccctccaactaatccttctgttgactacacatctggagattcagttcatgtctcaaagaaaacaagaccaatggggctgtcagatgaggtaaatctaccagtcaatgtgttgtcgtcgacattccagggtcatgatcacggtcatggtcactcctttaatgcatctgatgacttgccaaagactgtaatgcgaactctgaaccagggttcatctcctatgagcatggactttcatccagttcaacaaactttacttctcgttggtacgaatgtgggggacattgctttgtgggaagtgggtactagggaacgattggtcttgaggaacttcaaagtttgggaacttggttcttgttcaatgcaatttcaggctgctcttgtcaaagatccatgcgtttctgtcaaccgtgtgatttggagtcctgatggtgctttattcggggttgcatactcaaggcacattgttcagatacactcttaccatggtgcagatgaagtacgacagcacctggagattgatgctcatgttggtggagtaaatgatttggccttttcccatccaaataagaaactatgtgtgataacctgcggtgatgataagaccattaaggtgtgggatactgctactggtacaaagcagtatacttttgaaggtcatgatgctcctgtttattctgtctgcccacattataaagaaaacattcagttcatcttttcgacagcattagatggaaagataaaagcatggttatatgacaatttgggatctcgtgttgattatgatgctcctggccgttggtgcacaaccatggcctatagtgctgatggcacaaggctcttttcatgtggtacaagcaaggatggggaatcctctattgttgagtggaatgaaagtgaaggagctgtgaaaaggacttatcaaggattccgtaaacgatctttgggtgttgtacaatttgatacaaccaaaaaccgatatttggctgccggagatgatttctccattaaattctgggatatggacaatattcagcttttgacaactgttgatgctgatggaggtctccctgcaagcccacgtatccgtttcaacaaggatggagctcttttagccgtctctgcgaatgagaatggaattaaaattctagccaatggagatggtattcatttgttgcgttcactagagaattctttatatgatgcatcaagaacatcagaagccatggcaaagcctacgataaatccaatttcagctgcagcagcagccgccgctgcatctagcgctgcacttgcagagaggacctcatctgtagcagctattgctggaatgaatggggatgcccgaactctggttgatgttaaacctagaataagtggagaatccagtgacaagtcgaagatatggaagctgactgaaatcagtgaaccatctcaatgtcgatccttgaaactaccagagaacgcaagagtaaccaagatatcaaggttgatatatactaattcaggcaatgctattctggcgttagcttcaaatgccattcatctgctctggaaatggcagcgaagtgaccgtaattcatctggcaaggccaatgccagcatgtcacctcagttgtggcaaccttcaagtggcatcctgatgactaatgatattaacgataacaccaccgaggatgcagttccctgctttgctctgtccaagaatgattcttacgtgatgtcagcatcgggagggaagatttctctgttcaatatgatgactttcaagactatgacaactttcatgcctccaccacctgcagcgacctttcttgctttccatcctcaggataataatattattgctataggcatggatgattcttccattcagatatataatgttcgcgtggacgaggttaaaagtaaactcaaaggccatactaaaagaataaccggtcttgctttctctcatgtattgaatgtgctagtttcatctggggcagatgctcagctttgtgtgtggaatacaaacggatgggaaaagcagacgactaggtttttgcaacttcctgctgggaggactccaccagcacaggcggatactcgtgtacagtttcatcaggatcagatccacttcttggttgtacatgaaactcaacttgccatttatgaagcgacaaaactagaatgtctaaagcagtggtcgccaagagattctgctgcaccaatatcacatgcaactttctcttgtgatagccagctaatatatgccagctttttagacacaaccgtctgtgtatttagtgcttcaaacctcatattacgctgtcgcatcaatccttctgcttatctttctgcgagtgtcagcaattctaatgtacaaccacttgtgattgcggcgcatccacacgaaccaaatcagtttgctgtaggattgtcagatggtgcagttcatgtgtttgagccccttgagtccgaaggcaaatggggtgtgcctccacccattgagaatggttcagcaagtaatgttgcagctacttcagttggaccttcctcggatgaagctcaaagataatccattttcagccaaagataagtttattttacatacctgaattgctagtcatttcaagaactaggtggtaatgtacttaagttaatgcagcaggagatgacccatttggttgaaaaccaaaagaacatcataattgctaatatatgtgaaatttctttttaagtttaatgccatagttgtagaagttattgagtactttcaaggtctttgttgctatttatttagattggtttatcctaatttgttctcttttgtaatcaccatctagtgtgcatgtaaactcactaagctaatcttgtctttattttgtataaatatatatttttaagtagtgcagtttgattcatgttatgtagttttactaaagtttgaggtgcaaaggtgtagaatttttttatac

SEQ ID NO: 9198 - DNA, 4272 bp, Glycine max
caaaacaaagccggcttagtgggcccctcactaaactgcacttgaaatataagctgtagtgcttctcttatagcttattgtcacactgataaccactaaacgataagttattctgcttatcatctccttctctgtcgcctcctatgtaaaaaacacctatttgagcaagttcatgtgtcctatatatatctagagagaggtaattagagacagagagtgagtgagaagtatattaggacatttcttgcaggagagagaaagtggaagagaagagagagaaggtttggtcttttgtgttttggtctctcttctcttgtggtgtgttggtggtggtggtggtggtggtggtggtggtggtgcgttccatattcgggggacctttcttcccatgtgtgtgtgtgagctttgaagatctagtctatagttgctcattttggtgctggtctaatcgaagacgaggcggttacgatgtcatctctaagtagggagttggtgttcttgatcttgcagtttctggatgaggaaaagttcaaagaaactgttcacaagcttgagcaggagtctgggtttttctttaacatgaaatattttgaggatgaagtgcacaatggtaattgggacgaggttgagaggtacctctctggtttcaccaaagtggatgataataggtattctatgaagatattttttgaggtaatgaagcagaagtacctggaggcattagataagcatgatcggtccaaggctgtagaaatattagtgaaggatttgaaagtctttgccacatttaatgatgaactgtttaaggaaatcacacagcttttgacattggagaattttagggaaaacgagcaattgtctaagtattgtgatacaaagtctgcaagggcaatcatgttggttgagctcaaaaagttgattgaggccaatcccttatttcatgacaaattgcaatttcccaaccttaaaagctcaaggttacggactctaatcaatcaaagcttgaattggcagcaccaactttgtaagaatccacggccaaatccagatataaaaactctttttgtggatcattcatgtggacaactaaatggtgcaccggctccatcacctgctaataatctgctacttggatcattaccaaaggccggaggatttcctcctcttggtgcacatgggccttttcaaccttctccagcccctgtgccaacacccctggctggttggatgtcaaacccaaccactgtagcacatcctgaagtttcaggaggagctataggtcttggtgtgccatcaattcctgctgctttgaagcaccctaggacccctccaacttatccttctgttgactatccatctggtgattcagatcatgtttctaagagaacaagaccaatgggaatgtcagatgaggtaaatctgcctgtcaatgttttgtcagcaacgttccctggtcatggtcatggtcatggtcatggtcaggcttttaatgcccctgatgatttgccaaagactgccatgcgaactctgaaccaaggctcatctcctatgagcatggactttcatccggttcaacagacactgcttcttgtcggtacgaatgtgggggacattgctttgtgggaagtgggctctagggagcggttgctcatgaggaactttaaagtttgggatcttagtgcttgttcaatgccctttcaggctgctcttgtcaaagatccgggtgtttctgtctaccgtgtgatttggagtcctgatggggctttatttggagttgcttactcaaggcacatcgttcagatatactcttaccatagtggggatgatgttcaacagcatctggagattgatgctcatgttggtggagtaaatgatctagcgttttctcacccaaataagcaactatgtgtcataacctgtggtgatgataagaccattaaggtttgggatgctgctacgggtgcgaaacagtatactttcgaaggtcatgaagctccagtttattctttcatcttttcaacggcattagatggaaagataaaagcatggttatatgataatttgggatctcgtgttgattatgaagctcctggacgttggtgtacaaccatggcctatagtgctgatggtacaagactcttttcatgtgggacaagtaaggatgcggaatcctctattgttgagtggaatgaaagtgaaggagctgtgaaaaggacttatcaaggatttcggaaacgatctttgggttttgtacaatttgatacaaccaaaaaccgatatttggctgcaggtgatgatttctccattaaattctgggatatggacaatattcagcttttgacaactgttgatgcggatgggggtctccctggaagcccacgaatccgttttaacaaggatggagctcttttagctgtttctgcaaaagagaatggaattaaaatcttagccaatgcagatggtattcgtttgttacgcacattagaaaattctttatatgatacatcaagaacatcggaagtcatgacaaagcctacaataaatccaatttcagcagccgccgccgctgcaactagtgctgcacttggagagagggccttgtctgtgaatggggatgcccggaacttgggtgatgttaaacctagaataagtgaagaatccaatgataagtcaaaaatatggaagctaactgaaatcaatgaaccatctcaatgcagatccttgaagctacctgagaatgtcagagtgaacaagatatcaaggttgatatatactaattcaggtaatgctatcctggcattagcttcaaatgccattcatctgctctggaaatggcagcgaaatgaccgtaattcaactgtaaaggcctctgccagcgtgcaaccccagttgtggcaaccttctagtggcatcctgatgactaatgacattactgatagcaatactgaggatgccgttccctgctttgctctgtcgaaaaatgattcttatgtaatgtcagcatcaggagggaagatttctctgttcaatatgatgacttttaagacaatgacgacattcatgcctccgccacctgcagcaaattttcttgcttttcatcctcaagataacaatattattgctataggcatggatgattcttccatacaaatatataatgtccgcgtagatgaggtaaaaagtaaacttaaaggccatactaaaagaataactggtcttgctttttctcatgtgttaaatgtgctagtttcatctggggcagatgctcagatttgtgtgtggaatactgacggatgggaaaagcaaaagtctagattcttgcaacttcctgctgggaggactccaccagcacaagcagatacccgtgtacagtttcatcaggatcagatccgcttcttggttgtacatgaaactcagcttgccatttatgaagcaacaaagctagaatgtttaaagcagtggttcccacgggattcatcagcaccaatatcacatgcaactttctcatgtgatagccagctcatatatgccagctttttagatgcaacagtctgtgtatttagtgtttcaaaccttagattacagtgtcgaatcaatccttctgcttatctttctgcaagtgtcagttctaacgtacaaccacttgttattgctgcacatcctcaagaaccaaaccagtttgctgtaggactgtcagatggcggagttcatgtctttgagccccttgagtctgaaggcaaatggggtgtgcctccacccattgagaatgggtcaacgagcaatatggcagctacttcagttggagcttcttcagatgaagctcagagatgatccatgtcagccaaagacaagtttcttttacatacttggcttgctggccatttcaagaattaggtatgtacttatgataatgcagggcaccctctgaattagttgatccaactattctcttgatccattgtgttgtctggcctttgtgcagtcacataccagaacaatggaccaaaccccaaaccaaaaactaaaccttgtaattgtcaaaatatgtgaaaatttctttcaagtttaatgctactgaagcagaagtttaagtaaagaggatccctgtgatgagatgacatccatccaagcatcaaccacaattgcagcagcagcaccaccaccaccatatgcatttgcatattctcccaagtaactatcctataaaacaacaacaacaacaacaacataataataataataataataataagagtaagacctgtaaggaaa

SEQ ID NO: 9199 - DNA, 4091 bp, Castanea mollissima
gagagaatggttctctaaagctctatctctctttgttcggttctgtttgtgttctttggtttacaagatctagtggtgtttttggtgattttggtttgttgggaatcgaacaagaggtgggcggctactatgtcatcgcttagtagagagctcgtgttcttgatcttacagtttctagatgaggaaaagttcaaagagactgttcacaaacttgaacaggaatctgggtttttctttaatatgaaatattttgaggatgaggtgcataatgggaattgggatgaggttgagaagtacctttctgggttcacaaaagtggatgacaatcggtattcaatgaaaatcttttttgagataaggaagcagaagtatcttgaggcattggataagcatgaccggtccaaggctgtggatatattagtaaaggatttgaaagtttttgccacatttaatgaagagcttttcaaggagatcactcagctcttgacattggagaattttagggagaatgagcaactttccaagtatggagataccaagtctgcaagagcaatcatgttggtggagctcaagaagctgattgaagcaaatcctttattccgtgataaattgcaattccccaatcttaaaaattcaaggttacggacccttatcaaccaaagcttgaattggcagcatcaactgtgtaaaaacccaaggccaaatccagatataaaaactctttttgtggatcactcatgtggacaaccaaatggtgcacgagctccatcacctgcaaacaatccactgcttggatccttaccaaaagctgggggcttccctaacttaggtgctcatgggccttttcaacctacaccagcaccagttccaacaccccttgcaggttggatgtccaatccttccactgttactcatccggcagtttctggaggagctattggtcttggtgctccatcaatcccagctgctttaaaacatccaaggactcctccgaccaacccttctgtagactacccgtctggggattctgatcatgtttctaaaagaacaagaccaatggggatttctgatgaggtaaacctgcctgttaatgtgttacccgtaacatttccgggtcatggtcatggtcaggcttttaatgctacagacgacttgccaaagaatgttgcacggactttaaatcaaggatcttctcccatgagcatggattttcatcctattcaacagactctacttcttgttggtaccaatgttggggacatagcgttgtgggaagttggctctagggagcgattggttttgaggaacttcaaagtttgggatcttagtgtatgttcaatgcctctgcaggcagctctagttaaagatcctggtgtatctgttaaccgcgtgatttggagccctgatggttctttatttggagttgcatactccaggcacattgttcaaatatattcttatcatgggaatgaagatgtacgacagcatctggagattgatgctcatgttggtggagtaaatgatatagcattctcccacccaaataagcaactttgtgtgataacctgcggtgatgacaagaccatcaaggtgtgggatgctgcaacaggagcaaagcagtatacttttgaaggtcacgaggctcctgtttattccgtctgtcctcactataaggaaaacattcagtttatcttttctacagcactggatggaaaaataaaagcatggctgtatgacaacttgggatctcgagttgattatgatgctcctggtcgctggtgcacaacaatggcatacagtgctgatggtacaagactcttttcatgtggtacaagtaaggatggggagtcatttattgttgaatggaatgaaagtgaaggggctgttaaaaggacctatcaaggattccgcaagcgctcattgggtgttgtgcaatttgatacaactaaaaaccggtttttggctgctggtgatgatttctctattaaattctgggatatggacaatgttcaacttttggtaactattgatgctgacggtggcctcccagcaagcccacgcatccgcttcaacaaggatggctctctcttggccatttctgccaacgataatggaattaaaatattatccaatacagatggtattagattgttacgcacatttgagaatctatcttatgatgcatcaagagcgtctgaatctgttgcaaagcctacgatcaacccaatttcagctgcggcagctgctgctactagtgctggacttgcagacagaggtgcctctgtggttgctattgctggaatgaatggggatgcccgtaatttgggggatgtgaaaccaagaataatggaagagtccaatgacaaatccaagattttgaagctcactgaaatcaatgaaccatctcagtgccgatccctaaggctacctgaaaacctaagagtaactaagatttcaaggttaatctacacaaattcaggtaatgccgttctggcattagcatcaaatgccattcatctgctctggaaatggcagagaagtgatcgcaattcttctggcaaggcaactgccagtttgtcacctaatttatggcaaccaccaagtggcattttaatgactaacgatattgctgacactaatcctgaagattctgttccctgttttgctttatccaagaatgattcttatgtaatgtcagcatctggagggaagatttccttgttcaatatgatgacatttaagaccatgacaactttcatgccaccaccacctgcagcaacatttcttgctttccatcctcaagataataacatcattgccattggaatggatgattccacaattcaaatatataacgtccgtgtagatgaggttaaaagcaaacttaaaggacactctaaaagaattactggccttgccttttctcatgtactgaatgtgctggtttcatctggagcagatgctcagctttgtgtatggaactctgagggatgggaaaagcagaaggcaagactcttgcagcttccaactggaaggactccagcacagtcagacacacgtgtacagtttcatcaggaccagatgcactttctggttgtacatgaaactcagcttgccatatatgaaacaacaaaactagaatgtgtaaagcagtggctctcacgcgaatctgcccccatttcacatgctacgttctcatgtgatagcctgttggtatatgcctgcttcttagatgggacagtctgtgtgtttaatgctgcaaatcttagactacgttgtcgaataaatccttctgcttatcttcctgctaatgtcagcagttctagtgtacaaccactcgtgattgcggcacatccacaagaaccaaatcaatttgcaataggactatcagatgggggggttcatgtctttgagcctcttgaatctgaaggcaaatggggtgtgcttccacctgttgagaatgggtcagctagcagtgtgccagctactccttcagttggagcttcaggttctgatcaagcccagagatgatccagatagctgccagtgacaagttcttttacatgcttgcttgctggctcatctcaaacttaggtatgctttacaaggcttcttattctgttcgttaagggcagcataattctatagcacctccagccagtaatgctaggctcaatctttccacaattgttgacgtggcaaattgtgattggagcaacatcactttcacgtgggcccactattgacttcacttttattggcacccatcacaacatatcacctcagcagatgtgaaaattgttgtcactagacttgttgatcttcagaacttcgatttaacatgatatgtctgcctcattcatgtttgatttttgtgttgtgcagtttgcaggtcatgatatgtaatttattcttaaggaaggacactgcaaaaagatgtagattttaacatgtttaatcaaattatgaggtaaatgttgtaggagtattaatagtggaatgtcagtttacttttgggaaggaatttcttcaaaaatgacggtttatactttatcaggctatcttacttctaatgatttaatatcaaaaaa

SEQ ID NO: 9200 - DNA, 4081 bp, Ricinus communis
taatgtttgtatgtgtatatatataaaatttattcttgagagagaaagtctagaaagagaaagataaaagagagataaatcttgccttcaatttctagagagaggaaactgtgtttttcttagagagagaaataagctttctctctctgatctcgatctagtgctaattagggttatattcccgcatttcaaagcaaaaacggggcgttcaagatgtcgtctctcagtagagagcttgtgttcttgatccttcagtttctcgatgaggaaaagttcaaagagactgttcacaagcttgaacaggaatctgggtttttctttaacatgaagtattttgaggatgaggtgcatagcggtaattgggatgaggtggagaagtacctttctggtttcacaaaagtggatgataatcgatactcgatgaaaatcttttttgagattaggaagcaaaagtatcttgaggccttggataagcatgatcggtccaaggcagtagatatattggtaaaggacttgaaagtgtttgccacattcaatgaggagcttttcaaagaaatcacacaattattgactttggagaactttagggagaatgagcaactatcaaaatatggagatacaaagtcagcaagagcaattatgttggtggagctgaagaagagcttattgaagcaaatcccttatttcgtgataaattgcagtttccaaaccttaaaaattcaaggttgcggactctgattaaccaaagcttgaattggcagcatcagttgtgtaaaaatccaaggccaaatccagatattaaaactctatttgtggatcattcatgcgggcaaccaaatggtgctcgggctccatcacctgcaaacaatccactgcttggatccttaccaaaagctggaggatttcctcctcttggtgcacatgggccatttcaacctacaccagcaccggttccagcaccacttgcaggatggatgtctaatccttctgctgtaactcatccagcagtttctggaggaggagccattggtcttggtgccccatcaatcccagctgctttaaagcatccaaggacacctccaactaacccttctgtagattacccttctggagattctgatcatgttgcaaaaagaacaaggcccatgggaatttctgatgaggtaaatttgccagttaatgtgttgccggtatcatttccaggacatggtcatggtcagaattttaatgcaccagatgacttgccgaagactgtttcacggactttgaatcagggatcatctcctatgagcatggacttccatcctcttgaacagactcttcttctagttggtaccaatgtgggggatgttgccctatgggaagttggttctagggagcgactaatgctaagaaactttaaagtctgggatattagcacatgttcgatgcctctgcaggcagccctagtcaaggatcctggtgtatctgtaaaccgtgtgatttggagtcccgatggttcattatttggagttgcatactcgaggcacattgtacaaatatattcttaccataggggtgatgatgtaaggcagcacttggagattgatgctcacgttggtggagtaaatgatcttgcattctctactcctaataaacaactttgtgtaataacctgcggtgatgacaagacaatcaaggtatgggatgctgctactggtacaagacagtatacttttgaaggccatgaagctcctgtttactctgtctgccctcactataaggaaaacattcagtttatattttcaacagcactagatggaaagataaaagcatggttgtatgacaacctaggatcacgagttgattatgaggctcctggtcgctggtgcacaactatggcttatagtgctgatggtacaaggctattttcatgcgggacaagtaaagatggggagtcacatattgttgaatggaatgaaagtgaaggtaatgtgaaaaggagctatcaaggtttccgcaaacgttctttgggtgttgtgcaatttgatactacaaagaatcggtttttggctgctggtgatgatttctctatcaagttctgggatatggataatcttcaacttttgacatcaattgatgctgatggaggccttccagcaagcccgcggatccgcttcaacaaagatggcagtctcttggcagtgtctgccaacgagaatggtattaaaatactggcaaattcagatggtcataggttgttacgcacatttgagaatctctcttatgatgcctcacgagcatctgaagctgttacaaagcctataattaaccccatatcagcagcagcagcaactagtgctgggcttgctgacagaactgcttctgtggttactattcctggaatgaatggagatgctcggaacatgggagatgtgaaacctagaataactgaagaatccaatgacaaatcaaagatatggaagctcacggaaatcaacgaaccaactcaatgtcgatcattaaggctccctgataacttgagagtgaacaagatatcaagattaatttatacaaattcaggtaacgcaattttggcattagcatcgaacgcaatccatctgctatggaaatggcaacgaagtgagcgtaattcaactggcaaggcaactgccaatgtgtcacctcaattatggcaaccatcaagtggcattctgatgaccaatgacatcactgacactaaccctgaagaggctgttccctgctttgctttgtctaaaaatgattcctatgtcatgtcagcatctggaggaaagatttcccttttcaatatgatgacatttaagacaatgacaactttcatgccgccaccaccagcagcaacatttctcgcatttcatcctcaagataataacattattgctattggcatggatgattccacaattcagatttataatgttcgggtagatgaggtcaagagcaagctcaaaggccattctaaaagaattactggccttgccttctctcatgtattgaatgtgctagtttcatcaggagcagatgcccagctatgtgtatggaattctgatggatgggaaaagcagaagacaagattcttgcaggttcctcctgggaggaccacaacaggacaatcagacacacgtgtacagtttcatcaggaccagatacagtttctggttgtacatgagactcagcttgccatatatgaagcaacaaaactagagtgtaccaagcagtgggtcacacgtgaatcttccgcgccaatctctcatgcaacattctcatgtgatagtcagcttgtatatgctagcttcttagatgcaacagtatgtgtgttcagtgcgcagaatctgagactacgctgtcgcatcaatccttcctcatatctttctgctaatgttagttctagtctccatccacttgtgattgctgcacatccgcaagaaccgaatcagtttgcattgggactgtctgatggtggagttcatgtgtttgaaccccttgaatctgaaggcaaatggggggtacctccacctgctgagaatgggtcagcaagcagtgttccagctactccttctgtcggaccttcaggttcagatcaagcccagagatgatcaaatgactgccacagcacaagtttttttacatgcttggcttgctggcccattcctaagttagtttgaggttcatgatatgtaatttactcaaggaacaacttgcaaaagatgtagatttagcatgttttgtcagatactatgtaaggtaaatgctgtaggaatatttgtagtgaactgcattttgccattaagaaagaaatttcatgatgattttttttttttggaagaaaattttttggttgtatgtttattctctccttgcaaatgttaaaatacgctgaaattttttgttgtcttgtcctgaaaccttggcatcctcaaatactaaaaaagcaccaatatttgttttttgggggttctgtttacgggcaaactcgtctgatgtcctctcgctctctttacactctggaattttgagacttagaatatttatactcaaataaagtactttaccctaatac

SEQ ID NO: 9201 - DNA, 3428 bp, Manihot esculenta
atgtcatctctcagtagagagcttgtgttcttgatcctgcagttccttgatgaggaaaagttcaaagagactgttcacaagcttgaacaagaatctgggtttttctttaacatgaagtattttgaggatgaggtgcacagtggaaattgggatgaggtggagaagtatctttcaggtttcacaaaagtggatgataatcgatactcgatgaaaatatttttcgagattagaaagcaaaagtaccttgaagcattggataagcatgatcgttccaaggcagtggatatattggtaaaggatttgaaagtgttttccacattcaatgaggagcttttcaaagaaatcactcagctattgacattggagaatttcagagagaatgagcaactatccaagtatggagacacaaaatcagcaagagcaattatgttagtggagctcaagaagcttattgaagcaaatcccttgtttcgtgataaattgcagtttcctaaccttaagaattcacggttgcggactctcattaaccaaagcttgaattggcaacatcaactttgtaaaaatccaaggccaaatccagatattaaaactctctttgtggatcattcatgtgggcaaccaaatggtgctcgagctccatcaccagcaaacaacccactgcttggatctttaccaaaagctggagggtttcctcctcttggtgcacatgggccattccagcctacaccagcacctgttccagcacctcttgcaggttggatgtctaatccttccagtgtaactcatccagctgtttctggaggaggagccattggccttggtgctccatcaatcccagctgctctgaagcatccaaggactcctccaactaatacttctgttgactatccatctggagattcggatcatgttgcgaaacgaactaggcccatgggaatttctgatgaggtcaatttgccagttaatgtgttgccagtatcatttccaggacatggtcatggtcagacttttaatgcaccagatgacttgccaaagactgttgctcggactttgaatcagggatcatctcctatgagcatggatttccatcctgttcaacagactcttcttctagttggtaccaatgtgggggatgtggggctgtgggaagttggttctagggagagactggtgttaagaaacttcaaagtttgggatcttagtacatgttcaatgcctctgcaggcagctctagttaaagatcctggcgtgtcagtgaaccgagtgatttggagtcctgatggcaacttgttcggagttgcatactcaaggcacattgtacaaatatattcttaccatggtggtgacgatgtaaggcagcacttagagattgatgctcatgttggtggagtaaatgatcttgcattctccacccctaataagcaactttgtgtaataacttgcggagatgacaagaccatcaaggtatgggatgctgctactggttcaaaacagcatacttttgagggtcatgaggcccctgtttattctgtctgccctcactataaggaaaacattcagtttattttttcaactgcattggatgggaagataaaggcatggttgtatgacaatttgggatctcgagttgattatgaggctcctggtcgctggtgcacaaccatggcttacagtgctgatgggacaaggctcttttcatgtgggacaagtaaagagggggagtcgcatattgttgaatggaatgaaagtgaaggtaatgtgaaaaggagctatcaaggtttccgcaaacgttcgttgggtgttgtgcaatttgatacaacaaagaaccgttttttggccgctggtgatgatttctctatcaagttttgggatatggacaatgttcaaattttgacatcaattgatgctgatggaggccttccagcaagcccacgtatccgcttcaacaaggatggcactctcttggcagtttctgccaatgagaatggtattaaaatattagcaaattcagatggtctcagattgttacgttcatttgagaatctctcttatgatgcctcacgagcatctgaaactgttacaaagccgattattaccccaatctcagcagcagcagcagcagctgcaactagtgctggacttgcagatagaagtgtttctgtcgttaatattcccggaatgaatggagatgctcggaacttgggagatgtgaaacctagaataactgaagaatccaatgacaaatcaaagatatggaagctcactgaaattaatgaaccatctcaatgtcgttccttaaggcttcctgagaacttgagagtgaacaagatatcaaggttaatttatacaaattcaggtaatgccattttggcattagcatcaaatgctattcatctgctatggaagtggcaacgaagcgaccgtaattcaaccggcaaggcaactgccagtgtgtcacctcaattatggcaaccatcaagtggcatcctgatgaccaatgacattactgacacaagtcctgaagaggctgtgccatgctttgctttgtccaaaaatgattcttacgttatgtcagcatctggaggaaagatttcccttttcaatatgatgacatttaagacaatgacaactttcatgccgcccccacctgcagcaacatttcttgcatttcatccgcaagataataatattattgctatcggcatggatgattctacaatacagatctataatgttcgtgtagatgaggtcaagagcaagctcaaaggtcactctaaaagaattacgggccttgccttctctcatgtgctgaatgtgcttgtttcatcaggagcagatgctcaactttgtgtatggaactctgatggatgggaaaagcagaagacaagattcttgcaagttccacctgggaggactacaactggacaatcagaaacacgtgtccaatttcaccaggaccagatacaattcctggttgtacatgagactcagcttgcaatatatgaagcaactaaactagagtgtgcaaagcagtgggtcacacgtgaatcctctgcaccaatctctcatgcaacattctcatgcgatagtcagctggtatatgccagcttctttgatgcaacagtctgtgtgtttagtgcacaaaatctgagactgcgttgtcgcatcagtccttcctcttatcttcctgctaatgtcagttctaatgtccacccactagtgattgctgcacatccacaagaatcaaatcagtttgcattaggactgtccgatggtggggttcatgtgtttgaaccccttgaatctgaaggcaaatggggtgttcctcctcctgctgagaatgggtcagcaagcagtgtgccagctgcttcttctgttggaccttcaggttcagaccaagcccagagatgatccaatgcccgccagag

SEQ ID NO: 9202 - DNA, 3985 bp, Manihot esculenta
gtgtgtgtacaattataaattttctagagagagaaggtctcgaaagagagataaatcttgcttcatttccggtgagagaaagctgtgttttttagagagagaaagcttctcttagcgctcgctctggttctctgatctctctgctatgtttacgagatctagtgttaattaggtgatatttgcgcatttccaagcgaaacgggactattaagatgtcatctctcagtagagagcttgtattcctgatcctgcagttccttgatgaggaaaagttcaaagagactgttcacaagcttgaacaggaatctgggtttttctttaacatgaagtattttgaggatgaggtgcacagtggtaattgggatgaggtggagaagtacctctctggtttcacaaaagtggatgataatcgatactcaatgaaaatctttttcgagattaggaagcaaaagtatcttgaagcattggataagcatgatcgttccaaggcagtggatatactggtaaaggatttgaaggtgtttgccacattcaatgaggagcttttcaaagaaatcactcagctattgacattggagaatttcagggagaatgagcaactatccaagtatggagacacgaagtctgcaagagcaattatgttggtggagctcaagaagcttatcgaggcaaatcccctgtttcgtgataaattgcagtttcctaaccttaaaaattcaaggttacggaccctcattaaccaaagcttgaattggcagcatcaactttgtaaaaatccaaggccaaatccagatattaaaactctctttgtggatcattcatgtgggcaacccaatggtgctcgggctccatcacctgcaaacaatccactgcttggatccttaccaaaagctggaggttttcctccacttggtgcacatgggcctttccaacctacaccagcgcctgttccagcacctcttgctgggtggatgtctaatccctccactgtaactcatccagcagtttctggagggggagccattggccttggtgctccatcaattgcagctgctctgaagcatccacggactcctccaactaacccttctgttgactatccatctggagattctgatcatgttgcaaaaagaacaaggcccatgggaatttctgatgaggtcaatttgccagttaatgtgttaccggtatcatttccaggacatggtcatggtcatggtcagacttttaatgctccagatgatttgccgaagactctttctcggactttgaatcagggatcatcacctatgagcatggatttccatcctgttcaacagactattcttctagttggtaccaatgtgggagatgttgggctgtgggaggttggttcgagggagcgtctggtgttgagaaacttcaaagtttgggatcttagtacatgttcaatgcctctgcaggctgctttagtgaaagatcctggcgtgtccgtgaatcgtgtgatttggagtcctgatggctccttatttggagttgcatactcgaggcacattgtacaaatatattcttaccatggtggtgatgatgtaaggcaacacttggagattgatgctcatgttggcggagtaaatgatcttgcattctccacccctcataagcaactttgtgtaataacttgcggtgacgacaagaccatcaaggtgtgggatgctggtactggttcaaaacagtatacttttgaaggtcatgaggctcctgtttattctgtctgccctcattacaaggaaaacattcagtttattttttcaactgcattggatgggaagataaaggcatggttgtatgacaatttgggatctcgagttgattatgaggctcctggtcgttggtgcacaaccatggcttacagtgctgatggtacaaggctcttttcatgtgggacaagtaaggagggggagtcacatatcgttgagtggaatgaaagtgaaggtaatgtgaaaaggagctatcaaggtttccgcaaacgttctctgggtgttgtgcaatttgatacaacaaagaatcgatttttggctgctggtgatgatttctctatcaagttctgggatatggacaatgttcaacttttgacatcaattgatgctgatggaggccttcctgcaagcccacgtatccgcttcaacaaagatggaactctcttggcagtttccgctaatgataatggtattaaaatattggctaattcagacggtcttagattgttgcgatcatttgagaatctctcttatgatgcctctcgagcatctgaaacagttaccaagcctataattaacccaatctcagcagcagcagcagctgcagctgcaactagtgctggacttgcagatagaaatgcttctgtggttactattcctggaatgaatggagatgctcggaacatgggagatgtgaaacctagaataaatgaagaatctaatgacaaatcgaagatatggaagctcactgaaattaatgaacaatctcaatgtcggtccttaaggcttcctgaaaacttgagagtgaacaagatatcaaggttaatttatacaaattcaggtaatgccattttggcattagcatcaaatgcaattcatctgctatggaagtggcaacgaagtgaccgtaattcaactggcaaggcaactgccagtatgtcacctcagttatggcaaccatcaagtggcattctgatgacaaatgactttactgacactaaccctgaagaggctgtgccatgctttgctttgtccaaaaatgattcctatgttatgtcagcatctggaggaaagatttctcttttcaatatgatgacatttaagacaatgacgactttcatgccaccaccacctgctgcaacatttcttgcatttcatccgcaagataataatattattgctattggcatggatgattccacaattcagatctataatgtccgtgtagatgaggtcaagagcaagctcaaaggccactctaaaagaataactggccttgccttctctcatgtgctgaatgtgctagtgtcatcaggagcagatgctcaactttgtgtatggaactctgatggatgggaaaagcagaagacaagattcttgcaagttcctcctgggaggacaacgacaggacaatcagatacacgtgtacaatttcatcaggaccagatacaattcctggttgtgcatgatactcagcttgcaatgtatgaagcaactaaactagagtgtacaaagcagtgggtcacacgtgaatcgtctgctccaatctctcatgcaactttctcatgtgatagtcagctggtatatgccagcttcttagatgcaacagtgtgtgtgtttagtgctcaaaatctaagactacgttgtcgtatcaatccttcgtcttatcttcctgctaatgtcagcatttctaatgtccacccacttgtgattgctgcacatccacaagaatcaaatcagtttgcattgggactatctgatggtggggttcatgtctttgaaccccttgaatctgaaggcaaatggggtgtgccgcctcctgctgagaatgggtcagcgagcagtgtgccagctgctccttctgttggaccttcaggttcagaacaagcacagagatgatcattagcctgccacagcacaagttcttttacatgcttggtttgctggcctactcctaagttagtttgatgttgatgatatgtaatttactcaagaggaacaacttgcaacagatgtagatttagcatgttttgtcagatactgtgtaaggtaaatgatgtaggaatattattagtaaatgcaattcaccatttagaaaatatatcttgaacatttatttatttatttttttgttactgtgtttattatctttcctttcaattgttcaatagtatgaaaaactttattatttcttctgaacctttttgcatccgcaaaatattaaagttgcttcaattttttgtttgtct

SEQ ID NO: 9203 - DNA, 3960 bp, Populus trichocarpa
aggcagatctagggctacaggtggtggtatttctgcattttgtatacaaaacggggcgtttaagatgtcttctctcagtcgagagctcgttttcctgatcttgcagttcctggatgaggagaagttcaaagagactgttcataagcttgagcaggaatctggatttttctttaacatgaagtattttgaggatgaggtgcataatggcaattgggatgaggtggagaaatacctctctggtttcactaaagtagacgacaatcgatattctatgaaaatatttttcgagatacggaagcaaaagtatcttgaagcattggataagcatgatcggtccaaggcggttgaaatattggtgaaggatttgaaagtattttcgacatttaacgaggagcttttcaaggaaatcactcaactactgacattggagaattttagggagaatgagcaactttccaaatatggagataccaagtcggcaagggcaatcatgttggttgagctgaagaagcttattgaagcaaaccctttgtttcgtgacaaattgcagtttcctaaccttaagaattcaaggttacgaactctcattaaccaaagcttgaattggcagcatcaactttgtaaaaccccaaggtcaaaccctgatataaagactctttttttcgatcattcatgtggacaaccaaatggtgctcgggctccatcacctgcaaacaatccactgcttggatccttaccaaaagctggagggtttcctcctctgggtgctcacgggccatttcaacctacaccagcaccagtcccagcacctcttgcaggttggatgtccaatcctcccacagtaactcatccagcagtttctggaggaggagccattggtcttggtgctccatctatctcagctgctctgaagcatccacggactcctccatctaacccttcggtagactatccttcaggagatcctgaccatgttgctaaaagaacaaggccaatggggatttctgatgaggtaaatttgcccgttaatgtattgccaatgtcatttccagggcatggtcatggtcatggtcagacttttaatgcaccggatgacttgccaaaggctgttgtacggactctgaatcagggatcatctcctatgagcatggatttccatcctgttcaacagactattcttctagttggtaccaatgtgggggaaattgggctgtgggaagttggttctagggagcgactggttttaagaaacttcaaagtttgggatctgaatgcatgctcgatgcctcttcaggcagctttagtcaaagatcctggcgtctctgttaaccgtgtaatttggagtccagatggtaacttgtttggagttgcgtactcaaggcatattgtacaaatatattcttatcatgggaatgatgatgtacggcagcacctagagattgatgctcatgttggtggagtaaatgatcttgcattctccactccgaataagcaactttgtgttataacctgtggtgatgacaaaatcatcaaggtgtgggatgctgccactggtgcaaaacaatatacgtttgaaggtcacgaggctcctgtttattccatctgcccacattataaggaaaatattcagtttatcttttcaacagcactggatggaaagataaaagcatggttatatgacaatctaggatctcgggttgattatgaggctcctggtcgatggtgcacaaccatggcttacagtgctgatggtacaaggcttttttcttgcggtacaagtaaagatggggaatcctacattgttgaatggaatgaaagtgaaggtgctgtgaagagaacctatgttggatttagaaaacattctttgggtgtcgtgcaatttgatacaacaaagaatcgttttttggctgctggtgatgatttttccatcaagttctgggatatggacagtgttcaacttttgacaacaattgatgctgatggaggcctcccagcgagcccacgtatccgcttcaacaaggagggcaccctgttggctgtttctgccaatgataatgggattaaaatattggcaaattcagatggcatcaggttgctgcgtacatttgaaaatctttcttatgatgcctctcgagcatctgaatctgttgcaaagcctactgttaatccaatctcagctgcagcagcagcagctgcaactagcagtggacttgcagacaggggtgcctctgtggtcgccgttgctggaatgaacggagatgcccggaatttgggagatgtgaaacctagaatagctgaagaattgaatgataaatcaaagatatggaagctcactgaaatcaatgaaccatctcaatgccggtccttgaggcttcctgaaaacttgagagtaaccaagatatcaaggttaatttatacaaattctggcaatgccattttggcattagcttcaaatgcaatacacttgttatggaaatggcaacgcagtgatcgtaatgcaagtggcaaggcaaccgctggtgtgccacctcaattatggcaaccatcaagtgggattctaatgaccaacgacatcactgactctaaccctgaagaggctgtggcatgttttgctttgtccaaaaatgattcttatgttatgtcagcatctggaggaaagatttcccttttcaatatgatgacatttaagacaatgacaactttcatgccaccacctcctgcagcaacatttcttgcttttcatcctcaagataacaacataattgctattggcatggatgattccacaattcaaatatataatgtccgtgtagacgaggtcaagagcaagctgaaaggccactctaaaagaataactggccttgccttctcccatgtgctgagcgtgctagtgtcatcgggagcagatgctcagctttgtgtttggaactcggacggatgggaaaagcagaaaacaagattcttgcaggttccgactggaaggacaacaacagcacaatcggacacccgtgtacaatttcatcaggatcagatacacttcctggttgtgcacgagactcagcttgccatatttgaaaccacaaagctagaatgcgtaaagcagtggcttccacgtgaatcttctgcaccaatctcacatgctgtgttctcatgtgatagtcagctggtatatgccagcttcttagatgcaactgtttgtgtatttagtgctgcaaatctcagattacgctgtcgtatcaatccttcttcatatcccccacctaatgtcagctcaaatgtccacccacttgtgattgctgcacacccgcaagaaccaaatcagtttgcattgggattatcagatggtggggttcatgtctttgagccacttgaatctgaaggaaaatggggtgtgcctccacctgctgagaatgggtcagcaagcagtgtggcagctattccttcagttggaccatcaggttctgatcaagcccagagatgatttatgattgccagagcacaagttcttttacatgcttggcttgctggcccattcctaagttagtttgaggttcaatgatatgttgtaacctgctcaaggaactacttgcaaaagatgtagatttagcatgttctgtctgatacttcgtgaggtaaatgctgtagtagtattagtaatagtattaatagtgatgccttttgaccttgaactagaaatttgcttaaggaagattttttttggttctgtgcttattttatttctttgaactcttgaatagtctgtaatatttattattttgtcgtcaaacatcgaaatttcctcattgttttgtttgtggtcgagaatcttttccccaacccagtcgttctacttaggattttagaccatctgtcattttgctttaaggtatcatactggacaaatcggacttgtattctttatttgccaatcttttcaatgctggaaaacatcattctttc

SEQ ID NO: 9204 - DNA, 3967 bp, Euphorbia peplus
agataaatctagctctccgtttctagagagagaaagctctggttttctagagagagaaagcttctcttagctctctctctcctccatcgctccctctgcgtttctgatctctctctgcttttcattacgagatctagtgaaaattacagtaaaatttgtgcatttctaagcaacaacggggcgtttgagatgtcgtccctcagtagagagcttgtgttcttgatcctgcagttcctggatgaggaaaagtttaaagagactgttcataagcttgaacaggaatctggatttttcttcaacatgaagtattttgaggatgaggtgcatggtggaaattgggatgaggtggagaagtacctctctggtttcaccaaagtggatgataaccgatactcgatgaaaatctttttcgagattaggaagcaaaagtaccttgaagcattggataagcatgataggtcaaaggcagtcgatatattggtaaaggacttgaaagtgtttgccacattcaatgaggagcttttcaaggaaattactcagttgttgacactggagaatttcagggagaatgagcaactatccaagtatggagataccaagtcggcaagggcaatcatgttagtggagctcaaaaagcttattgaagcaaaccccctgtttcgtgataaattgcagttccctaatcttaaaaattcaaggttgcggacactcattaatcaaagcctgaattggcagcaccaactttgtaaaaatccaaggccgaatccagatattaaaactctctttgtggaccattcatgtgggcaaccaaacggtgcacgggctccatcgccagctaataacccactgcttggatcaataccaaaagctggaggatttcctcctttgggtgctcatgggccctttcaacccacgccagcgccagttccagcacctttagcaggttggatgtctaatccttccactgtaacccatccagctgtttctggtggaggagccattggtcttggtgctccatcaatgccagctgctctaaagcatccaaggacccctccaactaactcctctgtagactatccatctggagattctgatcatgttgctaaaagaacaaggccgatgggaattactgatgaggtaaatctgccagttaatgtgctgccagtaccatttcctggacatggccatagtcagacttttaatccaccagatgacctaccaaagactgttgcacggactttgaatcaaggatcatctcctatgagcatggatttccatcctattgaacagactattcttctagttggtacaaatgtgggagatgttgcactatgggaagctggttcaagggagcgacttgtattaagaaacttcaaagtttgggatcttagtacatgttcaatgcctctgcaggcggctctggtaaaggatcctggtgtttcagtgaaccgtgtgatttggagtcctgatggctctttatttggagttgcatactctaggcacattgtacaaatatattcttaccacagaggtgatgatgtcaggcagcacttggagattgatgctcatgttggcggagtaaatgatcttgcattctccactcctaataaacaactttgtgtgataacctgtggtgatgacaagactatcaaggtgtgggatgctgctactggtgcaaagcagtatacttttgaaggccatgaggctccagtttattctgtctgcccccattataaggaaaacattcagtttatcttttcaacagctttggatggaaagataaaagcatggttgtatgacaatttgggatctcgagttgattatgacgctcctggacgttggtgcacaaccatggcttacagtgctgatggtacaaggctattttcatgtgggactagtaaagatggcgaatctcatattgttgaatggaatgaaagtgaaggaaatgtgaaaaggagctatcaaggtttccgcaaacgttcattgggtgttgtacaattcgatacaaccaagaaccggtttttggctgctggtgatgatttttctatcaagttctgggatatggataatgttcaacttttgacatctattgatgctgatggaggccttccagctagccctcgtatccgctttaataaagatggcactctcttggcagtttctgcaaatgaaaatggaattaagatattgtcaaactcagatggtcataggttgttgcggacattcgagaatctctcttatgatgcctcacgagcaactgaagctgttacgaagccaattattaacccaatcacagcagcagcagcggcagcggcagcagcagcagctggtgcaactagtgccggactttctgaccgaaataattctgttgttactattcctggaatgaatggagatgctcggaatttgggagatgtgaaacctagaattacagaagaatcaaatgacaaatcaaagatatggaagctcactgaaatcagtgaaccatctcaatgtcggtccttaaggctccccgagaacatgagagtgaacaagatatcaaggttaatttatacaaattcaggcaatgccattttggcattggcatcaaatgctattcatcttctgtggaagtggcaacgaagtgaacggaattcaaatgccaaggcaactgccaatgtgccacctcaattgtggcaaccatctagtggcattctgatgaccaacgacgttactgacactaaccttgaggaggcagtaccttgctttgctttgtctaagaatgactcttatgttatgtcagcatctggagggaagatatctcttttcaatatgatgacatttaagacaatgacaaccttcatgcctccaccacctgctgcaacatttcttgcttttcatcctcaagataataatattattgctattggcatggatgattccacaattcagatatataatgttcgcgtggatgaggtcaaaagcaagctcaaaggtcactcaaaacgaattacaggccttgcattctcccatgtattaaatgtgctagtttcatctggagcagatgctcagctttgcgtgtggaattcagatgggtgggaaaagcagaaaacacgatttttgcaggttccacctgggaggactacatcaggacattcagatacacgtgtacaatttcatctagaccagatacagtttttggttgtgcatgagactcagcttgccatatatgaagctacaaagctagagtgtgtaaagcagtgggtcactcgcgactcttctgcgccaatctcgcatgcaacattctcatgtgatagtcaactggtgtatgccagtttcttagatgcaacagtatgtgtgttcagtgctcagaatctgagactacgttgtcgcatcaatccttcctcctatctaccagctaatgtcagcaattctaatgtacacccacttgtaatcgctgctcatccgcaagaagcaaatcagtttgcattgggactatctgatggcggggttcatgtgtttgaaccccttgaatcagaaggaaaatggggggtgccgcctcctgttgagaatgggtcagcaagcagtgttccagccactccttctgttggaccgtcgggttcagatcaagctcagagatgatctaaccatagccagagaacaagttcttttacatgcttggcttgctggcccattcctaagttagtttgacgttcaacatatgtaatttactccaggaacaagttgcaaaagatgtagatttagcatgttttgtcagatactttgtaaggtaaatgctgtaggaatatttaatagtgaaatgtttttctatttagaaggaaatttcttgaagattttttattctttatcttctatgtttattctccttccatgcaaaatgttcaataggctgaaaatttagttattttgacacgaatgtttgagtagcaaagacttgtttaatttatttcatttgtttgtctatata

SEQ ID NO: 9205 - DNA, 4857 bp, Gossypium raimondii
aggttgggtattatatacaagggaatacaattattttttttagagagaaagaggtaatatttgctttgtattatttaagagaagaaggttcattttatttacctcagggagagcaaggtctttttttttatctctaattttttgtctgaaaatcgatctattcaaagaacaagatctagactttatatttggtgattttagtctcgtccttgcgaaaataagacagggcggctacgatgtcgtctctcagtagagagcttgtgttcttgatcttacagtttctagatgaggaaaagtttaaagagactgttcacaggcttgaacaggaatctgggtttttctttaatatgaagtattttgaggatgaggtgcataacggaaactgggatgaggttgagaaatacttgtctggtttcaccaaggtagacgacaatcgatattccatgaaaatctttttcgagataagaaagcagaagtatctcgaggcattggataagcatgatctgtccaaggccgtggagatattagtaaaggatttgaaagtttttgccacatttaatgaggaactttttaaggaaatcactcagcttttgacgttggagaatttcagggagaatgaacagttgtcaaaatatggagatacaaagtctgctagagcaatcatgttagttgaactcaagaagcttattgaagcaaatcctttattccgtgacaaattacagttcccaaaccttagaaattcaaggttacgcaccctcattaatcagagcttgaattggcagcatcaactttgtaaaaacccgaggccgaatccagatataaaaactctcttcgtggatcactcttgtggacagccaaatggtgcacgagcaccatcacctgctaacaatcctcttcttggaggcttaccaaaggccgggggctttcctccccttggtgctcatgggccttttcaacctacaccagcgccagttccagcaccccttgctggttggatgtcaaacccttctactgtaactcatccagctgtgtccggtggagctattggtcttggtccttcctcaataccagctgcattgaagcatcctaggactcctccaactaatccttctgtagactacccatctggggactctgatcatgtttccaaaaggacaaggcccatggggatttctgatgaggtaaatcttcctgtcaatgtgctgcctgtaacatttcctggccatggtcacagtcagactttcaatgcacccgatgatctgccaaaggcagttgcaagaactttgaatcagggttcatctcctatgagcatggatttccatcccgttcaacagactttacttctagttggtaccaatgttggagacatagcattgtgggaaattggctctcgggagcggctggttttgaagaactttaaagtttgggatcttagtgcttgttcaatgcctcttcaggctgctctagtcaaagatcctgctgtctctgtaaatcgtgttatttggagccctgatggctctttatttggagttgcttactcgaggcacattgtgcaaatatattcttatcatggtggcgatgaggttcggcagcatctggagattgatgctcatgttggtggagtaaatgatcttgcattttctcatccaaataagcaactttgtgtagtaacttgcggtgatgacaagatgatcaaggtgtgggaggctaccaatggtacaaaacaatatacctttgaaggtcatgaggctcctgtttattctgtctgccctcactataaagaaaacattcagtttatcttttcaacggctttagatggaaagataaaagcatggttgtatgataatatgggatcacgtgttgactatgaagctcctggtcgttggtgcacaaccatggcctacagtgctgatggtacaaggcttttttcctgtggcaccagtaaagaaggggagtcatttatcgtagaatggaatgaaagtgaaggggccgtgaagaggacctatcaaggattccgcaaacgttctttaggtgttgtgcaatttgacaccactaagaataggtatttagctgccggtgatgatttctctatcaaattctgggatatggacaatgttcaacccttgacaagtgttgatgctgatggaggccttccagcaagtccacgtattcgctttaacaaggatggctctctcttggctgtttccgcgaatgataatgggattaagattttggcgaattcagatggtatgcgattattgcgcacgttggagaatctttcttatgatgcctcaagaacatcggaagccccaaagcctacaataaatccaatctcagctgctgctgccgctgttgctactagtgctggacttgcagacagaagtgcctctgtagttgctattgctggaatgaatggggatgccaggagcttgggggatgtgaaacccagaataacagaagaatcgagtgataaatcaaagatttggaagctaactgaaatcagtgaaccatctcagtgtcgatccttgaggcttcctgaaaacttgagggtgaccaagatatcaaggttaatcttcactaattcaggtaatgctattttggcattggcatcaaatgctattcacttgctctggaagtggcagcgaagtgagcgtaattcaaatggcaaggcaactgcgagtgtaccgcctcagttgtggcaaccatcaagtggcattcttatgacaaatgatgttgctgatacaaatcctgaagaggctgtaccctgttttgctttatccaagaatgattcttatgtaatgtctgcatctggaggaaagatttccttgtttaatatgatgacattcaagacaatggcgactttcatgccgccaccaccaccagcaacttttcttgcattccaccctcaagataacaatattattgctataggcatggacgattcaacgattcagatatataatgttcgtgtggatgaggtgaagagtaagcttaaaggccactccaaaagaataactggccttgccttctctcatgtactgagtgtgcttgtctcatcaggagcagattctcagctttgtgtatggaacactgatggatgggaaaagcagaggtctagattcttgcaggttccatctgggagaacaccaacggcactgtcagacacacgtgtacaattccatcaagaccagatgcattttcttgttgtacatgagactcagcttgccatatatgaaacaacaaagctagaacgtgtgaagcagtgggttccgctcgaatcttctgctccaattactcatgcgacattctcatgtgatagccaactggtgtattccagctttttggatgcaactgtttgtgtctttactgctgcaaacctcagactacgttgccgtataaatccttctgcttatcttcctgctagtgtcagttccaatgttcatccacttgtaattgctgcacatccatctgagccaaatgaatttgcattgggactctcagatggtggggttcatgtctttgagccccttgaatctgaaaacaaatggggtgtgcctccaccagttgaaaacgggtcatccagcaatatggcagtaacaccttcggtcggagctccaggatcagaacaagcacaacgatgatgaaatggctgacagagcacaagttcttttaaatgcttggcttgcatgtccattcctaatctaggtaggcatcaagagttgtgatctgagtacaacatgcaaagttgtagatttaacatatttgttagatacaatctaaggtaaattgcatagtagtatttaatagctttaaagtgttctctcatcccttatttgaagggtactttttttctttcccatcacaacgttctttttgtatcaaatttacatgttttagaaaccagttttctttgtttgttgccatcatgattatctgattgacctaatcactgtctcgtcctttcttcaatttcttttggtggtacaaaggagactgcaccccggggataggggaaagggttgcaaatgctaggattcgaaccccaaacttgctggatgccacctcttataggtggccgcataaattaactaatctaaactctggtccatgttctcctccagttagttgttggagatttagtttgttttcaacatgcagtgtttcagactcacttgcagtatggtagaagttagaatctaataacattttggggaccattaggagccaaaatatcagaaagtttgatgaaatataaagtagtttagggtttatatgggtacatccgaggaagatggaaatgaacgtggaggctgagcaaagtatggggtatgagataactatcatactataggttatatatatagtatacgctgacgatgcaaagctgtttcaaaaggtctgaactgttggttttggaaggcagtttcttgaacttgatatggagaaatagattttaattccatttttattatgctccatgaatgtgtaatcattgaaaattgtgtatattgctttagtagcatatttatcaaaatacctgtttttagaaaaaaaagagaatttaaacaagtttttacagtatggggattaggaagcttttgtgagtgtagcctctacttgagtttttggcaatgaaccttagaataataccctttgaagggcattccaatgctatacctaccctctccctatttcttcataagtaaacccgccaaaatttccatcgacctaacccaacccctcaaaaagtgaaaatggtcccaatatgcagctgacctgacgttgaccaatgatgttttcagagtccctactcggaactgcagttactaaattcagagcgtaacattctgcccctca

SEQ ID NO: 9206 - DNA, 3964 bp, Trigonella foenum-graecum
agatctagtttagtgtttgctcattttgattttcatctgatccacaagacaaaggggttgccatgtcatcactcagtagggagttggtgttcttgatcctgcagtttcttgaggaggaaaagttcaaagaggctgttcataagcttgaacaggaatcagggttttacttcaacatgaagtattttgaagatgaagtgcataatgggaattgggatgaggttgagaagtacctctctggtttcactaaagttgatgataataggtattctatgaagatatttttcgagataaggaagcagaagtatctggaagcattggacaagcatgatcggtccaagggtgtcgaaatattagtgaaggatttgaaagtgttttctactttcaatgaagaattattcaaggagatcacacagcttttgacattggagaatttcagggaaaatgaacaattgtccaagtatggtgatacgaagtctgcaagagcaatcatgttggttgagctaaaaaagttgattgaggcaaatcctttatttcgtgacaaattgcaatttcccaaccttaagaactcaaggttgcggactctcatcaatcaaagcttgaattggcagcatcaactttgtaagaatccacggccaaatccagatataaaaactcttttcgtggatcactcttgtggacagccaaatggtgcacgggctccatcacctgctaatatgccgctactaggatccttaccaaaggttggaggatttcctcctcttggtgcacatgggccttttcaaccaactccagctcctgtgccgatgcccttggctggttggatgtcaaatcctactactgtggcacatgcctcagtttctggaggaggagctataggtcttggtgttggtggaccatcaatgcccgatcacatgtctaagagaacaagaccaataggaatgtctgatgagggaaatctacctgttaatgttttgtcggcgacgtttccgggtcatggtcatggccaggcgtttaattcacctgatgacttgccaaagacagtcttgcgaactctaaaccaaggctcgtctcctatgagcatggactttcatccagttcaacagactttacttcttgttggtacaaatgtggcggacattggtctatgggaattaggctctagggagcgattggtcttgaggaacttcaaagtttgggatctgagtgcttgttcaatgccatttcaggctgctcttgtcaaagatccagctgtttctgtcaaccgtgtgacttggagtcctgatggggctttgttcggagttgcttactcaaggcacattgttcagatatactcttaccatggtggggatgaagtacgacagcacttagagattgatgctcatgtcggcggagtaaatgatctagcattttctcacccaaataagcagctatgtgtgatcacctgtggtgatgataagaccattaaggtgtgggatgctgctacgggtataaagcaatacacttttgaaggtcatgaggctcctgtttattctgtctgcccacattataaagaaaacattcagttcatcttttcaacggcattagatggaaagataaaagcatggttgtatgacaatttgggatctcgtgttgactatgacgctcctggtcggtggtgtacaaccatggcttatagtgctgatggtacaaggctcttttcgtgtgggactagcaaggaaggggaatcctctattgttgagtggaatgaaagtgaaggagctgtgaagaggacttaccaaggatttcggaaacgatctttgggagttgtacaatttgatacaaccaaaaaccgatatctagctgctggtgatgatttctccattaaattttgggatatggacaatattcagcttttgacaactgttgatgctgatggaggtctcccagcaagcccacgtatccgtttcaataaggatggatctcttttagctgtctctgcaaatgagaatggaattaaaatcttagccaatggagagggtattcgttttttgcgctcattagagaattcgttatatgattcatcaagaacatcagaagccatgacaaagcccataataaattctatgtctgttgctaatgctgcaagtagtgctgcacttgcagagagagcctcgtccgcggcagctattgctggaatgaatggggatgcccggaacttaggtgatattaaacctagaataagtgaagaatccaatgacaagtcaaagatatggaagctcactgaaatcaatgaaccatctcattgtagatccttgaagctacctgaaaatgcaagagtcaccaagatatcgaggttgatatatactaattcaggtaatgctattctggcattagcttcaaatgccattcatcttctctggaaatggcaacgaaatgatcgtaactcatccggcaaggctactgctagtctgccacctcagttgtggcaaccttcaagtggcatcttgatgactaatgacattaatgataacaataccgaggatgcagtcccatgctttgctctttccaaaaatgattcttatgtaatgtcagcatcgggcgggaagatttctctgttcaatatgatgacttttaagacaatgacaacattcatgccaccaccacctgcagcaacctttctggctttccatcctcaggataacaatattattgctataggcatggacgattcttccattcagatatataatgtccgcgtagatgaggttaaaagtaaactcaaaggccatactaaaagagtaactggtcttgcgttttctcatgtactgaatgtattagtttcagctggggcagatagccagatttttgtatggaatactgatggctgggagaagcagaagaatagattcttgcaatttcctcctgggaggactccaccagcacaggcagatacacgtgtacaatttcatcaggaccagttccgcttcttggtggtacatgaaactcagcttgccatttatgaagcaacaaaactggaatgtttaaagcagtggttcccacgagatgctgccgcaccaatatcatatgcaactttctcatgtgatagccatctgatatttgccagctttttagatgcaacaatctgtgtatttagtgcttcaaaccttcgattgcgatgccgtatcaatccttctgcttatctttccgcaaatgtcagttctaacattcaaccgctggtaattgctgcacatccacacgaaccaaatcagtttgctgttggactgtcagatggcgtagttcatgtgtttgagccccttgagtctgaaggaaagtggggtgtacctccacctattgagaatggatcagcaagcaatgcggtaactaattcggtgggtgcttcttctgatgaagtccaaagatgatcgatccagttccaacttccatccaaagacaggtttccatcacaagaactaggtatatataatataattaagaaatgcagggcactcaccaaatcagttgattcagctactctctagaaaatgcagtgcaacagaaaaccaagaccaccctatgtaaatttattaagtttaatgatacagatgtagaaattcctagggtatttcgaagcttttcctggatatttatttagattggtttatcttaaaacttcttcctatgtagtatttatatttattggtctgcatgcactatggcaatcttgcctccattggccatatttataaatatgtaaattttttaatggtgcagtttgtgattcatgacatgataaatagtgttgcgccttgaaaaaaatcaagaaatatcctaactataacttttaaagttgatacagtcttagtcgttggaaacttagagaaaacattctcagttcaatcatttaaaaaatagcttattttcaagtttttcattatcagttgaatctacacatttgctaatcgtattggatcaaatgttcaacaat

SEQ ID NO: 9207 - DNA, 4138 bp, Gossypium raimondii
gtctctttgatgctaaaaatccctagagtttttttcttttggagagaggggtttgaagaaggttaaatggtttaagtttcatgtaaaattaactttgggctttcttttatcttttattttaaaggatttttaaggtgtttgagctgactctttttttttttttggggggggggaaatacttttgcagatctagactttatatttggtgattttagtctcgtccttgcgaaaataagacagggcggctacgatgtcgtctctcagtagagagcttgtgttcttgatcttacagtttctagatgaggaaaagtttaaagagactgttcacaggcttgaacaggaatctgggtttttctttaatatgaagtattttgaggatgaggtgcataacggaaactgggatgaggttgagaaatacttgtctggtttcaccaaggtagacgacaatcgatattccatgaaaatctttttcgagataagaaagcagaagtatctcgaggcattggataagcatgatctgtccaaggccgtggagatattagtaaaggatttgaaagtttttgccacatttaatgaggaactttttaaggaaatcactcagcttttgacgttggagaatttcagggagaatgaacagttgtcaaaatatggagatacaaagtctgctagagcaatcatgttagttgaactcaagaagcttattgaagcaaatcctttattccgtgacaaattacagttcccaaaccttagaaattcaaggttacgcaccctcattaatcagagcttgaattggcagcatcaactttgtaaaaacccgaggccgaatccagatataaaaactctcttcgtggatcactcttgtggacagccaaatggtgcacgagcaccatcacctgctaacaatcctcttcttggaggcttaccaaaggccgggggctttcctccccttggtgctcatgggccttttcaacctacaccagcgccagttccagcaccccttgctggttggatgtcaaacccttctactgtaactcatccagctgtgtccggtggagctattggtcttggtccttcctcaataccagctgcattgaagcatcctaggactcctccaactaatccttctgtagactacccatctggggactctgatcatgtttccaaaaggacaaggcccatggggatttctgatgaggtaaatcttcctgtcaatgtgctgcctgtaacatttcctggccatggtcacagtcagactttcaatgcacccgatgatctgccaaaggcagttgcaagaactttgaatcagggttcatctcctatgagcatggatttccatcccgttcaacagactctacttctagttggtaccaatgttggagacatagcattgtgggaaattggctctcgggagcggctggttttgaagaactttaaagtttgggatcttagtgcttgttcaatgcctcttcaggctgctctagtcaaagatcctgctgtctctgtaaatcgtgttatttggagccctgatggctctttatttggagttgcttactcgaggcacattgtgcaaatatattcttatcatggtggcgatgaggttcggcagcatctggagattgatgctcatgttggtggagtaaatgatcttgcattttctcatccaaataagcaactttgtgtagtaacttgcggtgatgacaagatgatcaaggtgtgggaggctaccaatggtacaaaacaatatacctttgaaggtcatgaggctcctgtttattctgtctgccctcactataaagaaaacattcagtttatcttttcaacggctttagatggaaagataaaagcatggttgtatgataatatgggatcacgtgttgactatgaagctcctggtcgttggtgcacaaccatggcctacagtgctgatggtacaaggcttttttcctgtggcaccagtaaagaaggggagtcatttatcgtagaatggaatgaaagtgaaggggccgtgaagaggacctatcaaggattccgcaaacgttctttaggtgttgtgcaatttgacaccactaagaataggtatttagctgccggtgatgatttctctatcaaattctgggatatggacaatgttcaacccttgacaagtgttgatgctgatggaggccttccagcaagtccacgtattcgctttaacaaggatggctctctcttggctgtttccgcgaatgataatgggattaagattttggcgaattcagatggtatgcgattattgcgcacgttggagaatctttcttatgatgcctcaagaacatcggaagccccaaagcctacaataaatccaatctcagctgctgctgccgctgttgctactagtgctggacttgcagacagaagtgcctctgtagttgctattgctggaatgaatggggatgccaggagcttgggggatgtgaaacccagaataacagaagaatcgagtgataaatcaaagatttggaagctaactgaaatcagtgaaccatctcagtgtcgatccttgaggcttcctgaaaacttgagggtgaccaagatatcaaggttaatcttcactaattcaggtaatgctattttggcattggcatcaaatgctattcacttgctctggaagtggcagcgaagtgagcgtaattcaaatggcaaggcaactgcgagtgtaccgcctcagttgtggcaaccatcaagtggcattcttatgacaaatgatgttgctgatacaagtcctgaagaggctgtaccctgttttgctttatccaagaatgattcttatgtaatgtctgcatctggaggaaagatttccttgtttaatatgatgacattcaagacaatggcgactttcatgccgccaccaccaccagcaacttttcttgcattccaccctcaagataacaatattattgctataggcatggacgattcaacgattcagatatataatgttcgtgtggatgaggtgaagagtaagcttaaaggccactccaaaagaataactggccttgccttctctcatgtactgagtgtgcttgtctcatcaggagcagattctcagctttgtgtatggaacactgatggatgggaaaagcagaggtctagattcttgcaggttccatctgggagaacaccaacaacactgtcagacacacgtgtacaattccatcaagaccagatgcattttcttgttgtacatgagactcagcttgccatatatgaaacaacaaagctagaacgtgtgaagcagtgggttccgctcgaatcttctgctccaataactcatgcaacattctcgtgtgatagccaactggtgtatgccagttttttggatgcaactgtttgtgtctttactgctgcaaacctcagactacgttgccgtataaatccttctgcttatcttcctgctagtgtcagttccaatgttcatccacttgtaattgctgcacatccatctgagccaaatgaatttgcattgggactctcagatggtggggttcatgtctttgagccccttgaatctgaaaacaaatggggtgtgcctccaccagttgaaaacgggtcatccagcaatatggcagcaacaccttcggtcggagctccaggatcagaacaagcacaacgatgatgaaatggctgacagagcacaagttcttttaaatgcttggcttgcatgtccattcctaatctaggtaggcatcaagagttgtgatctgagtacaacatgcaaagttgtagatttaacatatttgttagatacaatctaaggtaaattgcatagtagtatttaatagctttaaagtgttctctcatcccttatttgaagggtactttttttctttctcatcacaacgttctttttgtatcaaatttacatgttttagaaaccagttttctttgtttgttgccatcatgattatctgattgacctaatcactgtctcgtcctttcttcaatttcttttggtggtacaaaggagactgcaccccggggataggggaaagggttgcaaatgctaggattcgaaccccaaacttgctggatgccacctcttataggtggccgcataaattaactaatctaaactctggtccatgttctcctccagtta

SEQ ID NO: 9208 - DNA, 3994 bp, Fragaria vesca
ccttggtctgaactcgtctctctctagatataaaatacaaaaatttggtagagagagaaagaaacagagtttacttcaagtttgaggagagagaaaactttctctaagctcctgtttctcttcttcttcttcttgttcctgtggttctgcttcttctgatttggtttctcaagatctagttagattgggagtgataaatctgggtttggaattgaacagggccagactgggcggtcaagatgtcttccctcagtagggagcttgtgttcctgatcttgcagtttctagatgaggaaaagttcaaagagactgttcacaagcttgaacaggaatctgggtttttctttaatatgaagtattttgaggatgaggtgcataatggcaattgggatgaagtggaaaagtacctctctgggttcactaaagtggacgataaccggtactccatgaaaatattttttgagataaggaagcagaagtatctcgaggcattggacaagcatgacaggtccaaagctgtggacattctggtgaaggatttaaaagtgtttgccacatttaatgaagaacttttcaaggaaatcactcagcttttgacactggataattttagggagaatgaacaactatccaaatatggagatacaaagtctgcaagggcaattatgcttgttgaacttaagaagctgattgaggcaaatcccttattccgtgataaattgcagttcccaaacctaaaaaattcaaggctccgaactctgattaaccaaagcttaaactggcaacatcagctttgtaagaatccaaggccgaatccagatataaaaactctttttgtggatcactcgtgcggacaaccgaatggtgctcgggctccatcacctgcaaacaatcccttgcttggatccttaccaaaagctggaggatttcctcctttgggtgcacatgggccctttcaacctacaccagccccagttccaattccccttgcaggttggatgtctaatgcttccactgttactcatccagcagtttctgaaggaggagctattggtcttggtggtccctcgataacagcggccttgaaacatccaaggactcctccaactaacccttctgtagagtacccgtctggggattctgatcatgtttctaagcgaacaagacccatgggactttccaatgaggttaatctccctgttaacatattgccagtgtcatttccgggtcacagtcatagtcaggctttgaatgcacctgatgacttgccaaagaatgttgctcggactttaaatcagggttcatcgcccatgagcatggattttcatcctgttcagctgacgctgcttcttgttggtaccaatgtgggggacatagggctgtgggaagttggatccagggagcgactggttttaaggaacttcaaagtttgggatcttggttcttgttcaatgcctctacaggctgctctggtaaaggatcctggtgtatctgttaaccgtgtgatttggagccctgatggttctttatttggtgttgcttactcgaggcacattgttcaaatctactcttatcacggaggtgatgatatacgacaacacctagagattgatgctcatgttggtggagtaaatgatctagcattctctcaccccaataagcagctttgtgtaataacctgtggggatgacaagacaatcaaggtctgggatgctgcaactggttcaaaacagtatacttttgaaggtcatgaggctccagtttattctgtctgcccacactataaggaaaacattcagtttatcttttcaacagcactggatggaaagataaaggcctggctctatgacaatttgggatctcgagttgattatgatgctcctggtcgctggtgcacaaccatggcatacagtgctgatggcacaaggctcttttcgtgtgggacaagtaaagaaggtgagtcatatattgttgaatggaatgaaagtgaaggggcagtgaaaaggacctatcaaggtttccgcaaacgttctttcggcgttgtgcaatttgatactacgaaaaaccggtttttggcggctggtgatgatttctctattaaattctgggacatggacaatgttcagcttctaacgacagttgatgctgatggagggctcccggctagcccccgtatccgctttaacaaggatggcactctcttggctgtatctgccaatgagaatgggattaaaattttgggcaatgcagatggcattcggttgttgcgcacatttgagaatctttcttatgatgcgtcaaggacctctgaagttgtgacaaagcctgcaatgaatccaatttctgttgctgccgccgccgccgcagctgcttcaagcgctggactggctgagagaagtgcatcagcggttgctatttctggaatgaatggggaggctaggaacttgggggatgtgaaacctagaataactgaagaatccaatgacaaatcaaagatttggaaactcactgaaatcaatgaaccgtctcaatgtcgctccttgaggctacctgaaaacatgagagtaaccaagatatcaagattaatctatacaaattctggtaatgcgattcttgcattagcatcaaatgccatccatttgctctggaaatggcaaaggaatgatcgcacctctgttagcaaggcaactgccagtgtttcacctcaactttggcagccaacaagtggcattctaatgacaaatgatgttactgacacaagttctgaagaagctgttccttgctttgctttatccaagaatgattcttatgtgatgtcagcttctggtggaaagatttctctcttcaatatgatgacatttaagacaatgacaactttcatgccaccaccacctgctgcaacatttcttgctttccatcctcaagataacaatatcatagctatcggcatggacgattcaacaattcagatatataatgtccgtgtggatgaggttaagagcaagcttaaaggtcactccaaaaggataactggcctagcattttctcatgtattaaatgtgctagtttcgtcaggagcagatgctcaggtttgtgtatggaattctgatggatgggaaaagcagaagagcagattcttgcagcttccagctgggagaacaccgtcttcgcagtcagatactcgtgttcagtttcatcaggatcagacacacttcttggttgtgcatgagactcaactggccatatttgaaactacaaaactagaatgtgtaaagcagtgggtcccacgtgattctgctgccccaatctcccatgcaacattctcatgtgatagccagcttatttatgccagcttcttagatgcaaccgtgtgtgtcttcagtgctgcaaatctcagattacgatgtcgtattaatcctcctgtttatcttcctgctaatgtcagcagttctaatgtacagccccttgtgattgcggcacatccacaagaaccaaatcagtttgctttaggactatcagatggtgcggttcatgtgtttgagccgcttgaatcagaaggcaaatggggcgtgcctcctcctgctgaaaatggttcagcaagcagtgtgccggcttctcaagttggaaattcaagttcggaacaggctcagagatgatcaagtggctggcagagcacaagttcttttacatgcttggcttgctggcccagttccatatagtttgtggttcctcatgcaaagtaatttactgaaggaatgatgtgcagatatgtagatttaacttgttggttaagaatctctaggtaaattatgtaggagtattattggcagtgtattaaattaaggaagaattttttatgtttctcccttgtgtttttatttattgcagctgagaaatataattcaagtttgtttttgttgcggtcttacttttcgtgtctgttctacagtaatcattactggtttttatgttatcatttcggtgggggtgatca

SEQ ID NO: 9209 - DNA, 4198 bp, Gossypium raimondii
aggttgggttttatataaaaaggaatttaaataattttttcctagagagagaaagagaatctctggctaccttggggttatttttttataaatatttttcttatttttggagagaaaaaaagtgttttttttatatgtaaaaatctctgggaagaggaagcttcttctttcttgtatgaaaatcgatctcagacgatctagtgtttttatttggtgatttttatttcatcgttgggaactgaagttggaggtggatacgatgtcgtctctcagtagagagcttgtgttcttgatcttacagtttctagatgaggaaaagtttaaagagactgttcacaagcttgaacaggaatctgggtttttctttaatatgaaatattttgaggatgaggtacataatggaaattgggatgaagttgagaaatacttgtctggtttcaccaaggttgatgataatcggtattcgatgaaaatctttttcgagattagaaagcagaagtaccttgaagcattggataagcatgaccggtcgaaagctgtggagatattagtaaaggatttgaaagtttttgctacattcaatgaggaacttttcaaggaaatcactcagcttttgacattggagaatttcagagagaatgaacagttgtcaaagtatggggatacaaaatcagctagagcaatcatgttagttgaactcaagaagcttattgaagcaaatcctttattccgtgacaagttgcagttccctaaccttaaaaattcgaggttacgcaccctcattaatcaaagtttgaattggcaacatcaactttgtaaaaacccaaggccaaatccggatattaaaactctctttgtggaccactcatgtggacagccaaatggtgcacgagcaccgtctcctgcaaacaatccacttcttggatccttgccaaaagctggaggttttcctcctctaggggctcatgggccttttcaacctacacctgcacaagttccggcaccccttgctggttggatgtcaaatccttctactgtaactcatcctgctgtttctggtggagctattggtcttggtgcttcaatacccgctgcattgaagcacccgaggacccctccaactaatccatcagtagactacccatctggagactctgatcatgtttccaaaaggacaaggcccatggggatatctgatgaggtaaatcttcctgtcaatgtgatgccagtaccgtttcagggccatggtcacagtcaggctttcagtgcacctgatgatctgccaagggctgttgcaagaatgctgaaccagggttcatctcctatgagcatggatttccatcctgttcaacaaactctacttctagttggtaccaatgttggggacatagcattgtgggaagctggctctcgagagcggctggtttctagaaactttaaagtttgggatcttactgcttgttccatgccccttcaggctgctctagtcaaagatcctgctgtctctgtaaaccgtgtaatttggagccctgatggttctttatttggagttgcttactcaaggcacattgtgcaaatatattcttatcatggtggtgatgaggttcggcagcatctcgagattgatgcgcatgttgggggtgtaaatgatattgcattctctcatccaaataagctactttgtgtaataacgtgcggtgatgacaagacaattaaggtgtgggatgcttctaatggtacaaagcagtatacctttgaaggtcacgaggcttctgtttattctgtctgccctcactataaagaaaacattcagtttatcttttcaacagccatcgatggaaagataaaggcatggttatatgataatatgggatcaagggttgactatgaagctcctggtcgttggtgcacgaccatggcctacagtgctgatggtacaaggctcttttcctgtggcaccagtaaagatggggagtcatttatcgttgaatggaatgaaagtgaaggagctgtgaagcgaacctatcaagggttccgcaaacgttctttaggtgttgtgcaatttgacacaactaagaacaagtatttggctgctggtgacgatttctctatcaaattctgggatatggacaatattcaacctttgaccagtttcgatgcggatggaggacttccagcgagtccacgcatccgctttaacaaggatggctccctcttggctgtttccaccaatgataacgggattaagattttggcaaattcagatggtatgcgattgttgcgcactttggagaatctttcttatgatgccttgagaacagctgaagccccaaagcctacaataaatccaatctcagctgcagcagcagcagcagccgcagccgctactagtgctggacttgcagatagaagtgttgctattgctggaatgaatggagatgctcggagtttaggggatgtgaaaccccgaataacagaagaacccagtgataaatcaaagatttggaagctcactgaaatcaatgaaccatctcagtgtcgatccttgaggcttcctgaaaacttgagggtgaccaagatatcaaggttaatcttcacaaattcaggtaatgctatattggcattagcatcaaatgctattcacttgctttggaagtggcagcgtagtgatcgtaactcaaatggcaaggcaactgccagtgtagcacctcagttgtggcaaccatcaagtggcattcttatgaccaatgatgttgctgatacaaatcccgaagaggctgtaccgtgttttgctttgtcgaagaatgattcttatgtaatgtcagcatctggaggaaagatttccttgtttaatatgatgacgtttaagacaatggctactttcatgccaccaccaccagcagcgactttccttgcattccacccacaagataataatattattgctataggcatggacgactcaacaattcagatatataatgtccgtgtggatgaggtgaagagtaaacttaaaggtcactccaaaagaataactggccttgccttctcgcatgtactgagtgtgctcgtctcatcaggagccgattctcagctttgtgtgtggaacaccgatggatgggaaaagcagaaggctagattcctgcaggttccagcggggaggacaccaacagcactgtcagacacacgtgtacaattccatcaagaccagatacattttcttgttgtacatgagactcagcttgccatatatgaaacaacgaagctagactgcatgaaacagtgggtcccacgtgattcttctgctcctataacgcatgcaacgttctcatgtgatagccaactggtatatgccagctttctcgatgcatctgtttgtgtatttactgctgcaaacctcagattacgttgtcgtataaacccttctgcttatcttccaactaacatcagttccaatgttcacccacttgtaatcgctgcacatccatctgagccaaacgaatttgcattgggactctcagatggtggcgttcatgtctttgagccccttgaatccgaaaacaaatggggtgtgcctccacccgttgaaaacggttcagccagcagtatgacagcaacaccttcagttggagctccaggatcagaacaagcccagagatgataaaatggttgacaaaagcacaaattcttttatatgattggcttgcatgcccctccctaatttagcttgacaatgaaagatgatgccaagatgtagatttttaacatattttgtgagatacaatgtctctaaggtaaatggcatagtagtgttttcttatgccctttttttgaagggaaaaattatgtttaaaaggaggaatgattttctgttctattgtagttgtttatcttcatatattaccccccccccctttttttttctcataaatcagaatgttctttttatgtatcagatttacattttcttctttcagaaaccttttcttctttctctgtcatcaactttaactgatggacatatatacttgtatctttaaataatcctatgatggtgtttacatagcatatggagcaagagccaaaaaccaagcaatgttcatcaagtctaattagaacctacaaggagtgaattgcaaattgtgcaagtaattcaagcacatcaatgtcaatgaaaggattaaattttattattttt

SEQ ID NO: 9210 - DNA, 3480 bp, Fagus grandifolia
tatatatataatttcctagagagagaaagttgtaagagaaaggctctctcttactgggtgtgttctttggtttacaagatctagtggtgtttttgctttgttgggaatcgaagaagagaggggcggctactatgtcgtcgcttagtagagagcttgtgttcttgatcttacagtttctggatgaggaaaagttcaaagagactgttcacaagcttgaacaggaatctgggttttttttaatatgaaatattttgaggatgaggtgcataatgggaattgggatgaggttgagaagtacctttctgggttcacaaaagtggatgacaatcggtattcaatgaaaatatttttcgagataaggaagcagaagtatcttgaggcattggataagcatgaccggcccaaggctgtggatatattagtcaaggatttgaaagtttttgccacatttaatgaagagcttttcaaggagataactcagctcttgacattggagaattttagggagaatgagcaactttccaagtatggagataccaagtctgcaagagcaatcatgttggtggagctcaagaagctgattgaagcaaatcctttattccgtgataaattgcaattccccaatcttaaaattcaaggttacggaccctcatcaaccaaagcttgaattggcagcaccaactgtgtaaaacccaaggccaaatccagatataaaaacttctttttgtggatcactcgtgtggacaaccaaatggtgcacgagctccatcacctgcaaacaatccactgcttggatccttaccaaaagctgggggcttccctaacttaggtgcacatgggccttttcaacctacaccagcaccagttccaacaccccttgcaggttggatgtccaatccttccactgttactcatccggccgtttctggaggagctattggtcttggtgctccatcaatcccagctgctttgaaacatccaaggactcctccgactaacccttctgtagattacccatctggggattctgatcatgtttctaaaagaacaagaccaatgggcatttctgatgaggtaaatctgcctgttaatgtgttgccagtaacatttccgggtcatggtcatggtcaggcttttaatgcacctgatgacttgccaaagactgtcgcacggactttaaatcaaggatcgtctcccatgagcatggattttcatcctcttcaacagactctacttcttgttggtaccaatgttggggacatagcgttgtgggaagttggtggtagggagcgattggttgtgagaagcttcaaagtttgggatcttagtgcttgttcaatgcctctgcaggctgctctagttaaagatcctggtgtatctgttaaccgcgtgatttggagccctgatggttctttatttggagttgcatactccaggcacattgttcaaatatattcttataatgggaatgatgatgtacggcagcacttagagattgatgctcatgctggtggagtaaatgatatagcattctcccacccaaataagcaactttgtgtgattacctgcggtgatgataagaccatcaaggtgtgggatgcagcgacgggtacaaaacagtatacttttgaaggtcatgaggctcctgtttattccgtttgtcctcactataaggaaaacattcagtttatcttttcaacagcactggatggaaagataaaagcatggttgtatgacaacttgggatctcgagttgattatgatgctcctggtaaatggtgcacaacgatggcgtacagtgctgatggtacaaggctcttttcatgtgggacaagcaaagagggggattcatttattgttgaatggaatgaaagtgaaggagctgtgaaaaggacctatcaaggattccgcaagcgttctttgggtgttgtgcaatttgatacaactaaaaaccggtttttggctgctggtgatgatttctctataaaattctgggatatggacaatattcagcttttgacaactgttgatgctgacggaggcctcccagcgagtccacgtatccgcttcaacaaggatggttctctcttggctgtttctgccaatgaaaatggaattaaagttttagctaatacagatggtattaggttgttgcgcaattttgataatctatcgtatgatgcatcaagagcgtctgaagctgttgcaaagcctacgataaaccctatttcagctgcggcagctgctgctactagtgctggacttgcagacagaggtgcctctatggtttccattgctggaatgaatggggatgcccggaatttgggggatgtgaaaccaagaataacggaagaatccaatgataaatccaagatttggaagctcactgaaatcaatgaaccctctcagtgccgatccttgaggctacctgataacatgagagtaactaagatttcgaggttaatctacacaaattcaggtaacgctgttctggcattagcatcgaatgccattcatctgctctggaaatggcagcgaagtgatcgcaattcttctggcaaggctactgccagtttgtcacctcaattatggcaaccaccaagtggcattttaatgacaaatgatgttgctgacagtaatcccgaagaggctgtaccctgctttgctttatccaagaatgattcttatgtaatgtcagcatctggagggaagatttccttgttcaatatgatgacatttaagacgatgacaactttcatgccaccaccacctgcagcaacatttcttgctttccatcctcaagataataacatcattgccattggaatggatgattccacaattcagatatataacgtccgtgtagatgaggttaagagcaaacttaaaggacactctaaaagaattactggccttgccttttctcatgtactgaatgtgctagtttcatctggagcagatgctcagctttgtgtatggaactctgagggatgggaaaagcagaagaccagattcttgcagcttccaactggaaggactccatcgcagtcagacacacgtgtacagtttcatcaggaccagatacactttctggttgtacatgaaactcagcttgccatatatgaaacaacaaaactagattgtgtaaagcagtgggcctcacgcgacactgcccccatttcgcatgcgacattctcatgtgatagccagttggtatttgcatgcttcttagatgcgacagtttgtgtgtttaatgctgcaaatctcagactacgttgtcgaattaatccttctgtttatcttcctgctaacatcagcagttctaacgtacaaccactcgtgattgcggcacatccacaagaaccaaatcagtttgcattaggactatcagatgggggggttcatgtctttgagcctctcgaatctgaaggcaaatggggtgtacttccacctgttgagaatgggtcagcaagtagtgtg

SEQ ID NO: 9211 - DNA, 4124 bp, Gossypium raimondii
ttaggttgggttttatataaaaaggaatttaaataattttttcctagagagagaaagagaatctctggctaccttggggttatttttttataaatatttttcttatttttggagagaaaaaaagtgttttttttatatataaaaatctctgggaagaggaagcttcttctttcttgtatgaaaatcgatctcagacgatctagtgtttttatttggtgatttttatttcatcgttgggaactgaagttggaggtggatacgatgtcgtctctcagtagagagcttgtgttcttgatcttacagtttctagatgaggaaaagtttaaagagactgttcacaagcttgagcaggaatctgggtttttctttaatatgaaatattttgaggatgaggtacataatggaaattgggatgaagttgagaaatacttgtctggtttcaccaaggttgatgataatcggtattcgatgaaaatctttttcgagattagaaagcagaagtaccttgaagcattggataagcatgaccggtcgaaagctgtggagatattagtaaaggatttgaaagtttttgctacattcaatgaggaacttttcaaggaaatcactcagcttttgacattggagaatttcagagagaatgaacagttatcaaagtatggggatacaaaatcagctagagcaatcatgttagttgaactcaagaagcttattgaagcgaatcctttattccgtgacaagttgcagttccctaaccttaaaaattcgaggttacgcaccctcattaatcaaagtttgaattggcaacatcaactttgtaaaaacccaaggccaaatccggatattaaaactctctttgtggaccactcatgtggacagccaaatggtgcacgagcaccatctcccgcaaacaatccacttcttggatccttgccaaaagccggaggttttcctcctctaggggctcatgggccttttcaacctacacctgcacaagttccggcaccccttgctggttggatgtcaaatccttctactgtaactcatcctgctgtttctggtggagctattggtcttggcgcttcaatacccgctgcattgaagcacccgaggacccctccaactaatccatcagtagactacccatctggagactctgatcatgtttccaaaaggacaaggcccatggggatatctgatgaggtaaatcttcccgtcaatgtgatgccagtaccgtttcagggccatggtcacagtcaggctttcagtgcacctgatgatctgccaagagctgttgcaagaatgctgaaccagggttcatctcctatgagcatggatttccatcctgttcaacaaactctacttctagttggtaccaatgttggggacatagcattgtgggaagctggctctcgagagcggctggtttctagaaactttaaagtttgggatcttactgcttgttccatgccccttcaggctgctctagtcaaagatcctgccgtctctgtaaaccgtgtaatttggagccctgatggttctttatttggagttgcttactcaaggcacattgtgcaaatatattcttatcatggtggtgatgaggttcggcagcatctcgagattgatgcgcatgttgggggtgtaaatgatattgcattctctcatccaaataagctactttgtgtaataacgtgcggtgatgacaagacaattaaggtgtgggatgcttctaatggtacaaagcagtatacctttgaaggtcacgaggcttctgtttattctgtctgccctcactataaagaaaacattcagtttatcttttcaacagccatcgatggaaagataaaggcatggttatatgataatatgggatcaagggttgactatgaagctcctggtcgttggtgcacaaccatggcctacagtgctgatggtacaaggctcttttcctgtggcaccagtaaagacggggagtcatttatcgttgaatggaatgaaagtgaaggagctgtgaagcgaacttatcaagggttccgcaaacgttctttaggtgttgtacaatttgacacaactaagaacaagtatttggctgctggtgacgatttctctatcaaattctgggatatggacaatattcaacctttgaccagtttcgatgctgatggaggacttccagcgagtccacgcatccgctttaacaaggatggctccctcttggctgtttccaccaatgataacgggattaagattttggcaaattcagatggtatgcgattgttgcgcactttggagaatctttcttacgatgccttgagaacagctgaagccccgaagcctacaataaatccaatctcagctgcagcagcagcagcagccgcagccgctactagtgctggacttgcagatagaagtgttgctattgctggaatgaatggagatgctcggagtttaggggatgtgaaaccccgaataacagaagaatccagtgataaatcaaagatttggaagctcactgaaatcaatgaaccatctcagtgtcgatccttgaggcttcctgaaaacttgagggtgaccaagatatcaaggttaatcttcacaaattcaggtaatgctatattggcattagcatcaaatgctattcacttgctttggaagtggcagcgtagcgatcgtaactcaaatggcaaggcaactgccagtgtagcacctcagttgtggcaaccatcaagtggcattcttatgaccaatgatgttgctgatacaaatcccgaagaggctgtaccgtgttttgctttgtcgaagaatgactcttatgtaatgtcagcatctggaggaaagatttccttgtttaatatgatgacgtttaagacgatggcaactttcatgccaccaccaccagcagcgaccttccttgcattccacccacaagataataatattattgctataggcatggacgactcaacaattcagatatataatgtccgtgtggatgaggtgaagagtaaacttaaaggtcactccaaaagaataactggccttgccttctcgcatgtactgagtgtgctcgtctcatcaggagccgattctcagctttgtgtgtggaacaccgatggatgggaaaagcagaaggctagattcctgcaggttccagcggggaggacaccaacagcactgtcagacacacgtgtacaattccatcaagaccagatacattttcttgttgtacatgagactcagcttgccatatatgaaacaacgaagctagactgcatgaaacagtgggtcccacgtgattcttctgctcctataacgcatgcaacgttctcatgtgatagccaactggtatatgccagctttctcgatgcatctgtttgtgtgtttactgctgcaaacctcagattacgttgtcgtataaacccttctgcttatcttccaactaacatcagttccaatgttcacccacttgtaatcgctgcacatccatccgagccaaacgaatttgcattgggactctcagatggtggcgttcatgtctttgagccccttgaatccgaaaacaaatggggtgtgcctccacccgttgaaaacggttcagccagcagtatgacagcaacaccttcagttggagctccaggatcagaacaagcccagagatgataaaatggttgacaaaagcacaaattcttttatatgattggcttgcatgcccctccctaatttagcttgacaatgaaagatgatgccaagatgtagatttttaacatattttgtgagatacaatgtctttaaggtaaatggcatagtagtgttttcttatgccctttttttgaagggaaaaattatgtttaaaaggaggaatgattttctgttctattgtagttgtttatcttcatatattacccccccccttttttttctcataaatcagaatgttctttttatgtatcagatttacattttcttctttcagaaaccttttcttctttctctgtcatcaactttaactgatggacatatatacttgtatctttaaataatcctatgatggtgtttacatagcatatggagcaagagccaaaaaccaagcaatgttcatcaagtctaattagaacctacaa

SEQ ID NO: 9212 - DNA, 3850 bp, Vitis vinifera
agagaagcagtctagagagagaaagtagtgtttctctctcctcttcttcctgtctctctgttatttctctccaaatccatcttctctttgttggcttttcaaagatctagtgttattttttgtgaaatttgttgatttggataccaacagggggccaaaacgatgtcgtctctcagtagagagcttgtgttcttgatcttacaatttcttgatgaggagaagtttaaagagactgttcacaagcttgaacaggaatctgggtttttctttaacatgaagtattttgaggatgaggtacatagtgggaattgggatgaggttgagaagtacctctctggttttacgaaggtggatgataatcggtattcaatgaaaatctttttcgaaattaggaagcagaagtatcttgaggcattggacaagcatgatcggtccaaggcggtagaaatattggtaaaggatctaaaagtttttgcaacatttaatgaggagctcttcaaggaaatcacacaactcttgacattggagaattttagggaaaatgaacaactctctaagtatggggatacaaagtctgctagagcaattatgttggttgagctcaaaaagcttatcgaagcaaatcccttattccgtgacaagttgcagtttcctcacctcaaaaattcacggttacggactcttattaaccaaagcttgaattggcaacatcaactctgtaaaaatccaaggccaaatccagatataaaaactctttttgtagaccatacatgtggacaaccaaatggtgcacgggcaccatcacccgcaaacaatcccttgctaggatccctaccaaaagctggaggttttcctcctctgggtgctcatgggccttttcaacctacaccagcacctgttcctactccgctttggatgtccaatccttctactgtaactcatccagcagtttctggaggccctattggacttggtgctccatcaatccctgctgctttgaagcatcctaggactcctccaactaacccttctgtggactacccatcaggggattctgagcatgttgccaaaagaggaagacctatgggaatttctgatgaggtgaatctacctgttaatgtgttgccagtgacattcccagggcatggtcatagtcaggcttttaatgcgcctgatgatttgcccaagactctagtacggaatctgactcaggggtcatctccgatgagcatggattttcatcccgtacaacagactctgcttttagttggtaccaatgttggggacatagggttgtgggaagttggttctaagcaaaaattggtttcaaggaacttcaaagtatgggatattggtgcatgttcagtgcctcttcaggcagcactagctaaagatccaggtgtctctgttaaccgcataatctggagcccggatggttctttgtttggagttgcatactctaggcacattgtgcaaatatattcttatcatggtggtgatgatgtacggcagcatctggagattgatgctcatgctggtggagtaaatgatctggcattctctcatccaaataagcaactttgcgttataacctgtggtgatgacaagaccatcaaggtgtgggatgccactaatggaactaaacagtatacttttgaaggccatgaggatgcagtttattctgtctgcccccactataaggagaatattcagtttatcttttcaacagcacttgatgggaagataaaagcatggttatatgataacttgggatctcgagttgattatgatgctccaggtcgctggtgcacaacaatggcttacagtgcagatggtacaaggctcttttcatgtggaacaagtaaggatggggattcatatatcgttgaatggaatgaaagtgaaggggcagttaaaaggacctaccaagggttcaggaaacgttctttgggtgttgtgcaatttgatacaactaaaaatcggtttttggctgctggcgatgatttctctattaaattttgggatatggacaacattcaacttctaacaatccttgatgcggaaggagggcttccagggcttcctgcaagcccacgcattcgcttcaacaaggacggcactctcttggctgtttctgctaatgagaattcgattaaaatcttggctaattctgatggtcttagattgttgcgcacatttgacaatctttcttatgatgcttcaagagcatctgaatctgtgacaaagcctgccataaattcaatttcagctgctgctgctgctactagtgctggactagcagacagaggtgcatctgtggttgctattgctggaatgaatggggacgccagaaacatgggggatgtgaaacccagattagctgaagaaacaaatgacaaatcaaagatttggaagctcactgaaatcaatgaaacgtcgcagtgtcggtcattgaggcttcaagaaaacttgagaataacaaagatatcaaggttgatctatacaaattccggtaatgctattctggcattagcatcaaatgccattcattttctttggaagtggcagcgcaatgatcgtaattcgagtggcaaggcaactgccactgtttcacctcaattatggcaaccaacaagtggcattctaatgaccaatgatgttgctgacactaatcctgaagaggctgttccctgctttgctttgtctaagaatgattcttatgtaatgtcagcttcaggagggaagatttcccttttcaatatgatgacatttaagacaatgactactttcatgcctccaccacctgcagcaacatttcttgctttccatcctcaagataacaatattattgctatcgggatggatgattctacaatccagatatataacgtccgcgtagatgaggttaaaagcaagcttaaaggccactctaagagaataactggccttgccttctctcatgttcttaatgtgctagtttcgtctggagcagatgctcagctttgtgtgtggagctctgatggatgggaaaagcagaagtcgagattcttacaggttccagctggaaggacatcaacaggacaatcagatacccgtgttcagtttcatcaggaccagacacatttcctggttgttcatgagactcagcttgccatttacgaagcaacaaaactagattgtgtaaagcagtgggttcaacgtgaagctgctgctccaatatcccatgcaaccttctcatgtgatagcctgctagtatatgccagtttcttagatgcaactgtctgtgtattcagtgctgcaaatctcaggctacgatgtcgtattaatcctactgcttaccttcctgccagtgtcagcaattctaatgtacacccccttgtgattgcggcacatccacaagagccaaatcagtttgcattgggattatctgatggtggagtgtgtgtttttgagccccttgaatccgaaggcaaatggggtgtgccaccacctgttgagaatggatcagctagtagtgtgccagctacaccttcagttggaccttcaggttcagatcaaccccaaagatgatcaaacggctgccagagcacaagttcttttacatgcttggcttactggcactctaaatttagattttcaggatatgtaatttactcaaggattgaaatctgttgatgtagatctaacttattggggtaaggttctgcttgaggtaaatgctgtagaagaattaatagtgaaatattttttctttttaaaaagaaatttctttgaggaagtctttcttctctcgtctttgttaacattttgcttcaattattgaatagtaatgctgttttatgcatcgaac

SEQ ID NO: 9213 - DNA, 4272 bp, Vitis vinifera
cgcagatctagtgttattttttgtgaaatttgttgatttggataccaacagggagccaaaacgatgtcgtctctcagtagagagcttgtgttcttgatcttacaatttcttgatgaggagaagtttaaagagactgttcacaagcttgaacaggaatctgggtttttctttaacatgaagtattttgaggatgaggtacatagtgggaattgggatgaggttgagaagtacctctctggttttacgaaggtggatgataatcggtattcaatgaaaatctttttcgaaattaggaagcagaagtatcttgaggcattggacaagcatgatcggtccaaggcggtagaaatattggtaaaggatctaaaagtttttgcaacatttaatgaggagctcttcaaggaaatcacacaactcttgacattggagaattttagggaaaatgaacaactctctaagtatggggatacaaagtctgctagagcaattatgttggttgagctcaaaaagcttatcgaagcaaatcccttattccgtgacaagttgcagtttcctcacctcaaaaattcacggttacggactcttattaaccaaagcttgaattggcaacatcaactctgtaaaaatccaaggccaaatccagatataaaaactctttttgtagaccatacatgtggacaaccaaatggtgcacgggcaccatcacccgcaaacaatcccttgctaggatccctaccaaaagctggaggttttcctcctctgggtgctcatgggccttttcaacctacaccagcacctgttcctactccgctttggatgtccaatccttctactgtaactcatccagcagtttctggaggccctattggacttggtgctccatcaatccctgctgctttgaagcatcctaggactcctccaactaacccttctgtggactacccatcaggggattctgagcatgttgccaaaagaggaagacctatgggaatttctgatgaggtgaatctacctgttaatgtgttgccagtgacattcccagggcatggtcatagtcaagcttttaatgcgcctgatgatttgcccaagactctagtacggaatctgactcaggggtcatctccgatgagcatggattttcatcccgtacaacagactctgcttttagttggtaccaatgttggggacatagggttgtgggaagttggttctaagcaaaaattggtttcaaggaacttcaaagtatgggatattggtgcatgttcagtgcctcttcaggcagcactagctaaagatccaggtgtctctgttaaccgcataatctggagcccggatggttctttgtttggagttgcatactctaggcacattgtgcaaatatattcttatcatggtggtgatgatgtacggcagcatctggagattgatgctcatgctggtggagtaaatgatctggcattctctcatccaaataagcaactttgcgttataacctgtggtgatgacaagaccatcaaggtgtgggatgccactaatggaactaaacagtatacttttgaaggccatgaggatgcagtttattctgtctgcccccactataaggagaatattcagtttatcttttcaacagcacttgatgggaagataaaagcatggttatatgataacttgggatctcgagttgattatgatgctccaggtcgctggtgcacaacaatggcttacagtgcagatggtacaaggctcttttcatgtggaacaagtaaggatggggattcatatatcgttgaatggaatgaaagtgaaggggcagttaaaaggacctaccaagggttcaggaaacgttctttgggtgttgtgcaatttgatacaactaaaaatcggtttttggctgctggcgatgatttctctattaaattttgggatatggacaacattcaacttctaacaatccttgatgcggaaggagggcttccagggcttcctgcaagcccacgcattcgcttcaacaaggacggcactctcttggctgtttctgctaatgagaattcgattaaaatcttggctaattctgatggtcttagattgttgcgcacatttgacaatctttcttatgatgcttcaagagcatctgaatctgtgacaaagcctgccataaattcaatttcagctgctgctgctgctgctgctgctactagtgctggactagcagacagaggtgcatctgtggttgctattgctggaatgaatggggacgccagaaacatgggggatgtgaaacccagattagctgaagaaacaaatgacaaatcaaagatttggaagctcactgaaatcaatgaaacgtcgcagtgtcggtcattgaggcttcaagaaaacttgagaataacaaagatatcaaggttgatctatacaaattccggtaatgctattctggcattagcatcaaatgccattcattttctttggaagtggcagcgcaatgatcgtaattcgagtggcaaggcaactgccactgtttcacctcaattatggcaaccaacaagtggcattctaatgaccaatgatgttgctgacactaatcctgaagaggctgttccctgctttgctttgtctaagaatgattcttatgtaatgtcagcttcaggagggaagatttcccttttcaatatgatgacatttaagacaatgactactttcatgcctccaccacctgcagcaacatttcttgctttccatcctcaagataacaatattattgctatcgggatggatgattctacaatccagatatataacgtccgcgtagatgaggttaaaagcaagcttaaaggccactctaagagaataactggccttgccttctctcatgttcttaatgtgctagtttcgtctggagcagatgctcagctttgtgtgtggagctctgatggatgggaaaagcagaagtcgagattcttacaggttccagctggaaggacatcaacaggacaatcagatacccgtgttcagtttcatcaggaccagacacatttcctggttgttcatgagactcagcttgccatttacgaagcaacaaaactagattgtgtaaagcagtgggttcaacgtgaagctgctgctccaatatcccatgcaaccttctcatgtgatagcctcctagtatatgccagtttcttagatgcaactgtctgtgtattcagtgctgcaaatctcaggctacgatgtcgtattaatcctactgcttaccttcctgccagtgtcagcaattctaatgtacacccccttgtgattgcggcacatccacaagagccaaatcagtttgcattgggattatctgatggtggagtgtgtgtttttgagccccttgaatccgaaggcaaatggggtgtgccaccacctgttgagaatggatcagctagtagtgtgccagctacaccttcagttggaccttcaggttcagatcaaccccaaagatgatcaaacggctgccagagcacaagttcttttacatgcttggcttactggcactctaaatttagattttcaggatatgtaatttactcaaggattgaaatctgttgatgtagatctaacttattggggtaaggttctgcttgaggtaaatgctgtagaagaattaatagtgaaatattttttctttttaaaaagaaatttctttgaggaagtctttcttctctcttctttgttaacattttgcttcaattattgaatagtaatgctgttttatgcatcgaacggagtcatgtctgaaatgtacattacttggatttcctttcagtcctctcctctttttatgaactgccaccagttgatagcaaaattcaatttcaaggggcatccagatatgctatcaactctctgtttttggaattgtaattatacgttctatgaacaactccactttttctccccctgttttgtcttgccagtgtggcttaaggtcttcacccttgttccttccatgtctagaagctccaaatctgaaactctgttttgatattcagccggggtcttaaatattcaaggcgaagttaaaatgcgtgacaaggataaatgtatttgtttgatgatctttgattgatcaggtgagcacaatggcccctagagtagagcaaccataggtgggtcttacccaagctggagagtgccatctagtctcagtactgaaattcaagttccttttgtacagtgagatcaacaccttttaagttcacataaagttgacctttttccagttggaatgggtgg

SEQ ID NO: 9214 - DNA, 4253 bp, Gossypium raimondii
gtacattttccaataagctatcaagtgataagtaactctacttatcatcttctttatctgcctccccctttaaaattctccatttctgcaaggctgtaggttgggtttttatataaaaaggatatacaaaagagagagagagagaagagagagaaagtgaaatctctgcctgcctttggttttttttttttttgtttaagagagaaagttcttttaacctcttaaagggtctgaaactcgatctcttctaaagaacaagatctggtgattttcgtttcagcgttgggacttgaaacggggcggcttcgatgtcgtctctcagtagagagcttgttttcttgatcttacagttcctagatgaggaaaagtttaaagagactgttcacaagcttgaacaggaatctgggtttttcttcaatatgaaatattttgaggatgaagtgcataatggaaattgggatgaggtggagaaatacctctctggttttaccaaggtcgatgacaatcgatattccatgaaaatctttttcgagataagaaagcagaagtatcttgaggcattggataagcatgatcgatccaaagctgtggagatattagttaaggatttgaaagtttttgctacatttaatgaggaactttttaaggaaatcactcagcttctgacgttggagaatttcagagagaatgaacagttgtcgaaatatggagatacaaagtcagctagagcaatcatgttagttgaactcaagaagcttattgaagcaaatcctttattccgtgacaaattgcagttcccgacccttaaaaattcgaggttacgaaccctgattaatcagagcttgaattggcagcatcaactttgtaaaaacccgagaccaaatccagatataaaaactctctttgtggatcactcatgtgggcagccaaatggtgcacgagcaccatcacctgccaataatccacttcttggatccttaccaaaagctggaggttttcctcccttaggtgctcatgggccttttcaagctacgcctgcaccggttccagcaccccttgcaggttggatgtcaagtccttcagctgtaactcatccagcagtttcagctggtgccattggtcttggtgcgtcttcaataccagctgcgttgaagcatccaaggactcctccaactaatccgtctgtagactacccatctgcagactctgatcatgtttccaaaagggccaggcccatggggatttccgatgaggtaaatctgccagttaatgtgctgcaggtaacatttccgggccatggtcacagtcaaactttcaatgcacctgacgatcttccgaaggctgttgcaagaactctgaatcagggttcatctcctatgagcatggatttccatcctgttcagcagactctacttctagttggtacaaacgttggagacattgccttgtgggaagttggctctcgggagcggctggtttcaaagaacttcaaagtttgggatcttagtgtttgttcaatgcctcttcaggctgctctagtcaaagatcctgctgtctcagtaaatcgtgtaatttggagtcccgatggttctttattcggagttgcttattcaaggcatattgtgcaaatatattcttaccatggtggtgatgaagttcgacagcatcttgagattgatgctcatgttggtggagtaaacgatattgcattctctcttccaaataagcaactttgtgtaataacttgcggtgatgacaagacaattaaggtgtgggatgcttccaatggtacgaagcagtatacctttgaaggtcacgaggctcccgtgtattctgtctgccctcactataaagagaacattcagtttatcttttcaactgccttagatggaaagataaaggcatggttgtatgataacatgggatcacgggttgactacgaagctcctggtcggtggtgcacaaccatggcctacagtgctgatggtacaaggcttttttcatgtggaaccagtaaagaaggggagtcatttatcgtagaatggaatgaaagtgaaggggctgtgaagaggacctatcaaggattccgcaaacgttctttaggtgttgtgcaatttgatacaactaagaaccggtatttggctgctggtgatgatttctcgataaaattctgggatatggacaatgttcaacctttgaccagttatgatgccgaaggaggccttcctgcaagcccacggatccgctttaataaagatggctctctcctggctgtttcagccaatgataatggaattaagattttggccaattcagatggtatgcgattgctgcgcactttggagaatctgtcttatgatgcctcaagaacaccggaagctcctaaaccaacaataaatccaatctcagctgcagcagcagctactagtgctgcacttgcagacagaagtgcatctgtggttgctatacctggaatgaatggggatgccaggagttttgcggatgtgaaacccagaataacagaagaatctagtgataaatcaaagatttggaagctcaccgaaatcagtgaatcttctcagtgtcgatccttgaggcttcctgaaaacttgagggtgaccaagatatcaaggttaatcttcacaaattccggtaatgctatcctggcgttagcatcaaatgctattcacttgctttggaaatggcagcgaagtgatcgtaattcaaatggcaaggcaactgccagtgtatcacctcagttgtggcaaccatcaagtggcattcttatgacaaatgatgttgctgatacaaatccagaagaggctgttccttgttttgctttatctaagaatgattcttatgtaatgtcagcatctggaggaaagatttccctgtttaatatgatgacatttaagacaatggcaactttcatgccaccgccacctgccgcgacttttcttgcattccacccacaagataataatattattgctattggcatggatgattcaacaattcagatatataatgtccgtgtggatgaggtgaagagtaaactcataggtcactccaaaagaataactggccttgccttctctcatgcactgaatgtgcttgtctcatccggggcagattctcagctttgtgtatggaacactgatggatgggaaaagcagaagactaaattcttgcagattcctgttgggataacaccaactgcacaatcagagacacgcgtacaattccatcaagaccagatacgtcttcttgttgtacatgagactcagcttgccttatatgaaacaacgaagttggaatgttttaagcagtgggtccctcgtgaatctttcgcgccaattactcatgcaacattttcatgtgatagccaactggtatatgccagctttttggatgcaactatttgtgtgtttgttgctgcaaacctcagaccacgttgccgtataaatccctctgcttatctgccagctagtgtcagctccaatgttcaccctcttgtaattgctgctcatccatcagagccaaatgaatttgcggtgggactctccgatggaggggttcatgtcttcgagccccttgagtctgaaaacagatggggagtgcctcaaccagcagacaatgggtcagccagcagtataacagcgacaccttcagttgcagctcaaggatcagaacaagcgcaaagatgatgatgaaaacgggtgatggagcacaagtttcttttatatacttggcttgcaggcccatctaatttagtattggttgagataaaaagttgcaaatattcaattttggatgcaagaagggggctgtactcaagttacgagcagcataccatattttggtggtccactcagcattgttggcattatcttttttagaagttggctttcactgtaaatgttgaattggtaaaaagctcttacttttgttcttattgtattgttaaaagatggattggtaaaagaaaatctaactttttttttttgtagaaatgatggtttaataacaaatgttagaagtatcaaatttgcaacaatgaatcccattataaataaaccctttaaactccatggtaacaatcaaaccttaaattgagtaaatattaccattgaatttagaacattatatatgacatcatgagagaccatccatttttagagtgcaatactcaataatgaatcaatcccctatatttttacaaataaccaaaacaatcagatctctttccttta

SEQ ID NO: 9215 - DNA, 4149 bp, Gossypium raimondii
aggttgggtttttatataaaaaggatatacaaaagagagagagagagaagagagagaaagtgaaatctctgcctgcctttggttttttttttttttttggttaagagagaaagttcttttaacctcttaaaggatctggtgattttcgtttcagcgttgggacttgaaacggggcggcttcgatgtcgtctctcagtagagagcttgttttcttgatcttacagttcctagatgaggaaaagtttaaagagactgttcacaagcttgaacaggaatctgggtttttcttcaatatgaaatattttgaggatgaagtgcataatggaaattgggatgaggtggagaaatacctctctggttttaccaaggtcgatgacaatcgatattccatgaaaatctttttcgagataagaaagcagaagtatcttgaggcattggataagcatgatcgatccaaagctgtggagatattagttaaggatttgaaagtttttgctacatttaatgaggaactttttaaggaaatcactcagcttctgacgttggagaatttcagagagaatgaacagttgtcaaaatatggagatacaaagtcagctagagcaatcatgttagttgaactcaagaagcttattgaagcaaatcctttattccgtgacaaattgcagttcccgacccttaaaaattcgaggttacgaaccctgattaatcagagcttgaattggcagcatcaactttgtaaaaacccgagaccaaatccagatataaaaactctctttgtggatcactcatgtgggcagccaaatggtgcacgagcaccatcacctgccaataatccacttcttggatccttaccaaaagctggaggttttcctcccttaggtgctcatgggccttttcaagctacgcctgcaccggttccagcaccccttgcaggttggatgtcaagtccttcagctgtaactcatccagcagtttcagctggtgccattggtcttggtgcgtcttcaataccagctgcgttgaagcatccaaggactcctccaactaatccgtctgtagactacccatctgcagactctgatcatgtttccaaaagggccaggcccatggggatttccgatgaggtaaatctgccagttaatgtgctgcaggtaacatttccgggccatggtcacagtcaaactttcattgcacctgacgatcttccgaaggctgttgcaagaactctgaatcagggttcatctcctatgagcatggatttccatcctgttcagcagactctacttctagttggtacaaacgttggagacattgccttgtgggaagttggctctcgggagcggctggtttcaaagaacttcaaagtttgggatcttagtgtttgttcaatgcctcttcaggctgctctagtcaaagatcctgctgtctcagtaaatcgtgtaatttggagtcccgatggttctttattcggagttgcttattcaaggcatattgtgcaaatatattcttaccatggtggtgatgaagttcgacagcatctcgagattgatgctcatgttggtggagtaaatgatattgcattctctcttccaaataagcaactttgtgtaataacttgcggtgatgacaagacaattaaggtgtgggatgcttccaatggtacgaagcagtatacctttgaaggtcacgaggctcccgtgtattctgtctgccctcactataaagagaacattcagtttatcttttcaactgccttagatggaaagataaaggcatggttgtatgataatatgggatcgcgggttgactatgaagctcctggtcggtggtgcacaaccatggcctacagtgctgatggtacaaggcttttttcatgtggaaccagtaaagaaggggagtcatttatcgtagaatggaatgaaagtgaaggggctgtgaagaggacctatcaaggattccgcaaacgttctttaggtgttgtgcaatttgatacaactaagaaccggtatttggctgctggtgacgatttctcgataaaattctgggatatggacaatgttcaacctttgaccagttatgatgccgaaggaggccttcctgcaagcccacggatccgctttaataaagatggctctctcctggctgtttcagccaatgataacggaattaagattttggccaattcagatggtatgcgattgctgcgcactttggagaatctgtcttatgataactcaagaacaccggaagctcctaaaccaacaataaatccaatctcagctgcagcagcagctactagtgctgcacttgcagacagaagtgcatctgtggttgctatacctggaatgaatggggatgccaggagttttgcggatgtgaaacccagaataacagaagaatctagtgataaatcaaagatttggaagctcaccgaaatcagtgaatcttctcagtgtcgatccttgaggcttcctgaaaacttgagggtgaccaagatatcaaggttaatcttcacaaattccggtaatgctatcctggcgttagcatcaaatgctattcacttgctttggaaatggcagcgaagtgatcgtaattcaaatggcaaggcaactgccagtgtatcacctcagttgtggcaaccatcaagtggcattcttatgacaaatgatgttgctgatacaaatccagaagaggctgttccttgttttgctttatctaagaatgattcttatgtaatgtcagcatctggaggaaagatttccctgtttaatatgatgacatttaagacaatggcaactttcatgccaccgccacctgccgcgacttttcttgcattccacccacaagataataatattattgctattggcatggatgattcaacaattcagatatataatgtccgtgtggatgaggtgaagagtaaactcataggtcactccaaaagaataactggccttgccttctctcatgcactgaatgtgcttgtctcatccggggcagattctcagctttgtgtatggaacactgatggatgggaaaagcagaagactaaattcttgcagattcctgttgggataacaccaactgcacaatcagagacacgcgtacaattccatcaagaccagatacgtcttcttgttgtacatgagactcagcttgccttatacgaaacaacgaagttggaatgttttaagcagtgggtccctcgtgaatctttcgcgccaattactcatgcaacattttcatgtgatagccaactggtatatgccagctttttggatgcaactatttgtgtgtttgttgctgcaaacctcagaccacgttgccgtataaatccctctgcttatctgccagctagtgtcagctccaatgttcaccctcttgtaattgctgctcatccatcagagccaaatgaatttgcggtgggactctccgatggaggggttcatgtcttcgagccccttgagtctgaaaacagatggggagtgcctcaaccagcagacaatgggtcagccagcagtataacagcgacaccttcagttgcagctcaaggatcagaacaagcgcaaagatgatgatgaaaacgggtgatggagcacaagtttcttttatatacttggcttgcaggcccatctaatttaggtatgctgttttttttcccagtgtcaaatttgtcaagaaacaaaaacagtattgatggaaaggaaagacaagacaatgccaaaaacaagttgatccaataaattgggtcattcaccattttgaactacaactgaattcaagttccataactacaacattatttcatggtgtttgttagagcagcaattcataaaattgcctatttcaagttctctattttcggttttcattttgtcataagtcctttggctctactctattgttcgccacttcatttcagtattggttgagataaaaagttgcaaatgttcaattttggatgcaagaagggggctgtactcaagtcacgagcagcataccatattttggcggtccactcagcattgttggcattatcttttttagaagttggctttcactgtaaatgtggaattggcaaaaagctcttacttttgttcttattgtattgttaaaagatggattggtaaaagaaaatctaac

SEQ ID NO: 9216 - DNA, 4147 bp, Populus trichocarpa
tatatatatatatatatatatataatttatggactatataaaactctgtgggggagagagtctatacagagagaaaagataaaaaaatttgtgcttcatttctacagagaaagaaagagaaagaaagggtctgatctctcagttgctttctttcggaggcagatctagagctacagtcggtggtatttgtgcaattggtttacaaaacggcgcgtttaagatgtcttctctcagtcgagagcttgttttcctgatcttgcagttccttgatgaggaaaagttcaaagagactgttcataagcttgagcaggaatctggatttttctttaacatgaagtattttgaggatgaggtgcataatggaaattgggacgaggtggagaaatacctatctggtttcactaaagtggatgataatcgatattcaatgaaaatatttttcgagataaggaagcaaaagtatctcgaagctttggataagcatgatcggtccatggcagttgaaatattggtgaaggatttgaaagtgttttccacattcaacgaggagcttttcaaggaaatcactcaactactgacattggagaattttagggagaatgagcaactctccaaatatggagataccaagtcggcgagagcaatcatgttggtggaactgaagaagcttatcgaagcaaatcccttgtttcgtgacaaattgcagtttcctaaccttaagaattcaaggctacgaactctcattaaccaaagcttgaattggcagcaccaactttgtaaaaacccaaggtcaaacccagatataaagactctttttgttgatcattcatgtggacaaccaaatggtgctcgggctccatcacctgcaaacaatccattgcttggctccttaccaaaagctggagggtttcctccattgggtgcacatgggccatttcaacctgcaccagcaccagtcccagcacctcttgcaggttggatgtccactccttccacagtaactcattctgcagtctctggaggaggagccattggtcttggtgctccatcaatcccagctgctctgaagcatccacgaactcctccaactaacctttccgtagattacccttcaggagattctgaccatgttgctaaaagagtaaggcccatggggatttctgatgaggtaaatttgccggttaatgtgttgccagtatcatttccagggcatggtcatggtcatggccatggtcaggcttttaatgcaccggatgacttgccaaaggtcgttgcacggactctgaatcagggatcatctcctatgagcatggatttccatcctcttcaactgactcttcttctagttggcaccaatgttggggacattgggctgtgggaagttggttctagggagcgactggttttaagaatcttcaaagtttgggatctgaatgcttgttcgatgcctcttcaggcagctttagccaaagatcctggtgtctcggttaaccgtgtaatttggagtccggatggttccttatttggagttgcatactcaaggcatattgtacaaatatattcttatcatgggaatgatgaagtgcgtcagcatctggagattgatgctcatgttggtggagttaatgatcttgcattctccactccgaataagcaactctgtgtaataacctgtggtgatgacaaaaccattaaggtgtgggatgcttccactggtgcaaaactgtatacttttgaaggtcatgaggctcctgtttattccatttgcccgcattataaggaaaacattcagtttatattttcaacagcactggatggaaagataaaagcatggttatatgacaatttgggatctcgagttgattatgaggctcctggtcgctggtgcacaaccatggcttacagtgctgatggtacaaggctattttcttgcggtacaagtaaagatggggattcatttattgttgaatggaatgaaagtgaaggtgctgtgaaaagaacctatcttggatttagaaaacaatcttggggtgtcgtgcaatttgataccacaaagaatcgttttttggctgctggtgatgatttctccatcaagttctgggatatggacagtgttcaacttctgacaacaattgatgctgatggaggtctcccagcgagcccacgtatccgcttcaacaaggatggcactcttttggctgtttctgcgaatgataatgggattaaaatattggcaaatacagatggcattaggttgttgcgtacatttgaaaatctttctttcgatgcctcacgaacatctgaatccattgcgaagcctactgttaacccaatctcagctgcagcggtggcggcagcagcagctgctgcaaccagcactggtcttgcagacaggagtgcctctgtggttgccattgctggaatgaatggagatgccaggaacttgggagatgtgaaacctcgattaactgaagaatccaatgataaatcaaagatatggaagctcactgaaatcaatgaaccatctcaatgccggtccttgaggctccctgaaaacttgagagtaaccaagatatcaaggttaatctatacaaactctggcaatgccattttggcattagcttcaaatgcaatacacctattatggaaatggcaacgcagtgatcggaatgctagtggcaaggcaactgcaggtgtgtcacctcaattatggcaaccatcaagtgggattctgatgaccaatgacagcactgacactaaccctgaagaggctgtgccctgttttgctttgtccaaaaatgattcttatgttatgtcagcatccggaggaaagatttcccttttcaatatgatgacatttaagacgatgacaactttcatgccaccacctcctgcagcaacctttcttgcttttcatcctcaagataacaacataattgctattggcatggatgattccacaattcaaatatataatgtccgcgtagacgaggtcaagagcaagctcaaaggccactctaaaagaataactggccttgccttttcccatgtgttgaacatgctagtctcatcaggagcagatgctcagctttgtgtatggaactctgatggatgggaaaagcagaaagcaagattcttgcaggtcccagctggaaggacaccaacagcacaatcagacactcgtgtacaatttcatcaggaccagatacatttcctggttgtgcatgagactcagcttgccatatatgaaaccacaaagctagaatgtgtaaagcagtgggttctacgtgaatcttctgcgccaatctcacatgcagtgttctcctgtgatagtcatctggtatatgctagtttcttagatgcaactgtctgtgtatttagtgctatgaatctcagattacgttgtcgtatcaatccttgtacgtatctttcccctaatgtcagttcaaatgtccacccactagtgatcgctgcacacccacaagaaccaaatcagtttgcattgggactatcagatggtggggttcatgtctttgagcctcttgaatctgaaggaaaatggggtgtgcctccacctgctgagaatgggtcagcaagtagtgtgccagctactccttcagttggaccatcaggttcagatcaagctcagagatgatcaatgactgccagagcacaagttcttttacatgcttggcttgctggcccattcctaaattagtatgaggttcaatgatacgtaacctactcaaggaacgagttgcaaaagatgtagatatagcatgttctgtctgatacttcgtgaggtaaatgctgtagtggtagtagtatttatagtgatgccttttgaccttaagctagaaatttattcaaggaagggttttttttttctttttataactcttgaatagtctgtaatatttttattattttttcttcaaacattgaaatttcttcattgttttgtttgtcatggagaatcttttcctcaacccagtctttcgactgttgataagaatctatggagtggattcccaaccattactaccactcacaatatcagaccataaagcctcatgtttaaatgaattattatcttcataaatcatagaagtgttgaagcaagtattggtacccaacatgataacac

SEQ ID NO: 9217 - DNA, 4206 bp, Chenopodium quinoa
gacaaacttctctgttctctctcctcttctcaatctcgtccttcttccttatctcacattctcaccgacgacactcatgaagaacacaattgcttagagaaggaattcttctcccaattatgtcggatttctcatcaactcttccgatgatgtcgacctcaatcttcttcctaatggcggcgagtgatctttaattctggaagtatctcaccatgcttatctctctctctttcatacgatccctcacaaggttgatgagcttcgaaaacatatcgaggttacacaaaattccagtattgagtgcggcgacggcgcgtaagaagaaaaactttatcagttataattcacccatatttcttatttggggttttacagatctggagaaatttgaggagataacggaatttctgggcggaaaaacgaaagagcagtttaagatgtcatctctaagtagagagcttgttttcctgattttacagtttttagatgaagaaaagtttaaggaaactgttcacaagcttgaacaggaatctgggtttttctttaatatgaagtattttgaggatgaggtgcataatggtaattgggacgaggttgagaggtatctttcggggtttacgaaagttgatgataatcgatactcaatgaagatattcttcgaaatccgaaagcaaaagtacttagaggcactggacaagcatgatcgatcgaaggcagtggatatacttgtcaaggatctgaaggtttttgcttcatttaatgaagagttgtttaaggaaattactcaactgttgacattggagaatttcagagagaatgagcagttgtctaaatatggagatacaaaatctgcaagggcaataatgttggttgaactcaagaagctaattgaagccaatcccttgtttcgtgacaaattgcaatttccgaatcttaagaattctaggttgcgaaccctgatcaatcagagcttgaattggcagcatcaactgtgtaaaaaccctaggccgaatccagatatcaagacgctgtttgtggatcactcttgtggacaaccaaatggtgctcgtgctccatcgccggctaataatcctctattaggctctttgccaaaagcaggaggctttccacctttgggtgcacatgggccttttcagccaacacctgctcaagtgccagcccctcttgctggatggatgtccaatccttctactgtaactcatcccgctgtatctggtggacctattgggcttggtgctccgtcaatgcctgctgcattgaagcatccaaggactcctcctacaaattcttccatggattatccatctggagactctgatcatgttgccaagagaacaagaccgataggaatatctgatgaggttaatcttcctgtcaatgtactgccagtgtcatttccaggccatggtcatactcagccatttaatgcacctgatgatttgcccaaaagtgttgttaggactttgaatcaggggtcttctcctatgagtatggattttcatcctgttcaactgacactacttctggttggcacaaatgtcggagacatagcattatgggaagttggctcccgtgaaaggctggtcttaagaaactttaaagtttgggagcttagtacgtgctcaatgcctctgcagtcagctctagtcaaagatcctgccgtttctgttaaccgtgtgatttggagccctgatggatccttgtttggggttgcatactcaaggcacattgtacaaatatattcatatcatggtaatgaagatgtacgacaacatttagagattgatgctcatgctggaggagtgaacgatattgccttttctactcctaataaacaactctgtgttatcacgtgtggggatgacaagaccattaaagtgtgggatgctgctaccggttcaaagcaatatacatttgaaggccatgaggctcctgtttactcagtgtgcccacattataaagaaaacatacagtttattttttcaactgctgtcgatgggaagattaaagcttggttgtatgacaatctgggctctcgcgtcgattatgatgctccaggccgctggtgcacaaccatggcttatagtcaagacgggaccaggcttttttcatgtggtaccagtaaagatggtgaatcacatattgttgaatggaatgagagtgaaggtgctgtgaagcgaacctatcaagggtttcggaaaagatcgctaggtgttgttcagtttgatacgactaagaatcgatatttggctgccggtgatgatttttctattaagttctgggatatggacaatgtgcagctgttgacttccattgatgctgatggaggacttccagcaagtccacgtatccgcttcaacaaagatggtacacttttagcaatctctgcaagtgaaaatggaataaaaattgtggctaattctgatggcctccggcttttacggacatatgaaaatctttcatatgattcctccagagcatctgaatctttgacaaagccttcaatcaatcccatttctgctgctgccgctgcagctgctactagttctgggctccctgacagaagtgcccctatgatttccatgggtggaatgaatgtagatgctagaagcatgggagatgtaaaatcgcgaattcttgaggaaactaatgacaaatcaaagatctggaagctttgtgaaatcagtgaaccagctcagtgtcgttcattgcgactccctgaacacatgagagcagctaagatttctagactgatctatacaaactcaggtaatgctatcttggcattagcttcaaatgcaattcatttgctttggaaatggcagaggaatgaacgtaacgcaagtgggaaggcatcagctaatgttccacctcagctctggcaaccctctagtggtattttgatgacaaatgatatctctgatgcaagtcctgaagaggctgttccttgctttgctttgtccaagaatgattcgtatgtaatgtctgcatccggagggaagatttcccttttcaacatgatgacttttaagacaatgacggtctttatgcctccaccaccagcagcaacatttcttgctttccatcctcaagataacaatataattgctattggcatggatgattctactattcagatatataacgttagagtagatgaggttaaaagcaagctgaaaggtcactcaaaaagaataactggtttggccttctcgcattcgttaaatgttctggtctcatctggtgccgatgctcagatatgtgtatggggctcagataactgggaaaagcaaaggtcaaagtttctgcagcttcctgcaggaagggcaccgacagcaccatcagatacacgtgtccaatttcatcaagaccaaatacatttccttgttgtgcatgaaactcagctggcaatttttgaaacaaaacaattagaatgtgttaagcagtgggttccacgtgaatcttctgctccaatctcccatgcaacattttcttgtgatagtcaactggtatacgccagcttcttggatgcaactgtttgtgtgttcagtgctgcaaatctcagactaagatgtcgaattaatccttctgcatatcttccagccaatgtcagtagctctaatgtccatccgcttgtcatcgctgcacatccgcaagaagcaaatcagtttgcggtaggactttcggatggtggtgttcatgtattcgagccacttgaatctgaaggaaaatggggtgtaccccctccaatggaaaatggatcagcaggcagtgggccaactacaccttcagtaggaccatcgggttctgatcaacaacaaagatgatgcatgaagttgcagagcaggagttagttgtttgctggcttattttctatctaggtttaggctctggctatgtatttactcaagttcgattgtgcagttaaggtatatgtatttactcaagttcgtttagagattaaacatgtttgggtcagagcaacatatggtatatacagtaggagtacctattctcaggtgttctcttttgtgttaatgatgaaatatcttttgaagaatcaaaatttttattctctttcttgatttgttttagtttctactctattgtggtgtgtttgctaagttttctcgcttgaccaatttaacaggcagatgctcattcttcagatatatatattccttg

SEQ ID NO: 9218 - DNA, 4292 bp, Chenopodium quinoa
tcacacagacaaacttctctgttctctctcctcttctcaatctcgtccttcttccttatctcacattctcaccgacgacactcttgaagaatacaattgcttagagaaggaattcttctctcaattctgtcggatttctcatcaactcttccgatgatgtcgacctcaatcttcttcctaatggcggcgagtgatctttaattctggaagtatctcaccatgcttatctctctctctttcatacgatccctcactaggttgatgagcttcgaaaacagatcgaggttacacaaaattctggtattgagtgcggcgacggcgcgtgagaagaaaaactttatcagttataattcacccatatttcttatttggggttttacagatctggagaaatttgaggagataacggaatttctgggtggaaaaacgaaagagcagtttaagatgtcatctctaagtagagagcttgttttcctgattttacagtttttagatgaagaaaagtttaaggaaactgttcacaagcttgaacaggaatctgggtttttctttaatatgaagtattttgaggatgaggtgcataatggtaattgggatgaggttgagaggtatctttcggggtttacgaaagttgatgataaccgatactcgatgaagatattctttgaaatccgaaagcaaaagtacttagaggcactggacaagcatgatcgatcgaaggcagtggatatacttgtgaaggatctgaaggtttttgcttcattcaatgaagagttgtttaaggaaattactcaactgttgacattggagaatttcagagagaatgagcagttgtctaaatatggagatacaaaatctgcaagggcaataatgttggttgaactcaagaagctaattgaagccaatcccttgtttcgtgacaaattgcaatttccgaatcttaagaattctaggttgcgaaccctgatcaatcagagcttgaattggcagcatcaactgtgtaaaaaccctaggccgaatccagatatcaagacgctgtttgtggatcactcttgtggacaaccaaatggtgctcgtgctccatcgcctgctaataatcctctattaggctcattgccaaaagcaggaggctttccacctttgggtgcacatgggccttttcagccaacacctgctcaagtgccagcccctcttgctggatggatgtccaatccttctactgtaactcatcccgctgtatctggtggacctattgggcttggtgctccgtcaatgcctgctgcattgaagcatccaaggactcctcctacaaattcttccatggattatccatctggagactctgatcatgttgccaagagaacaagaccgataggaatatctgatgaggttaatcttcctgtgaatgtactgccagtgtcatttcctggccatggtcatactcagccattcaatgcacctgatgatttgcccaaaagtgttgttaggactttgaatcaggggtcttctcctatgagtatggattttcatcctgttcaactgacactacttctggttggcacaaatgtcggagacatagcgttatgggaagttggctcccgtgaaaggctggtcttaagaaactttaaagtttgggagcttagtacgtgctcaatgcctctgcagtcagctctagtcaaagatcctgccgtttctgttaaccgtgtgatttggagccctgatggatccttgtttggggttgcatactcaaggcacattgtacaaatatattcatatcatggtaatgaagatgtacgacaacatttagagattgatgctcatgttggaggagtgaatgatattgccttttctactcctaataaacaactctgtgttatcacgtgtggggatgacaagactattaaagtgtgggatgctgctactggttcaaagcaatatacatttgaaggccatgaggctcctgtttactcggtgtgcccacattataaagaaaacatacagtttattttttcaactgctgtcgatgggaagattaaagcttggttgtatgacaatctgggctctcgcgtcgattatgatgctccaggccgctggtgcacaaccatggcttatagtcaagacgggaccaggcttttttcatgtggtaccagtaaagatggtgagtcacatattgttgaatggaatgagagtgaaggtgctgtgaagcgaacctatcaagggtttcggaaaagatcgctaggtgttgttcagtttgatacgactaagaatcgatatttggctgccggtgatgatttttctattaagttctgggatatggacaatgtgcagctgttgacttccattgatgctgatggaggacttccagcaagtccacgtatccgcttcaacaaagatggtacacttttagcaatctctgcaagtgaaaatggaataaaaattgtggctaattctgatggcctccggcttttacggacatatgaaaatctttcatatgattcctcccgagcatctgagtctttgacaaagccttcaatcaatcccatttctgctgctgccgctgcagcagctgcagctgctactagttctgggctccccgacagaagtgcccctatgatttccatgggtggaatgaatggagatgctagaagcatgggagatgtaaaatcgcgaattcttgaggaaactaatgacaaatcaaagatctggaagctttgtgaaatcagtgaaccagctcagtgtcgttcattgcgactccctgaacacatgagagcagctaagatttctagactgatctatacaaactcaggtaatgctatcttggcattagcttcaaatgcaattcatttgctttggaaatggcagaggaatgaacgtaacgcaagtgggaaggcatcagctaatgttccacctcagctctggcaaccctctagtggtattttgatgacaaatgatatctctgatgcaagtcctgaagaggctgttccttgctttgctttgtccaagaatgattcgtatgtaatgtctgcatccggagggaagatttcccttttcaacatgatgacttttaagacaatgacggtctttatgcctccaccaccagccgcaacatttcttgctttccatcctcaagataacaatataattgctattggcatggatgattctactattcagatatataacgttagagtagatgaggttaaaagtaagctgaaaggtcactcaaaaagaataactggtttggccttctcgcattcgttaaatgttctggtctcatcaggtgccgatgctcagatatgtgtgtggggctcagataactgggaaaagcaaaggtcaaagtttctgcagcttcctgcaggaagggcaccaacagcaccatcagatacacgtgtccaatttcatcaagaccaaatacatttccttgttgtgcatgaaactcagctggcaatttttgaaacaaaacaattagaatgtgtaaagcagtgggttccacgtgaatcttctgctccaatctcccatgcaacattttcttgtgatagtcaactggtatacgccagcttcttggatgcaactgtttgtgtgttcagtgctgcaaatctcagactaagatgtcgaattaatccttctgcatatcttccagccaatgtcagtagctctaatgtccatccgcttgtcatcgctgcacatccgcaagaagcaaatcaatttgcggtaggactttcggatggtggtgttcatgtattcgagccgcttgaatctgaaggaaaatggggtgtaccccctcccatggaaaatggatcagcaggcagtgggccaactacaccttcagtaggaccatcgggttctgatcaacaacaaagatgatgcatgaagttgcagagcaggagttagttgtttgccggcttattttctatctaggtttaggctctggctatgtatttactcaagttcgattgtgcagttaaggtatatgtatttactcaagtccgtttagagattaaacatgtttgggccagagcaacatatggtatatacagtaggagtacctattctcaggtgttctcttttgtgttaatgatgaaatatcttttgaagaatcaaaattttattctctttcttgatttgttttagtttctactgtattgtggtgtgtttgctaagttctctcgtttgaccaatttaacaggcagatgctcattcttcagatatatttattccttgaacctaaaacaataaaacaaatatacttccattttagttgatatgcgaattatatgaatccattattcata

SEQ ID NO: 9219 - DNA, 3934 bp, Sesamum indicum
tatatatacactttagagagagaaatcaaaccccattttctcctcgagctcgtcgtctctctccatccatcgatctttcggaaatctgctactaatttagcttttggattattccggtgggtttgaagaagagttggttggaatgtcatctctcagtagagaactggtcttcttgatcttacagttcctggatgaagaaaagtttaaagagaccgttcacaagcttgaacaagaatctgggttcttctttaacatgaagtattttgaagatgaagtgcacaatgggaactgggaggaggttgaaagatacctctccggtttcacaaaagtggatgacaatcgctactcaatgaagatcttttttgagattaggaagcagaaataccttgaagcactggataagcatgatcgctccaaagctgttgagatccttgtaaaggatcttaaagtgtttgcatcttttaacgaagagctttttaaggagataactcagctgctgacattagagaatttcagggagaatgagcagctatcaaagtatggggataccaaatcggcacgagccattatgttagttgagctgaaaaagcttatcgaggcaaatcccttgtttcgtgataagttgcagttcccaaacctcaagaattcaagactgcggacactcatcaatcaaagcttaaactggcagcatcaactttgtaaaaatcctaggccgaatccagatattaaaactctttttgtcgatcattcctgcggacaacctaatggtgcacgtgcaccttctccagctaacaatcccctgcttggaggagcagtaccaaaacctgggggcttccctcctttgggtgcacacgtgcccttccagcctactccagcacctgttccaacaccactggctggttggatgtctaatccacctactgggactcatccagcagtttctggtggacctataggtcttggtgctccaacaattccagccgccctgaagcatccaaggaccccaccaacgaatccttctgttgattttccatctgctgattctgaacatgctagcaaaagaaccaggccactgggaatttccgatgaggtaaatcttcctgtcaatgttcttcctgtgtcatttcccgggcatgcccatagccagactttcagtgcaccagatgacttgccaaaaacagtagctcggactttgaaccaaggatcatctcctatgagcatggattttcatcccatccaacagactctacttctggtcggtaccaatgtgggagatcttggtttgtgggaagttggttcaagagagaggctggtccagagaaacttcaaagtttgggatctgggttcctgtacaatgcctttacaggctgctctggtgaaagatcctggtgtttctgtgaatcgcgtaatttggagccctgatggatctttgtttggagttgcatattcacggcacctagtacagatcttttcatatcatggaaatgatgatgttcgtcagcatttggagattgatgctcatattggcggagtaaatgatctcgcattctcccaccccaataagcagctttctgtgataacctgtggggatgacaagtttatcaaggtttgggatgccacaactggtaccaaacaatacacttttgaaggtcatgaggcccctgtctattctgtctgtcctcaccacaaagagaatattcagtttatcttttctacagcattggatggaaagattaaggcttggttatatgacaatttgggatctcgagttgactatgatgctcctggtcgttggtgtacgaccatggcctacagtgctgatggcacaaggcttttttcttgtgggactagtaaagatggagagtcacacattgttgaatggaatgaaagtgaaggcgctgtgaagagaacatatcaaggtttccggaaacgatctttaggggtcgtgcagtttgatacgactaaaaataggtttttggcagctggtgatgacttctctgtcaaattctgggacatggacaatactcaacttttgaccagtactgacgctgatggaggtcttccagcaagtccacggatccgcttcaacaaagatgggactctcttggccgtttctgccaatgaaaatggaatcaaaattctagcaaatactgatggtcttcggttactacgcacatttgaaaatctcgcttttgatgcttcaagagcatctgaagctgcaaagcctactgtaaacccaatatctgctgcagctgccagcagtgcaggacttacagaaagggtggcctctgttgttagcatctctgcaatgaatggggatgcaagaaatcttggagatgtaaaaccccgaataacggaagaaactaatgacaaatcaaagatttggaagctcagtgaaattagtgaaccatctcagtgccggtccttgaagctccctgagaatttaagagtaacaaagatatcaagattgatatacacaaactcaggtaatgctatcctggcattagcttcaaatgcaattcatttactctggaaatggcagcgaagtgagcgtaattcaagtggaaaggcaactgctactgttccaccgcaattatggcaaccatcaagtggcattttgatgaccaatgatgtttctgacacaaaccctgaagaagctgttccatgctttgctttgtctaaaaatgactcttatgtaatgtctgcatcggggggaaagatctctttattcaatatgatgacattcaagacaatgacaactttcatgcctccaccaccagcagcaacattcttagcattccatcctcaagataataatataattgcaattggcatggatgattccacaattcagatatataatgttcgagttgatgaggtcaaaagcaagcttaaaggccactcaaaaaggattacaggcctcgcattctcacatgtattgaatgtgcttgtttcatctggagctgatgctcagctctgcgtgtggagttctgatggatgggaaaagcagaaatccagatttttgcaacttccttctgggagatcaccagcagcacagtctgaaacacgtgtacagtttcatcaggaccagattcactttctggttgtacacgaaacgcagctcgcgatatatgaaactacaaagttagaatgtgtaaagcagtgggtacctcgtgaatctgctgccccaatatctcatgcaacattttcatgtgatagccagctggtttatgctagttttctagatgcaactgtgtgcatattcaccgctgcacacctccgtttgcgatgtcgcattaatccttctgcatatctttctccgggagtcagttcaaatgtacatccacttgtgattgcagcacatccacaagaacctaatcaatttgcattaggtctatcagatggttcagttcatgtttttgagccccttgaatcggaaggcaaatggggtgtcccaccaccagccgaaaacggctctacaagcagtgtaccaaccactcctttagttggagcttcagcctcagatcaggcacaaagatgatccaatagtagtctcagaaaccttacatgctctacttgccagctccttgggaatttcggtaatgttggctatctaatattctctatactcactgatgaagactgaatagcttccgttctggaaataagctagcgccccccatcttgttccaggaaactgtggtagaacacctgtacattacatcttctttccgggcattgtgtaacacattcttctctatatttttctggatacatgcagtttttggagctggatatgtaattatctcagacctttggctcaaacatgccaattcactaacagtttgggtgagatgtgatgtaagattaatgtttttagtgagtgttaacagtcaattttccacctttatagagaggaatgtgttacacaatg

SEQ ID NO: 9220 - DNA, 3945 bp, Cajanus cajan
agagagagagagaggacatttcttgaaggagagagaaaggttttgttttggtctctcttgttgtggtgtgctggtgccttctatattcccatgtgcgagctttgaaggcttgagcaggagtctgggtttttctttaacatgaagtattttgaggatgaagtgcacaatggtaattgggatgaggttgagaggtatctctctggttttaccaaagtggatgataataggtattctatgaagatattttttgagataaggaagcagaagtatctggaagcattagataaacatgatcggtccaaggctgtagaaatattagtgaaggatttgaaagtctttgccacatttaatgaagagctgtttaaggaaatcacacagcttttgacattggagaattttagggaaattgtctaagtatggtgacacgaagtctgcaagagcaatcatgttggtcgagctcaaaaagttgattgaggccaatcccttatttcgtgacaaattgcaatttcccaaccttaaaaactcaaggttacggactctcatcaatcaaagcatcaactttgtaagaatccgcggccaaatccagatataaaaactctttttgtggatcactcatgtggacagccaaatggtgcacgggctccatcacctgctaataacccgctactaggatcattaccaaaggccggaggatttcctcctcttggtgcacatgggccttttcaacctactccagcacctgtgccaacacccctggctggctggatgtcaaatccaaccactgtagcacatcctgcagtttctggaggagctataggccttggggcaccatcaatccctgccgctttgaagcatcctaggacccctccaactaatccttctgttgactatccgtctggagattcagatcatgtttctaagagaacaagaccaatgggaataacagatgaggtaaatctgcctgtcaatgtgttgtcggcaacattccctggtcatggtcatggtcagacttttaatgcacctgatgacttgccaaagactgccatgcgaactctgaatcaagggtcatctcctatgagcatggactttcatccagttcaacagacattgcttcttgttggtacgaatgtgggggacattgctttgtgggaagtgggctctagggagcggttactcatgaggaacttcaaagtttgggatcttagtgcttgttcaatgccatttcaggctgctcttgtcaaagatccaggtgtttctgtcaaccgtgtgatttggagtcctgatggggctttattcggtaggttaagagtttttaaattcttaaatatatagatctaagtaatatataatttcagaagtcaactaaatgaataacttatgagttttttttccccttctgctaaacaggaattgcttactcaaggcacattgttcagatatactcttatcatggtggggatgatgttcgacagcatctggagattgatgctcatattggcggagtaaatgacctggcattttcccacccaaataagcaactatgtgtcataacctgtggtgatgataagaccattaaggtttgggatgcggctacgggtgcaaaacagtatacttttgaaggtcatgaggctccagtttattctgtctgcccacattataaagaaaacattcagttcatcttttcaacggcattagatggaaagataaaagcatggttgtatgacaatttggggtctcgtgttgattatgaagctcctggtcgttggtgtacaaccatggcctatagtgctgatggtacaagactcttttcatgtgggacaagtaaggaaggggaatcctctattgttgagtggaatgaaagtgaaggagctgtgaaaagaacttatcaaggtttccggaaacgatctttgggtgttgtacaatttgatacaaccaaaaatcgatatttggctgctggtgatgatttctccatcaaattctgggatatggataatattcagcttttgacaactgttgatgctgatgggggtctccctgcaagcccacgcattcgtttcaacaaggatggagctcttttagctgtttctgcaaatgagaatggaattaaaatattagccaatacagatggtattcgtttgttacggacattagagaattctatatatgatacgtcaagaacttcagaagccatgacaaagcctacaataaatccaattgcagcagcagctgctgctgctgctactgcaactagtgttgcacttgcagagagggcatcatctatggtagctattactggaatgaatggggatgcccgaaacatgggagatgttaaacctagaataagtgaagaatccaatgataagtcaaagatatggaaactcactgaaataaatgaaccatctcaatgtagatccttgaagctacctgagaatgtaagagtgaacaagatatcaaggttgatatatactaactcaggtaatgctattctggcattagcttcaaatgccattcatctgctctggaagtggcagcgtagtgaccgtaattcatctggcaaggccactgccagtgtgctaccccagttgtggcaaccttctagtggcatcctgatgactaatgacatcactgatagcaatactgaggatgccgttccatgctttgctctgtcaaaaaatgattcttatgtaatgtcagcatcaggagggaagatttctctgttcaatatgatgacttttaagacaatgacaacattcatgcctccgccacctgcagcaacttttcttgctttccatcctcaggataacaatattattgctataggcatggatgattcttccattcaaatatataacgtccgtgtagatgaggttaaaagtaaactcaaaggccatactaaaagaataactggtcttgctttttctcatgtattgaatgtgctagtttcatctggagcagatgctcagctttgtgtgtggaatactgatggatgggaaaagcagaagtcaagattcttgcaacttcctgcagggagaactccaccagcacaggcagacacccgtgtacagtttcatcaggatcagatccgcttcttggttgtacatgaaactcagcttgccatttatgaagcaacaaaactagaatgtttaaagcagtggttcccacgggattctgcggcaccaatatcgcatgcaactttctcgtgtgatagccaacttgtatatgccagttttttagatgcgaccgtctgtgtatttagcgcttcaaaccttagattacgctgtcgaatcaatccttctgcttatctttctgctagtgtcagttctaacgtacaacctcttgttattactgcacatcctcaagaaccaaatcagtttgctgtaggactgtcagatggtggagttcatgtttttgagccccttgagtctgaaggcaaatggggtgtgcctccacccattgagaatggatcaacaagcaatatagcagctacttcagttggagcttcttcagatgaagcacagagatgatccatgtcagccaaagacaagtttcttttacacatacttggcttgctggccatttcaagaactaggtatgtacttaagataatgcatccagggcactctccgaattagttcatccattgtgaagtctggcctttgtgcacagtcacacaccagaacaatggacaaaaaaccaaaagttaaaccttgtaattgccaaaatatgtgaaaatttcttgcaggtctaatgctacaggtgtagaagttctctaaagtttaaagtttttctgcctttttatttagattggtttatcctaacttctcttttgtaatctttggagactctaaatgtaacttactaggataatattgtcttcaccgcttacattttatttatatatgaatatataatttttttttgttgaatggtgtagtttgtggttca

SEQ ID NO: 9221 - DNA, 3782 bp, Panax ginseng
tatatgtcggtgcatgctcaaactacatgatgatgatcttctttgaattgggcgttctgttttgaagatcagtttcttaatgatctatttctggatttgaagacctattggatacaatgtcatctctcagtagagagcttgtgttccttatcttacagtttctagacgaggaaaaattcaaggagtctgttcacaagcttgaacaggaatccggttttttctttaacatgaagtactttgaggaagaagtgcataatgggaactgggatgaggttgagaaatacctctctggtttcacaaaagtggacgacaatcggtattccatgaagatcttttttgagattaggaagcagaagtatcttgaggcattggataagaatgatcgatccaaggctgtggaaatcctcgtgaaggatcttaaagttttttcatcatttaatgaagggctttttaatgaaattactcagctcttaacattggagaatttcagggagaatgaacagctatccaaatacggagatacaaaatctgcaagagctattatgttggttgaactcaagaagcttatcgaagcaaatcccttgttccgtgacaaattgcaatttcctaatcttaaaaattcgaggttacgtactctcatcaaccaaagcttgaattggcagcatcaactttgtaaaaacccaaggccaaatccagatatcaaaactcttttgtggatcattcatgtgcacaaccaaatggtgcacgtgctccatcacctgcaataatccactgcttggatccttgccaaaagctggagtttttcctccgctgggtgcacatgggcccttccaacctacaggagctccagttccaactcctcttgctgggtggatgtcaaatccatctactgttactcatcctccagtttctggtggagctattggtcttggtggtccatccatgccagctgctttgaagcatcctaggacgccgccagcaaacccttctttagattacccatctggagattcagatcatgtaaccaaaagaacaaggcccatgggcatatctgatgaggtaaatcttccgataaatgtgttgcctgtgtcattcccggggcatactcatagtcaggctttcaatgcacctgatgacctgcccaaaagtgttgcacgaactttgaatcagggttcatctcctatgagtatggattttcacccaattcaacagactttacttttagttggtaccaatgttggggatataggattgtgggaaattggttccagggagagattggttcttagaaacttcaaagtttgggatcttggcgcatgttcaatgcctctgcaggctgctctagttaaagatcccggtgtctctgttaaccgtgtgatttggagccccgatggttctttgtttggagttgcatattcaagacacattgtacaaatatattcttatcacaggggcgatgatttaaggcagcatttggagtttgatgctcatattggaggagtaaatgatcttgcattctctcatccaaataagcagctatgtgtgataacctgtggggacgacaagaccattaaggtttgggatgccacaactggtgcaaaacaatacacttttgaaggtcatgaagctcctgtctattctgtatgccctcactataaagaaaacattcagtttatattttcaacggctctagatggaaagataaaagcatggttatacgacaatttgggatctcgagttgattatgatgctcctggtcggtggtgcacaacaatggcgtacagcgctgatggaacaaggcttttttcatgtgggaccagcaaagatggggagtcacacatcgtagaatggaatgaaagtgaaggggctgtgaaaaggacatatttaggcttccggaaacgttctttaggtgtagtgcaattcgatacaactaaaaaccgatttttagcagctggtgatgaattttctattaaattctgggatatggacaatgttcaacttttgacgagtattgatggtgatggaggccttccagcaagtccacgtatccgcttcaacaaggatggctcgcttttggcagtctctaccaatgaaaatggaatcaaaattttagcgaattctgacggtcttcgattgctacgcacatttgaaaatcaatcttatgatgcttcaagggctcctgagactgtgaaggtggctgacttggaaaacttgattcttgcacccctacataatggagattccagaaatttgggggacattaagccgagaataactgaagaatccaatgacaaatcaaagatttggaaacttgcagaggttaatgagacttctcagtgccggtcaatgaagctccctgaaaacatgagagtaactaagatatcaaggctgatatataccaactccggtaatgctatattggcattagcatcaaatgcaattcatcttctgtggaaatggcagagaagtgatagaaattcaagtggcaaggctacagccagtgtctcacctcaattatggcaaccatcaagcggcattctaatgaccaatgacgtgactgacaccaacccagaggatgctgtgccatgctttgcattgtccaaaaatgattcttatgtgatgtcagcatcaggaggaaagatatctttattcaacatgatgactttcaagacaatgacaacattcatgcccccgccacctgcagcaacatttcttgcatttcatcctcaagacaacaatatcattgctattggcatggatgattcctcaattcagatatataatgttcgtgtggatgaggtcaaaagcaagcttaaaggccactctaagagaatcaccggccttgccttctctcatgtactgaatgtgctagtttcttctggagcagatgctcagctttgtgtttggagttctgatggatgggaaaagcaaaagaccagatacttgcaagttccagccgggaggacttcaacagctcagtccgacactagggtacaatttcatcaggaccagatccactttctggttgtacatgagactcagcttgccatatatgacgcaacaaaactagaatgtgtaaagcagtgggtccctcgagaatctgctgcccctatttctcatgcaacattttcgtgcgatagtcagctggtatatgccagtttcttggatgcaagtttgtgtgtatttactgctgcacacctccgtctccgatgtcgtatcagtcctatggcttatctgtcacctagtgtcagcaattcaaatatccatccactagtgattgctgcacatccacaagaaccaaatcagtttgcattgggtctatcagatggaggagtacatgtccttgaaccacttgaatctgaaggtaaatggggtttacctccaccagtcgaaaatgggtcagcaagcagtgtcccagcgacaccttcagttggagcttcaggctcagatcaagcccagagatgatatgaaaggttgccagagcacaagttctttaaatgctttgcttgctgggaaattcgaaatgtttgagaacaggctatgtaatttgctcagtgaatgacttgcagacatgtagatctaacacgttaattaagatattacggaaggtaaatgcttttaagtactaaatagtgaagtgttctctttgtttctttctcgcaggaagaaatttgttctcggaaatagatcttttctctctgtatttcttcagttgttagaatcactgctgctatctgaacaaaaatgccttttagctgaaagtttggtatttaaatttcttc

SEQ ID NO: 9222 - DNA, 3995 bp, Valeriana officinalis
tagtaaagtctagtagtattgtaagtaaggtactattattatttagagtattttgagattgagatatagatagagatagagagagcggcgaccagagaaaccatttctacctcgagctcgtcgttatctacttctgtgtttctgtgagctgtgtttattgtattttgtgctgtgctgtgctgtgctgtgttgtgttatctcttcaaatcgatttttctgcttcgttttaggatctgcttgtatacagagtgattgcctttcttctggatttgaagacggcatagttacaatgtcatctctcagcagagagctggtgttcttaatcttacagttccttgatgaggagaaatttaaagagacggttcacaagcttgagcaagaatcagggtttttctttaacatgaagtactttgaagaagaagtgcataatgggaattgggatgaggtggagaggtacctttctggtttcacaaaggttgatgacaataggtattctatgaagatcttcttcgaaataaggaaacaaaaatacctcgaggcgttggataagcatgataggtcgaaggctgtagagatcctggttaaggatcttaaagtattttcttcatttaatgaagagcttttcaaagagataacccagctgttgacattggagaattttagggagaatgagcagctgtccaaatatggagatacgaaatcggcaagggcaattatgttggttgagctcaagaaacttatcgaagcaaatcctttgtttcgtgacaaattgcagtttcctagcctaaagaattctaggttgcgaactctcatcaatcaaagcttaaattggcaacaccagctttgtaaaaaccctaggccgaatccagatataaaaacactttttgtagaccatctgtgtggacagccaaacggtgcacgtgctccatcacctgcaaataatcctctgctcggatccttaccaaaagctggagtgtttcctcctctgggtgcacatgggcctttccaacctacgcaagcgccggttccaactcctctggctggttggatgtcaaatcctccggctgtaactcatccggctgtatctggtggacctataggtcttggcggtccttccattactgctgctttaaagcaccctagaactccgtcgacaaatccatctctagattatccttctggtgattcagatcatgtgaccaaaagaacgagagctatggggataactgatgaggtaaatcttcccgttaatgtgatgcctgtgtcattccctggagggcatggtggtcatactcaagcttttgttgcaccagatgacttgccgaagactgtagcaagaactttgaatcagggctcatctgcgatgagcatggattttcatcccgttcaacaaactttgcttctagttggtacaaatgtgggtgatattggattgtgggaagttggttctagggagagattggttcttaaaaacttcaaagtttgggatctcagtgcatgctccatgcctctgcaggctgctctagtcaaagatccgggtgtatctgttaaccgtgtaatttggagcccagatggttccttgtttggtgttgcatattcgaggcatattgtgcaagtatattcttatcacggcagtgatgatgttcgccaacatttagagattgatgctcatattggtggagttaatgatctcgccttctctcaccccaataaacagttatgtgtgattacttgtggggatgacaaaaccattaaagtttgggatgcgaatactggtacgagacagtatacttttgaaggtcacgaggctcccgtgtactctgtatgtccacactacaaagaaaacatccagttcatattctcaacagctctagacggaaagattaaggcgtggctatatgacaatttaggatctagagttgattatgatgctcctggtcgatggtgcacaacgatggcttacagtgctgacggaataaggctgttttcatgcggcactagcaaagatggggaatcgcatattgtggaatggaatgaaagtgaaggggctgtgaaaaggacatatcaaggattccgcaaacgttctttgggtgttgtgcaatttgatactactaaaaaccggtttttggcagctggtgatgatttttccataaaattttgggatatggataatgttcaacttctgacgagtattgatgctgacggcggtcttccagcaagcccgcgtattcgcttcaacaaggatggtgctctcttggcagtttccgccaatgagaatggaatcaaaatcttggcgaattctgacggtcttcgattgctacgtacatatgaaaacctttcttatgattcttcgagagctcctcccgaaagttcgaagcctgggttgcaccaccctatgtctgctgctgctgctgctgctgcaacttctgccggacttgctgacaaggctgccgccgccgcttctgctgccgcagcgaacggagatgccagaaacatgggggatgttaaacctaggttagttgaggaatcaaatgacaaatccaagatttggaagcttaccgaaattgccgaaccttctcagtgtcgatcacttaaactacctgaaaacacgagaatgaacaaggtatcaaggttgatctatacaaattcagggaatgctattttggcattagcctcaaatgctattcatttactatggaaatggcaacgaggggaacgtaattcaactggaaaggcaacagcaaatgttctacctcaattatggcaaccgtcgagtggcatcataatgacaaatgacacaaccgagactaaccccgaggaggctgtagcgtgctttgctttgtctaaaaatgattcatacgtaatgtcagcttctggaggcaagatctctttatttaacatgatgaccttcaagacaatgacaacattcatgcctccaccacctgctgcaacttttcttgcattccatcctcaagacaataatatcattgctatcggtatggatgactctacgattcagatatataacgtccgcgttgacgaggtgaaaagcaagcttaagggtcactctaaaagaattaccggtcttgccttttctcatgtattgaatgtcctagtgtcttctggggctgatgctcagctgtgcgtgtggagttcgaatgaatgggaaaagctaaaagctagatatttgcaagtaccagcaggaaggacaccaacatcgtcagtgtcagatactcgagtacaatttcatcaagaccagatccacttccttgtcgtacacgagactcagcttgctatatacgaaacaactaaactagagtgtgtaaagcagtgggtcccgcgcgaaaatgccgccccaattgctcatgcaaccttctcgtgcgatagccagctggtgtacgccagtttcttagatgcaactctctgcgtattcactgcttctcaccttcgacttcgatgtcgtattaatcctttagcttatctctcacctaacgtcagcaattcgaatgtacaaccagtagtgatagctgcacaccctcaagaagcaaaccagtttgctatagggttatcagatggcggggtccacatatttgagccgctcgaatcagaaggcaaatggggcgtacctcctccagccgaaaatggatctggaagcagcatgcccaacacaccaaatgctgccgccggaggaacttcaggctcggatcaacctcagagatgataattgtcagattataatctgtgtttttctttggttttggccgatttctaatctaggtgtgtttctcctgaatgatggttgtttttggaaccgttaatgaaatgtaggtgtttttatgcggtgcagttgtggaggaactagtagagtagagattgtatatggtctaacatatcgagtaaggtagatggtgtattattagagtatttgtttgtcgtcgaaattgaggtggtagatcttatcagatgggaaaatcattttcagtcctcatccaata

SEQ ID NO: 9223 - DNA, 3882 bp, Mimulus guttatus
agatctgctgctatatttgcttttgaaatattccctttgtgggtttgaaaggagaggagttcttcggaatgtcttctctcagtagagaactcgtgttcttgatcttacagttcctcgatgaagagaagttcaaagagaccgttcacaagctcgagcaagaatctggattcttcttcaatatgaagtatttcgaagatgaagtgcacaatgggaactgggaggaggtagaaaagtacctctcgggtttcactaaagtggacgacaatcgctactcgatgaagatcttttttgaaattcggaagcaaaagtacctcgaagcattggacaagcacgaccggtcgaaagcggtcgacatcctagtaaaggatcttaaagtgtttgcgtcttttaacgaagacctttttaaggagataactcagctcttgacattagagaatttcagggaaaacgagcagctatcgaaatacggagatacgaaatccgcacgagccattatgcttgtggaactaaagaagctaattgaggcaaaccctttatttcgggacaagttacagttcccaaatctcaagaattcgaggctgcgtacactcatcaatcaaagcttaaactggcagcaccaactatgtaaaaatccgaggccaaatccagatattaaaacccttttcgtggatcattcgtgcggccaacaaaacggtgcacgtgcaccctctccggcgaataatcccttgcttggaggtccagtgcaaaagccaggtggcttccctccattgggtgcacatccatttcagcctgctccagcacctgtaccagcaccgctagctggttggatgtccaatccaccgaccgccactcatgcggcggtttccggtgcaccgttaggtcttggtggacctgcaatgcctggtcgagaattcaatatatctgctcttaagcatccgaggactccaccgaccaatgcttctgttgattttccgtccggtgattctgaacatgcgagtaaaagaactaggcctttggggcttaccgacgaggtgaatctacctgtgaatgttatgccggtatcttttcccgcgcatgcacatagccagagttttaatgcaccggatgatttgcctaagacagttggaagggttttgaaccaagggtcttcgcccatgagcatggattttcatcctattcaacagactcttcttctcgttggcacgaatgttggagatattggactgtgggaagtcggttcgagagaaagacttgttcagaggaacttcaaagtctgggatttgagcgcgtgtactatgcctttacaggctggtctggtgaaagatcctggtgtttctgttaatcgcgtcatttggagccccgatggatctttgtttggtgttgcatattcaagacacctcatacagatttattcatatcatggtaacgacgatgttcgtcagcacttggagattgatgctcatgttggaggagtaaacgatcttgcattctcccaccccaataagcagctctctgtgattacctgtggagatgacaagcttatcaaggtttgggatgccacaaccggtaccaaacaatacactttcgaaggtcacgaggcccctgtttactcagtctgccctcatcacaaagagaatattcagtttatattttcaacagcattagacggaaagattaaggcatggctgtacgacaatttagggtctcgagttgactatgatgcccctggtcgatggtgcactaccatggcctacagtgccgatggaacacggcttttctcttgtgggacaagtaaagacggagagtcgcacattgttgagtggaacgaaagtgaaggagcggtgaagagaacttatcaagggtttagaaaaagatctttaggtgttgtccaattcgatacgactaagaataggtttttggcagctggcgatgatttttcgattaaattctgggatatggacaacactcagcttttgaccagtagtgaggctgatggtggtcttcctgcgagcccacgtattcggttcaataaagatggaagcctattggctatttccgctaatgagaatggaatcaaagttttggcgaacaacgatggtcttaggttacttcgcacgtttgagaatattgctttcgatgcttcgagaacatctgaggctgcaaagcctactgtaaacccaatatctgccagtgtagcaagtagtgcaggacttacagacagggtgccgtcttctgttggaatctctgctatgaacggagatacaagaaatcttggagatgtaaaaccaagaataatagaagaaactaatgataaatcgaagatttggaagctcagtgaaattaacgaaccatctcagtgccggtccttgaagctcccggagaatctaagagtaacaaagatatcgagactgatatatacaaactcaggcaatgctatactcgcattagcttcaaacgcagtccatttactctggaaatggcaacgaagcgaccgtaactcaaacgggaaggcaaccgctactgtttcgcctcaactgtggcaaccgtcgagcggcattttgatgacaaatgacgtagccgacacaagtcccgaggaagctgtcccttgctttgctttgtccaaaaacgactcgtacgtgatgtcagcatccggaggaaagatctctctcttcaatatgatgacattcaagacaatgacgactttcatgcctcctccaccggcggcaacgttcttagccttccaccctcaagataataatataatcgcaatcggaatggatgattccactattcaaatatataacgttcgagtagatgaggtaaaaagcaagcttaaagggcactctaaaagaataacgggccttgctttctcacatgtgttgaatgtgctcgtttcgtcgggagctgatgctcagctttgtgtatggaattcggatgggtgggagaagcagaaatcgagattcttgcaactaccttccggaaggtcgccaggggcacaatcggaaactcgagtacagttccatcaggaccagcttcactttttggtcgtacacgagacacaacttgctatatacgaaacaacaaagttagaatgtgtaaagcagtgggccccacgagaatctactgctccgatatcccacgcgacattctcgtgtgatagccagctggtttatgctagtttcttagattcgactgtgtgtgtattcacagctgcgcagcttcgtttgcggtgccgtatcaatccgtcagcttatctctcaccgaatatcagttcaaatgtgcacccgctcgtaattgctgcacacccgcaagaaccaaatcaatttgcattgggtttatcagacggttcggttcatgttttcgaaccgctggaatccgaaggcaaatggggcctaacgccacctgtagaaaacgggtcgtcgagcaatgctccgtcatccgctccagctggtggcgggtcgggttcggatcagcctcaaagatgatgcccaccatttgataatatctaacgttttctttaatttaattctatgctggttcgatataaaagacgaaacgaaatagctgctctcgaggaaaatatattagagtctctcttcctccccgaatttatgaaaggaaaactttgtgtcgaaaacacgtgtaaattattatgactggcattttgttccccacatattcttatttgtatctgtctttggatatgtaattaactcaggctaagttcactggcagtttgggtggtgtaagatgaaatgcttgtaggagtttttatttatttatttattagacgattaattcattttactttgggcttattgcaagtactcgtaaattaaatatttagtgattattgttacatggtaatatttgtcatgatga

SEQ ID NO: 9224 - DNA, 4458 bp, Cicer arietinum
aattaaacaatccaacgctcaaattcaaactactaagctaggtacggcaccacaatgatctgaccaatcttctagtcatacccacgagccgatagatagattccgagccggttcttaaaacaaaaaatgaagctggctcagtgggctccacacttagatataagcttattcacttatctgatagcttatgttaacaagcagaagttcttatcgataagtaaactaacttatagtctcccttccctgtctcctcctatataaaataattcatccatgtatatatagatatagagagagaaagagagaaacatttgcacaaggagagagaaaggtttggtcttgttgttattgtggtgttgaagtggttgctgttgtgttccatattcacatgtttgagccttcgaagatctagtttagcttttgctcattttgattttaatctgatccaagacaaagagggttaccatgtcatctctcagcagagagttggtgttcttgatcttgcagtttctggatgaggaaaagttcaaagagactgttcataagcttgagcaggagtcagggtttttctttaacatgaagtattttgaagatgaagtgcacaatggaaattgggatgaggttgaaaagtacctatctggtttcactaaagtagatgataatagatattctatgaagatatttttcgagataaggaagcagaagtatctagaagcgttagacaagcacgatcggtccaagggtgtagaaatattagtgaaggatttgaaagtctttgccacatttaatgaagaattgttcaaggaaatcacacagcttttgacactcgagaattttagggaaaatgaacaattgtccaagtatggcgatacaaagtctgcaagagcaatcatgttggttgagctcaaaaagttgattgaggcaaatcctctatttcgtgacaaattgcaatttcccaaccttaaaaactcaaggttgcggactctcatcaatcaaagcttgaattggcagcaccaactttgtaagaatccacgaccaaatccagatataaaaactctttttgtggatcactcttgtggacaaccaaatggtgcacgagctccatctcctgctaatattccattactaggatccttaccaaaagccggaggatttccccctctcggtgcacatgggccttttcaaccaactccggcacctgtgccgatgcccctggctggttggatgtcaaatcctactactgtggctcatgcctctgtttctggaggaggagctataggtcttggtgttggtatcggtgcaccgtctataccagctgctttgaagcaccctaggacacctccaactaatccttctgtcgactacccatctggggattcagatcacgtttctaagagaacaagaccaataggaatgtccgatgaggcaaatctaccggtcaatgttttgtcagcgacgtttccgggtcatggtcatggtcaggcttttaattcacctgaggacttgccaaagactgtcttgcggactctaaaccaaggctcgtctcctgtgagcatggacttccatccagttcaacagactttacttcttgttggtacgaatgtggcggacattggtttatgggaattgggctctagggagcggttggtcttgaggaacttcaaagtttgggatctgagtgcttgttcaatgccatttcaggctgctcttgtcaaggatccagctgtttctgtcaaccgtgtgacttggagtcctgatggggctttgttcggagttgcttactcaaggcacattgttcagatatactcttaccatggtgcagatgaagtacgacagcacttggagattgatgctcatgtcggcggagtaaatgatctagcattttctcacccaaataagcagctatgtgttatcacctgtggtgatgataagaccattaaggtgtgggatgctgctacgggtataaagcagtacacttttgaaggtcatgaggcccccgtttattccgtctgtccacattataaagaaaacattcagttcatcttttcaacggcattagacggaaagataaaagcatggttgtatgacaatttgggatctcgtgttgattatgatgctcctggtcggtggtgtacaaccatggcatatagtgctgatggtacaaggctcttttcatgtgggactagcaaggacggggaatcctctattgttgagtggaatgaaagtgaaggagctgtgaaaaggacttatcaaggatttcggaaacgatcattgggtgtcgtacaattcgacacaaccaaaaacagatcattgggtgtcgtgcaattcgatacaaccaaaaacagatatctggctgctggcgatgatttctccattaaattttgggatatggataatattcagcttttgacaactgtggatgctgatggaggtctccctgcaagccctcgtatccgtttcaataaggatggatctcttttagctgtctcagcaaatgagaatggaattaaaatcttagctaatggagatggcattcgtttgttgcgatcgttagagaattccttatatgaagcatcaagaacgtcagaagccatgacaaagcctacaataaatccaatgtcagttgctacttctgcaactagtgctgcacttgcggagagagcctcatctgtggcagcgattgctggaatgaatggggatgctcggaacttaggtgatattaaacctagaataagtgaagaatctaatgacaagtcaaagatatggaagctcactgaaatcaatgagccatctcaatgtagatcgttgaagctacctgagaatgttagagtaaccaagatatcaaggttgatatatactaattcaggtaatgctattctagcattaggttcaaatgccattcatcttctctggaaatggcaacgaaacgatcgcaattcatctgggaaggccactgctagtgtcccgcctcagttgtggcaaccttcaagtggcatcttgatgactaatgacattaatgatagcaatactgaggatgcagtcccatgctttgctctgtccaaaaatgattcttacgtaatgtcagcatcgggtggaaagatttctctgttcaatatgatgacttttaagacaatgacaacgttcatgccaccaccacctgcagcaacctttctggctttccatcctcaggataacaatattattgctataggcatggacgattcttctattcagatatataatgtccgcatagatgaggttagaagtaaactcaaaggccatactaaaagaataactggtctcgccttttctcatgtactgaatgtattagtttcatctggggcagatgctcagatttgtgtatggaatacagatggatgggagaaacagaagactcgattcttgcaatttcctcccgggcggactccaccagcacaggcagatacacgagtacaatttcatcaggatcagttccgcttcttggttgtacatgaaacacagcttgccatttatgaagcaacaaaactagaatgtttaaagcagtggttcccacgagattccgctgcaccaatatcacatgcaactttctcatgtgatagccagctggtatttgccagctttttagatgcaacagtctgtgtatttagtgcttcaaaccttcgattacgatgccgtatcaatccttctgcttatctttccgcaaatgtcaggtaattcttgttttatattaaaaactcgaaacttttatgtaattatacttcttgttgaacactaactaggttgttctttatgtagcagttctaatgttcactcacttgtaattgcggcacatccacaagaaccaaatcagtttgctgttggactgtcagatggtatagttcatgtgtttgagccccttgagtctgaaggcaagtggggtgtgcctccacccattgagaatggttcaacgagcaatgcggtagctgctccagttggtgcttcttccgacgaaccccaaagatgatccatgtcagccttagacaagtttcttttacatactttggcttgctggcgccatcacaagataatgcagggcacttgccaaaggttgattcagctactctctagatccaccgtgttatcttggccgtgtgcacaatcatgttccgagccgcaacgcaaccgaaaaccaaaatcaagaccaacttatgtgtaaatttcttgtgtttaatgatacagatgtagaagttcttaagagtactttcaagcttttcctggctatttatttagattggtttattgtcttaactttttcctatgtagtatttagatttatttaatctgcatgtaatgtaactatggtaatcagtaatcatgctttactcgccagacatttataaatatgtaaattttttgaatggcgcagtttgtgattcatgacatgcagtcagtacttactaatataaagaatgaatggga

SEQ ID NO: 9225 - DNA, 4004 bp, Plantago ovata
cggccgggggttttattctcccttccatactcccctagtaaatttagagagagaaagtttagagagagagagaaatgagaaaaaccctctgtgtttataggaaatagacgccgatttgggaaaattgtagagaaaaggggactccatttctggtttggagctattcctttttcttctcgccgccgagtcatcgatctgcacaaatctgtagctatttgaggtttactcacactcccgagggctggaaggggatttagtaaacatgtcgtctctcagtagagaacttgtctttctgatcttgcagtttctggatgaggagaagtttaaagagactgttcacaagcttgagcaagaatctggcttcttctttaacatgaaatactttgaggatgaagtgcacaatggtaattgggaggaagttggaagatacctatctggttttactaaggtggacgataatcgctattccatgaagatattttttgagattaggaagcagaagtaccttgaagcattggacaagcatgaccggtccaaagctgtggaaatccttgtaaaggatcttaaagtgtttgcatcttttaacgaagagctctttaaggagataactcagctgttgacattggagaatttcagggagaatgaacagctctcgaagtatggtgatacaaaatctgcacgagctattatgttggtggagctcaaaaagcttattgaggcaaaccccttgttccgtgacaagttgcaattcccaaacctcaagaattcaaggctgcgaacacttatcaatcaaagcttaaactggcagcaccaattatgtaaaaatcctaggccaaaccctgatattaaaactctctttgtggatcattcatgcggacaaccaaatggtgcacgtgctccttctcctgcgaataatcccctgcttggaggagctgttccaaagcctggaggcttccctcctctgggtgcacatgtgccatttcagcaaacgccatctcctgtgccagcccctctggctggttggatgtctaatccgcctactggtgctcatccaggtgcttccagtggtcccataagccttggcgctccatcaatttctgctgctcttaagcatcccagaactccacctacaaatccatctgttgattttccgtctggtgattctgatcatgtaagcaaagaaccaggcaattgggaatttctgatgaggtgagtcttcctgtgaatgttctgcctgtatcttatcctggacatgcacatagccagaatgctttcggtccaccggttgacctgcacaagactgtagcccggactttgaaccagggatcatctcctatgagcatggacttccatcctgtgcaacaaactctgctcttagttggcacaaatgttggtgatattggtttgtgggaagttggttctcgtgagagattggtccagaagaacttcaaagtttgggatctgagcgcatgtacgatgcctttacaggctagtttggtgaaagatcctgcggtgtctgttaatcgtgtgatttggagcccagacgggtctttgtttggagttgcatattcaagacatcttgtacaaatctactcgtatcatggaaatgatgatgttcgccagcatttggagtttgatgctcatgtaggtggagtaaatgatctcgcattctctcaccctaataagcagctttctgttataacctgtggtgatgacaagcttatcaaggtttgggatgccacaactggaaccaaacagtacacttttgaaggtcatgaggccccagtatactcgatctgccctcaccataaggagaacattcagtttatcttttctacagcattagatggaaagatcaaggcatggttatatgacaatttgggatctagagttgattatgatgcccctggtcgttggtgtacaaccatggcatacagtgctgatggaacaaggcttttctcttgtggaacgagtaaagagggagagtcgcacattgttgaatggaatgaaagcgaaggagctgtaaaaagaacatatcaaggattccgtaaacgatccctgggggttgtgcagtttgatacaacaaaaaacagattcttggctgctggtgatgactttgctattaaattctgggacatggacaacattcaacttttgacttccattgatgctgacggaggtcttcctgcaagcccaagaatccgcttcaacaaggatggtagcctgttggctgtttctgcaaatgaaaatggaatcaaaatcttagctaataccgatgggcttcgatcgttacgcacatttgagaatctttctttcgatgcttcaagagcctccgaggcaccaaagcctactgtaaacccgattactgcagcggcagctgcagcagcagcgagtagtgctgggctagctgacagggtgggccctgttggcatctctgcaatgaatggagatacaagaaatcttgatgtgaaacctagaataacggaagaggctaacgacaagtcgaaggtttggaaactcagcgaaattagtgagccatctcagtgccgaaccctgaagctccctgagaatttacgtgtgacaaagatatcaagattgatatatacaaattcaggtaatgctatactagcattagcttcaaatgctatccatttactgtggaaatggcagcggagtgaccgtaattcaagtggaaaggcgactgctactgtttcacctcagctatggcaaccatcaagtggcattatgatgactaatgatgttacagaaacaaaccccgaggattctgttccatgctttgctttatccaaaaatgattcgtatgtaatgtcagcttctggagggaaaatctctctatttaatatgatgacgttcaagacaatgacaactttcatgcctcctccgcccgcagcaacattcttagccttccaccctcaagataataatataattgcgattggcatggatgattccacaattcagatatacaatgttcgtgtagatgaggtgaaaagcaagctcaaaggacatagtaagagaattactggtcttgcattctcgcacgtgctgaatgtgttggtttcatctggagcagatgcacagctttgcgtatggcattccgagaattgggaaaaacagagatcgaggtttttgcaacttccttctgggagatcaccaggagcacaatctgagacgcgcgtacagttccaccaggaccaaatgcatttcctagttgtacatgagacacagcttgccatatatgaaactacaaagctggaatgcgttaagcagtgggcacgcgaatctggcgcccctatttcccatgcaacattttcatgtgacagccagttggtctatgctagttttctcgatgcaaccgtgtgtatattcactgcatcacacctgcgcttgcgatgccgtattaatcctgctgcatatatttctccaagtgtcagcaattcaaatgtgcacccgcttgtgattgctgcacatccgcaagaaccgaatcagtttgccttgggactttcagatggttcagttcatgtctttgaaccccttgaatccgaagcgaagtggggtgtgccaccacccactgagaatggttcttcaaacagcgtaccaaccacccctttggtcggagcttcagggtcggatcagccacaaagatgatcctgtgactgaaactacttcacttccaggctcgttggaaatttagctggaagctggatatgtaattaacttggaaactctgactcagatctggtgttcactaacagcttggataaaacgtgatgatgtatgtaaacgttgtaggcagtgtttgacaatcagttttccagaaagtggacctttttgaactttccgactgaagctttatctcttatctgtggcacttggtttagttatggattttattctgggctttatgtatgaaaatctaagacctgttgcttgctagatgatatttcgtccatcgttgcacaagttaatagtagatgagattt

SEQ ID NO: 9226 - DNA, 3335 bp, Flaveria ramosissima
ttcacaaacttgaacaagaatcagggtttttctttaatatgaagtattttgaagatgaagttcataatgggaattgggatgaagttgagaaatacctttctgggttcactaaagtggatgataatcggtattcgatgaagatattctttgaaattcgaaaacagaagtatcttgaagcattggataagcatgatcgatccaaagccgtggagattctagtgaaggatcttaaagtgtttgcatcatttaatgaggagttgtttaaagagattactcaattattgactttggagaattttagggaaaatgagcaactgtctaaatatggagatactaaatcagcaagagctataatgttggttgagctcaagaagcttatcgaagcaaatcccttgtttcgcgacaaattgcagtttcctaatctcaagaactcgaggcttcggactcttataaaccaaagcttgaattggcaacaccaactttgtaaaacacctaggccaaatccagatatcaaaactctgtttgtagaccattcatgtgggcaaccaaacaatgcacgcgctccatcacctgcgaataatccacttcttggatctttaccgaaagctggaggctttcctcctttaggggcgcacgggccatttcaacctacacaagctcaagttccaacgccccttgcgggatggatgtctaatccacctgcagtagctcacccagcggtttctggtagtgcaatcgggcttggtgggccgtctattcctgctgcattaaagcatccacggaccccaccaacgaacccttctttggatttcccgtctggtgattctgatcatgtgagcaaaagaacaagggccatgggcttaacagatgaggtcaaccttccagtcaacgttttgcccgtgtcattcccggggcatagtggtcatagtcaagcttttaacccatccgatgacctgccgaaaaccgttgcacgaaatttgaaccagggttcatctcctatgagcatggattttcatcctatacaacaaacattactcttagttggaacaaatgttggggacattggattgtgggaagtcggttcgagagataaacttgttcttaaaaacttcaaagtttgggatcttagttcatgttcaatgtctttgcaggctgctctcgtaaaagatcccggagtgtctgtaaagcgtgtaatttggagtccagatggttcattgtttggagttgcctattcaaggcacattgtacaaatatattcatatcatggaagtgatgatgtgagacaacatatagagattgatgctcatgttggtggagtaaatgatcttgcgttctctagtccgaataagcaactttgtgtgattacttgtggtgatgataagaccatcaaggtttgggatgcagcaacgggtgcaaaacagtacacttttgaaggtcatgatgctcctgtttactcagtatgccctcactacaaagaaaacattcagttcatattttcaacggctcttgatgggaaaataaaagcgtggttatatgataacatgggttcgcgggttgattatgaggctccgggtcgttggtgcacaacaatggcatatagtgctgacggaacaaggcttttttcatgcgggacgagcaaagaaggggagtcacacatagtagaatggaacgaaagtgaaggagctgtaaaaagaacatatattggattccgtaaacgatctttaggcgttgtgcaatttgatacaactaaaaaccgctttttggcagctggtgatgatttcgctattaaatattgggatatggataatgttcaacttttaacaagtgttgatgctgatggtggtcttccggcgagcccacgtatccgatttaacaaagatggtactttattggctgtttctgctaatgaaaatggaataaaaatattagccaattcggatggtcttcggttactaagaacttttgaaaatctttcttacgatgctgctggaagagctgaaccgtcaaagcccgccttaaacacaataacggctgctgttgctgctagcggggctgcactagcagatagggtggcatctgttggttctatatcaggaatgaatggagatagcagaagcatggtagatgtgaaaccaagaatcaccgaagaaacaaatgacaagtcaaaggtttggaaactcactgaaataagtgaatcttcacagtgtcgatcactgaaacttccagaaaacatgagagtaacaaagatatcaagattaatatatacaaattcaggaaatgctattttggcattagcatcaaatgctattcatctgttgtggaaatggcaacgtagcgagcgcaattcaaacggaaaggcaacagccagtgttgcccctcaactatggcaaccttcaagtgggattttgatgacaaacgatgtagctgaaactaaccctgaagaatcggtatcctgctttgcattgtccaaaaatgattcttatgtaatgtcagcttcaggaggaaagatttctttattcaatatgatgacattcaagacaatgacaacttttatgcctccaccaccagcagctacttttcttgctttccatcctcaagacaacaatataattgctattggtatggatgattcgaccatccagatatataatgttcgtattgatgaggtcaaaagcaagcttaaagggcactccaaaagaattacgggtcttgccttttctcacgtgctcaatgttttagtctcatcaggggcagatgctcagctttgtgtatggagttctgatggatgggagaaacaaaaagcaagatacttgcaacttccaccgggaagaccaccaacggcacagtcagacactcgcgtgcaatttcatcatgatcaaatccattttcttgttgtacatgatacacagcttgctatttatgaaacaacaaaacttgaatgtgtaaagcagtggctggtacgtgaatcctttgccccgatatcacacgcgatgttttcatgtgatagtcagcttgtgtatgcaagtttcttggatgcaaccgtgtgtgtgttcacagcttctaatcttcgtttacgctgtcgaatcaatccttctgcatatcttggtccaagtgtcccaagcaacccaaatgtgcatcccttggtcattgctgcacatccacaagaaccgaatcagtttgcattggggttgtcagacggggcggtgcatgtctttgagccgcttgaatccgaaggcaaatggggagtcccaccaccagccgaaaatggttcaacaagtaatgtagcggctgcacctgctggtggcccgagtgctgaacaagcgcagagataaccg

SEQ ID NO: 9227 - DNA, 3551 bp, Gossypium hirsutum
tttaatatgaaatattttgaggatgaggtacataatggaaattgggatgaagttgagaaatacttgtctggtttcaccaaggttgatgataatcggtattcgatgaaaatctttttcgagattagaaagcagaagtaccttgaagcattggataagcatgaccggtcgaaagctgtggagatattagtaaaggatttgaaagtttttgctacattcaatgaggaacttttcaaggaaatcactcagcttttgacattggagaatttcagagagaatgaacagttatcaaagtatggggatacaaaatcagctagagcaatcatgttagttgaactcaagaagcttattgaagcgaatcctttattccgtgacaagttgcagttccctaaccttaaaaattcgaggttacgcaccctcattaatcaaagtttgaattggcaacatcaactttgtaaaaacccaaggccaaatccggatattaaaactctctttgtggaccactcatgtggacagccaaatggtgcacgagcaccatctcccgcaaacaatccacttcttggatccttgccaaaagccggaggttttcctcctctaggggctcatgggccttttcaacctacacctgcacaagttccggcaccccttgctggttggatgtcaaatccttctactgtaactcatcctgctgtttctggtggagctattggtcttggtgcttcaatacccgctgcattgaagcacccgaggacccctccaactaatccatcagtagactacccatctggagactctgatcatgtttccaaaaggacaaggcccatggggatatctgatgaggtaaatcttcccgtcaatgtgatgccagtaccgtttcagggccatggtcacagtcaggctttcagtgcacctgatgatctgccaagagctgttgcaagaatgctgaaccagggttcatctcctatgagcatggatttccatcctgttcaacaaactctacttctagttggtaccaatgttggggacatagcattgtgggaagctggctctcgagagcggctggtttcgaaaaactttaaagtttgggatcttactgcttgttccatgccccttcaggctgctctagtcaaagatcctgccgtctctgtaaaccgtgtaatttggagccctgatggttctttatttggagttgcttactcaaggcacattgtgcaaatatattcttatcatggtggtgatgaggttcggcagcatctcgagattgatgctcatgttgggggtgtaaatgatattgcattctctcatccaaataagctactttgtgtaataacgtgcggtgatgacaagacaattaaggtgtgggatgcttctaatggtacaaagcagtatacctttgaaggtcacgaggctcctgtttattctgtctgccctcactataaagaaaacattcagtttatcttttcaacagctgtcgatggaaagataaaggcatggttatatgataatatgggatcaagggttgactatgaagctcctggtcgttggtgcacaaccatggcctacagtgctgatggtacaaggctcttttcctgtggcaccagtaaagacggggagtcatttatcgttgaatggaatgaaagtgaaggagctgtgaagcgaacttatcaagggttccgcaaacgttctttaggtgttgtacaatttgacacaactaagaacaagtatttggctgctggtgacgatttctctatcaaattctgggatatggacaatattcaacctttgaccagtttcgatgctgatggaggacttccagcgagtccacgcatccgctttaacaaggatggctccctcttggctgtttccaccaatgataacgggattaagattttggcaaattcagatggtatgcgattgttgcgcactttggagaatctttcttacgatgccttgagaacagctgaagccccgaagcctacaataaatccaatctcagctgcagcagcagcagcagcagcagcagctgccacagccgctactagtgctggacttgcagatagaagtgttgctattgctggaatgaatggagatgctcggagtttaggggatgtgaaacctcgaataacagaagaatccagtgataaatcaaagatttggaagctcactgaaatcaatgaaccatctcagtgtcgatccttgaggcttcctgaaaacttgagggtgaccaagatatcaaggttaatcttcacaaattcaggtaatgctatattggcattagcatcaaatgctattcacttgctttggaagtggcagcgtagcgatcgtaactcaaatggcaaggcaactgccagtgtagcacctcagttgtggcaaccatcaagtggcattcttatgaccaatgatgttgctgatacaaatcccgaagaggctgtaccgtgttttgctttgtcgaagaatgactcttatgtaatgtcagcatctggaggaaagatttccttgtttaatatgatgacgtttaagacgatggcaactttcatgccaccaccaccagcagcgaccttccttgcattccacccacaagataataatattattgctataggcatggacgactcaacaattcagatatataatgtccgtgtggatgaggtgaagagtaaacttaaaggtcactccaaaagaataactggccttgccttctcgcatgtactgagtgtgctcgtctcatcaggagccgattctcagctttgtgtgtggaacaccgatggatgggaaaagcaaaaggctagattcctgcaggttccagcggggaggacaccaacagcactgtcagacacacgtgtacaattccatcaagaccagatacattttcttgttgtacatgagactcagcttgccatatatgaaacaacgaagctagactgcatgaaacagtggattccacttgattcttctgctcctataacgcatgcaacgttctcatgtgatagccaactggtatatgccagctttctcgatgcatctgtttgtgtgtttactgctgcaaaccttagattacgttgtcgtataaacccttctgcttatcttccaactaacatcagttccaatgttcacccacttgtaatcgctgcacatccatccgagccaaacgaatttgcattgggactctcagatggtggggttcatgtctttgagccccttgaatccgaaaacaaatggggtgtgcctccacccgttgaaaacggttcaacgagcagtatgacagcaacaccttcagttggagctccaggatcagaacaagcccagagatgataaaatggttgacaaaagcacaaattcttttatatgattggcttgcatgcccctccctaatttagcttgacaatgaaagatgatgccaagatgtagatttttaacatattttgtgagatacaatgtctttaaggtaaatggcatagtagtgttttcttatgccctttttttgaagggaaaaattatgttaaaaagaggaatgattttctgttctattgtagttgttttatcttcatatatta

SEQ ID NO: 9228 - DNA, 3943 bp, Gossypium hirsutum
cgatgtcgtctctcagtagagagcttgtgttcttgatcttacagttcctagatgaggaaaagtttaagagactgttcacaagcttgaacaggaatctgggtttttcttcaatatgaaatattttgaggatgaagtgcataatggaaattgggatgaggttgagaaatacctctctggttttaccaaggtcgatgacaatcgatattccatgaaaatctttttcgagataagaaagcagaagtatcttgaggcattggataagcatgatcgatccaaagctgtggagatattagttaaggatttgaaagtttttgctacatttaatgaggaactttttaaggaaatcactcagcttctgacgttggagaatttcagagagaatgaacagttgtcaaaatatggagatacaaagtcagctagagcaatcatgttagttgaactcaagaagcttattgaagcaaatcctttattccgtgacaaattgcagttcccgacccttaaaaattcgaggttacgaaccctgattaatcagagcttgaattggcagcatcaactttgtaaaaacccgagaccaaatccagatataaaaactctctttgtggatcactcatgtgggcagccaaatggtgcacgagcaccatcacctgccaataatccacttcttggatccttaccaaaagctggaggttttcctcccttaggtgctcatgggccttttcaacctacgcctgcaccggttccagcaccccttgcaggttggatgtcaaatccttcagctgtaactcatccagcagtttcagctggtgccattggtcttggtgcgtcttcaataccagctgcgttgaagcatccaaggactcctccaactaatccgtctgtagactacccatctgcagactctgatcatgtttccaaaagggccaggcccatggggatttccgatgaggtaaatctgccagttaatgtgctgcaggtaacatttccgggccatggtcacagtcaaactttcattgcacctgacgatcttccgaaggctgttgcaagaactctgaatcagggttcatctcctatgagcatggatttccatcctgttcggcagactctacttctagttggtaccaacgttggagacattgccttgtgggaagttggctctcgggagcggctggtttcaaagaacttcaaagtttgggatcttagtgtttgttcaatgcctcttcaggctgctctagtcaaagatcctgctgtctctgtaaatcgtgtaatttggagtcccgatggttctttattcggagttgcttattcaaggcatattgtgcaaatatattcttaccatggtggtgatgaagttcgacagcatctcgagattgatgctcatgttggtggagtaaatgatattgcattctctcttccaaataagcaactttgtgtaataacttgcggtgatgacaagacaattaaggtgtgggatgcttccaatggtacaaagcagtatacctttgaaggtcacgaggctcccgtgtattctgtctgccctcactataaagagaacattcagtttatcttttcaactgccttagatggaaagataaaggcatggttgtatgataatatgggatcgcgggttgactatgaagctcctggtcggtggtgcacaaccatggcctacagtgctgatggtacaaggcttttttcatgtggaaccagtaaagaaggggagtcatttatcgtagaatggaatgaaagtgaaggggctgtgaagaggacctatcaaggattccgcaaacgttctttaggtgttgtgcaatttgatacaactaagaaccggtatttggctgctggtgacgatttctcaataaaattctgggatatggacaatgttcaacctttgaccagttatgatgccgaaggaggccttcctgcaagcccacggatccgctttaataaagatggctctctcctggctgtttcagccaatgataacggaattaagattttggccaattcagatggtatgcgattactgcgcactttggagaatctgtcttatgataactcaagaacaccggaagctcctaaaccaacaataaatccaatctcagctgcagcagcagctactagtgctgcacttgcagacagaagtgcatctgtggttgctatacctggaatgaatggggatgccaggagttttgcggatgtgaaacccagaataacagaagaatctagtgataaatcaaagatttggaagctcaccgaaatcagtgaatcttctcagtgtcgatccttgaggcttcctgaaaacttgagggtgaccaagatatcaaggttaatcttcacaaattccggtaatgctatcctggcgttagcatcaaatgctattcacttgctttggaaatggcagcgaagtgatcgtaattcaaatggcaaggcaactgccagtgtatcacctcagttgtggcaaccatcaagtggcattcttatgacaaatgatgttgctgatacaaatccagaagaggctgttccttgttttgctttatctaagaatgattcttatgtaatgtcagcatctggaggaaagatttccctgtttaatatgatgacatttaagacaatggcaactttcatgccaccgccacctgccgcgacttttcttgcattccacccacaagataataatattattgctattggcatggatgattcaacaattcagatatataatgtccgtgtggatgaggtgaagagtaaactcataggtcactccaaaagaataactggccttgccttctctcatgcactgaatgtgcttgtctcatccggggcagattctcagctttgtgtatggaacactgatggatgggaaaagctgaagactaaattcttgcagattcctgttgggataacaccaactgcacaatcagagacacgcgtacaattccatcaagaccagatacgtcttcttgttgtacatgagactcagcttgccttatacgaaacaacgaagttggaatgttttaagcagtgggtccctcgtgaatctttcgcgccaataactcatgcaacattttcatgtgatagccaactggtatatgccagctttttggatgcaactatttgtgtgtttgttgctgcaaacctcagaccacgttgccgtataaatccctcggcttatctgccagctagtgtcagctccaatgttcaccctcttgtaattgctgctcatccatcagagccaaatgaatttgcggtgggactctccgatggaggggttcatgtcttcgagcccctagagtctgaaaacagatggggagtgcctcaaccagcagacaacgggtcagccagcagtataacagcgacaccttcagttgcagctcaaggatcagaacaagcgcaaagatgatatgaaaacgggtgatggagcacaagtttcttttatatacttggcttgcaggcccatctaatttaggtatgctgtttttttttcccagtgtcaaatttgtcaagaaacaaaaacagtattgatggaaaggaaagacaagacaatgccaaaaacaagttgatttgaactacaactgaattcaagttccataactacaacattatttcatggtgtttgttagagcagcaattcataaaattgcctatttcaagttctctattttcggttttcattttgtcataagtcctttggctctactctattgttcgccacttcatttcagtattggttgagataaaaagttgcaaatgttcaattttggatgcaagaagggggctgtactcaagttacgagcagcataccatattttggtggtccactcagcattgttggcattatctattttagaagttggctttcactgtaaatgttgaattggtaaaaagctcttacttttgttcttattgtattgttaaaagatggattggtaaaagaaaatctaac

SEQ ID NO: 9229 - DNA, 3976 bp, Arabidopsis thaliana
cgaagagagagaaaatccctttttctctagatagagagagagagagagagagagaagaagaagctttttaatttagttttgctttctttcaagtttccttttttcgatagagagaaaaagagtccaaaaatcaatccatcacctctttcgtctctgtggtcttcttcttcttcttcatcgatctctctctctttatgagatgcgaagtttctggataattattcagatatagatctggtgatagtttggttagttgttgtgcatctgagttagaaaaaagtcttttaaggaagtgagagaaaacatgtcttctcttagtagagagctcgttttcttgatcttacagtttctcgatgaagagaagtttaaagagactgttcacaagcttgaacaagaatctgggtttttcttcaatatgaagtattttgaggatgaggttcacaatggaaattgggatgaggttgagaagtatctctctggtttcactaaagtagatgataatagatactctatgaagatattcttcgagataagaaagcagaagtatctcgaggctttggataagcatgatcgtcccaaggctgtggatatactagtgaaggatttgaaagtgttttcaacttttaatgaggagcttttcaaggaaataacacagctcttgacattggagaacttccgggagaatgaacagttatccaagtatggggacaccaagtctgcaagagcgatcatgttggtggaactcaaaaagctgattgaggcgaatcctttattccgtgataaattgcagttccctactcttagaaattcaaggctgaggactttgatcaaccagagcttaaattggcaacaccagctttgtaaaaatccaaggccaaatccagatatcaagactctttttgtggatcactcttgtggccctccaaatggcgcacgagctccatctcctgtgaacaatccactgcttggagggataccaaaggctggaggatttcctcctttaggcgcacacgggccatttcaaccaacggcgtcacctgttccaacacctcttgctggttggatgtctagtccatcctctgtcccacatccagctgtctcagcaggagccattgcacttggtggtccatcaatcccagcggcgttgaagcacccgagaactcctccaactaatgcttctttagactacccgtcagcagattctgaacatgtctcaaaaagaacaagaccaatgggaatctctgacgaggtgaatctaggcgtgaacatgttaccgatgtcattttcagggcaggcccatggtcattctccggctttcaaagcacctgacgacttgcccaagacagttgcgagaactttgagtcagggctcatctcccatgagcatggatttccatccaattaaacagaccctgcttctagttggtacaaatgtaggtgatatcgggctgtgggaagttggttctcgcgaaagattagtacagaagacgttcaaagtctgggatttgagtaaatgttcaatgcccttgcaggctgctctggtgaaagaacctgtcgtttctgtcaaccgtgtgatatggagccctgacggttccttgtttggagttgcttactcgagacatattgtacaactatactcttatcacggaggtgaagacatgaggcaacaccttgagattgatgctcatgttggtggtgtgaatgatatttccttctcgactccaaacaagcaactatgtgtaataacttgtggtgatgacaaaaccatcaaggtttgggacgctgcaacaggtgtcaaaaggcatacttttgaaggccatgaagctcctgtttattccgtttgtcctcattacaaggaaaacattcagttcatattttcaacagctcttgatgggaaaattaaggcttggttgtatgataatatgggttcccgagttgactatgatgcacctggtcgctggtgtactacaatggcttatagtgccgatggtactaggctattctcttgtgggacgagtaaagatggagagtctttcattgttgagtggaatgaaagcgaaggagctgttaaaagaacttatcaaggattccacaagcgttctctaggtgttgtgcagtttgatacaactaaaaaccgttatctagctgcgggtgatgatttctccatcaagttctgggatatggacgctgtacagcttttaactgccattgatggcgatggaggcctccaggcaagcccgcgtatccggttcaacaaggaaggctctctcctggccgtgtctggcaacgagaatgtgatcaagattatggcaaactcagatggtctaaggctattgcacacttttgagaacatatcatctgaatcctccaagcctgcaataaacagcatagcagcggcagcggcagctgctgcaacaagtgctggtcacgcagatcgatcagccaatgtagtttccatccaaggaatgaatggagattcgcggaatatggtggatgtgaagccagtgatcacagaagaatcaaatgataagtctaagatatggaagcttactgaagtcagcgagccttctcaatgcaggtcactgagactccctgagaatctgagagtagccaagatatcaagattgattttcacgaattcgggaaatgctattttggctctggcatcaaacgcaattcatcttctatggaaatggcagcggaatgagcgcaacgcaactggaaaggcgacagcttctttaccgcctcagcagtggcaaccagctagtgggatcctcatgactaacgatgttgctgaaaccaatcccgaggaagctgtaccttgttttgctttatccaagaatgattcatatgtaatgtcagcctccggaggaaagatatccttatttaacatgatgacgtttaagacaatggcgactttcatgcccccaccaccggctgctacttttcttgcttttcatcctcaagacaacaatatcatcgctattgggatggatgatagcacgattcagatttataatgtccgtgttgatgaggtgaagagtaagcttaaaggtcattcaaagagaataactggtcttgccttctccaacgtattaaacgtgttggtttcgtctggagcagatgcacagctttgtgtttggaacacagatggatgggaaaagcagagaagcaaggttttgccacttccacagggaagaccaaacagtgcaccttcagatacgcgtgttcagttccatcaagatcaagctcacttcctcgttgtgcacgagacgcaacttgctatatacgaaactaccaagctcgaatgcatgaaacagtgggctgttcgagaatcattagctccaatcactcatgccacattctcatgcgatagccaattggtctacgcgagttttatggatgcaacagtttgtgtatttagctctgcaaatctacggctgcgttgccgggtcaacccttctgcgtatctaccagctagtctcagcaattcaaacgtacatccactagtgattgctgcacatccgcaagaaccaaacatgtttgcagttggtctctcagacgggggagtgcacatattcgaaccgctcgagtctgaaggtaaatggggagtcgctccaccggctgagaacgggtcggctagcggtgcaccaactgcaccttccgttggagcctctgcatctgatcagcctcagagatgatctgatccgagagccacctacctctctgattccctttcttctatttaaaagtcttttctttcttatttttttggtagaaaaatttatgacccagagattcttaacatttagatgtaacatattttcacagtaattcagtagtgaagtttggataaaaacagtgactgatgttgtttctctctcttttccttttctgagatttttaccttcacatagattttctattgtgcaagatattcaattatatattacagtcgatatttcgaatttacatat

SEQ ID NO: 9230 - DNA, 3830 bp, Arabidopsis thaliana
cgatagagagaaaaagagtccaaaaatcaatccatcacctctttcgtctctgtggtcttcttcttcttcttcatcgatctctctctctttatgatctggtgatagtttggttagttgttgtgcatctgagttagaaaaaagtcttttaaggaagtgagagaaaacatgtcttctcttagtagagagctcgttttcttgatcttacagtttctcgatgaagagaagtttaaagagactgttcacaagcttgaacaagaatctgggtttttcttcaatatgaagtattttgaggatgaggttcacaatggaaattgggatgaggttgagaagtatctctctggtttcactaaagtagatgataatagatactctatgaagatattcttcgagataagaaagcagaagtatctcgaggctttggataagcatgatcgtcccaaggctgtggatatactagtgaaggatttgaaagtgttttcaacttttaatgaggagcttttcaaggaaataacacagctcttgacattggagaacttccgggagaatgaacagttatccaagtatggggacaccaagtctgcaagagcgatcatgttggtggaactcaaaaagctgattgaggcgaatcctttattccgtgataaattgcagttccctactcttagaaattcaaggctgaggactttgatcaaccagagcttaaattggcaacaccagctttgtaaaaatccaaggccaaatccagatatcaagactctttttgtggatcactcttgtggccctccaaatggcgcacgagctccatctcctgtgaacaatccactgcttggagggataccaaaggctggaggatttcctcctttaggcgcacacgggccatttcaaccaacggcgtcacctgttccaacacctcttgctggttggatgtctagtccatcctctgtcccacatccagctgtctcagcaggagccattgcacttggtggtccatcaatcccagcggcgttgaagcacccgagaactcctccaactaatgcttctttagactacccgtcagcagattctgaacatgtctcaaaaagaacaagaccaatgggaatctctgacgaggtgaatctaggcgtgaacatgttaccgatgtcattttcagggcaggcccatggtcattctccggctttcaaagcacctgacgacttgcccaagacagttgcgagaactttgagtcagggctcatctcccatgagcatggatttccatccaattaaacagaccctgcttctagttggtacaaatgtaggtgatatcgggctgtgggaagttggttctcgcgaaagattagtacagaagacgttcaaagtctgggatttgagtaaatgttcaatgcccttgcaggctgctctggtgaaagaacctgtcgtttctgtcaaccgtgtgatatggagccctgacggttccttgtttggagttgcttactcgagacatattgtacaactatactcttatcacggaggtgaagacatgaggcaacaccttgagattgatgctcatgttggtggtgtgaatgatatttccttctcgactccaaacaagcaactatgtgtaataacttgtggtgatgacaaaaccatcaaggtttgggacgctgcaacaggtgtcaaaaggcatacttttgaaggccatgaagctcctgtttattccgtttgtcctcattacaaggaaaacattcagttcatattttcaacagctcttgatgggaaaattaaggcttggttgtatgataatatgggttcccgagttgactatgatgcacctggtcgctggtgtactacaatggcttatagtgccgatggtactaggctattctcttgtgggacgagtaaagatggagagtctttcattgttgagtggaatgaaagcgaaggagctgttaaaagaacttatcaaggattccacaagcgttctctaggtgttgtgcagtttgatacaactaaaaaccgttatctagctgcgggtgatgatttctccatcaagttctgggatatggacgctgtacagcttttaactgccattgatggcgatggaggcctccaggcaagcccgcgtatccggttcaacaaggaaggctctctcctggccgtgtctggcaacgagaatgtgatcaagattatggcaaactcagatggtctaaggctattgcacacttttgagaacatatcatctgaatcctccaagcctgcaataaacagcatagcagcggcagcggcagctgctgcaacaagtgctggtcacgcagatcgatcagccaatgtagtttccatccaaggaatgaatggagattcgcggaatatggtggatgtgaagccagtgatcacagaagaatcaaatgataagtctaagatatggaagcttactgaagtcagcgagccttctcaatgcaggtcactgagactccctgagaatctgagagtagccaagatatcaagattgattttcacgaattcgggaaatgctattttggctctggcatcaaacgcaattcatcttctatggaaatggcagcggaatgagcgcaacgcaactggaaaggcgacagcttctttaccgcctcagcagtggcaaccagctagtgggatcctcatgactaacgatgttgctgaaaccaatcccgaggaagctgtaccttgttttgctttatccaagaatgattcatatgtaatgtcagcctccggaggaaagatatccttatttaacatgatgacgtttaagacaatggcgactttcatgcccccaccaccggctgctacttttcttgcttttcatcctcaagacaacaatatcatcgctattgggatggatgatagcacgattcagatttataatgtccgtgttgatgaggtgaagagtaagcttaaaggtcattcaaagagaataactggtcttgccttctccaacgtattaaacgtgttggtttcgtctggagcagatgcacagctttgtgtttggaacacagatggatgggaaaagcagagaagcaaggttttgccacttccacagggaagaccaaacagtgcaccttcagatacgcgtgttcagttccatcaagatcaagctcacttcctcgttgtgcacgagacgcaacttgctatatacgaaactaccaagctcgaatgcatgaaacagtgggctgttcgagaatcattagctccaatcactcatgccacattctcatgcgatagccaattggtctacgcgagttttatggatgcaacagtttgtgtatttagctctgcaaatctacggctgcgttgccgggtcaacccttctgcgtatctaccagctagtctcagcaattcaaacgtacatccactagtgattgctgcacatccgcaagaaccaaacatgtttgcagttggtctctcagacgggggagtgcacatattcgaaccgctcgagtctgaaggtaaatggggagtcgctccaccggctgagaacgggtcggctagcggtgcaccaactgcaccttccgttggagcctctgcatctgatcagcctcagagatgatctgatccgagagccacctacctctctgattccctttcttctatttaaaagtcttttctttcttatttttttggtagaaaaatttatgacccagagattcttaacatttagatgtaacatattttcacagtaattcagtagtgaagtttggataaaaacagtgactgatgttgtttctctctcttttccttttctgagatttttaccttcacatagattttctattgtgcaagatattcaattatatattacagtcgatatttcgaatt

SEQ ID NO: 9231 - DNA, 3604 bp, Eutrema halophilum
tccaaaaccaaattccttcgcctctttcatctgaggagagagaaaccgaagctctggccttccttgtgaaatcgatctctctctctcttgttcatgatctggtgatagatttggtgggttttctgcatctgagttgaaaacgtctcggagtgagtaaacaaaaaacatgtcgtctcttagtagagagctcgtcttcttgatcttacagtttctagatgaggagaagttcaaagagactgttcataagcttgaacaagaatctggatttttcttcaatatgaagtattttgaggatgaggtgcacaatggaaactgggatgaggtggagaagtatctctctggttttacaaaagtagatgataatagatactccatgaagatattcttcgagataaggaagcagaagtatctcgaggccttggataagcatgatcgtccaaaggctgttgaaattttagtgaaagatttgaaagttttttccacttttaatgaggagcttttcaaggaaatcactcagctcctgaccttagaaaacttccgggagaacgagcagttatccaagtatggagacacaaagtcagccagatctatcatgttggtggagcttaagaagttgatagaggcgaatccattattccgtgataaactgcagtttcctacccttcgaaattcacggctgaggacgctgattaaccagagcttaaattggcaacatcagctttgtaaaaacccaaggccaaatcctgatataaagactctctttgtggatcactcctgtcgcctaccaaatgatgcacgagcaccatcccctgtcaacaatccgctgcttggatcattaccaaaagccgggggatttcctcctttaggcgcacacgggccatttcaaccaacaccgtctccagttccgacacctcttgctggttggatgtctagtccttcctctgtccctcatccagctgtgtctggaggagctattgctctcggtgctccatccatccaagccttgaagcacccgagaactcctccaagtaattccgctgtagactacccatcaggtgactcagaacatgtctccaaaagaacaagacctatgggaatctctgacgaggtgaatctaggtgtgaacatgttaccgatgacattcccggggcagggccatggtcatactcaaacctttaaagcacctgatgacttgcctaagacagtagcacgaactctgagccaaggctcatctcccatgagcatggatttccatccaatcaaacaggctctgctactagttggtacaaacgtaggggatattgggctctgggaagtcggttctcgagaacgtctagtacagaagactttcaaagtctgggacctgagtaaatgttcgatgcccttgcaggctgctttggtgaaagaacctgtcgtttctgtcaaccgtgtgatttggagcccggatggttccttattcggagttgcttattcgagacatattgtacagctatactcttatcacggtggtgaagatatgaggcaacacctcgagatagatgctcacgttggtggtgttaatgacattgcattctccactccaaacaagcaactatgtgttactacttgtggtgatgacaaaaccatcaaggtttgggatgctgcaacgggtgtaaaacggcatacttttgaaggccacgaagctcccgtgtactctatctgccctcactacaaggaaaacattcagttcatcttttcgactgcgcttgacgggaaaataaaagcgtggttatatgataatatgggttctcgggttgactacgaagctcctggtcgctggtgtacaacgatggcctacagtgctgatggaaccaggctattttcttgtgggacgagtaaagatggggattcgtacatagttgagtggaatgaaagcgaaggagcggttaaaagaacttatcaaggattccacaagcgttctcttggtgttgttcagtttgatactactaaaaaccgctatcttgctgcgggtgatgacttctccattaagttctgggatatggacaatatacagcttttgactgcaattgatgctgatgggggtctccaggcaagccctcggatccggtttaacaaggaaggctctctcttggccgtttctgcaaatgacaatatgattaaggttatggcaaacacagatggtctgaggctattgcacacggtcgagaacttatcttctgaatcctccaagcctgcaattaacaacattgcggtggcagagagacctgcctctgtggtttccatccccggaatgaatggagattcgcggaatatggtggatgtgaagccagtgatcactgaagaatcaaatgataagtctaagatatggaagcttactgaagtcggtgaaccctctcaatgccgctcgttgagactccctgagaatatgagagtcaccaagatatcgagattgattttcacaaattctggaaatgcgattttggcattagcatcaaatgctattcatctgctttggaaatggcagcgaaatgaccgaaacgcaactggaaaggcaacggcttctttacctcctcagcagtggcaaccagcgagcgggatcttaatgacaaacgatgtgactgaaactaatccagaggaagccgtaccgtgttttgctttgtccaagaatgattcctatgtgatgtcagcatccggaggaaagatctctttgtttaatatgatgacgtttaagacaatggctactttcatgccgcctccgcctgctgcaacgtttctggcttttcaccctcaagacaacaatataattgcaattggaatggatgatagtacaatacagatttataatgttcgcgttgatgaggtcaagagcaagcttaaaggacattctaagaggataaccggcctcgccttctccaacgtcctaaacgttctggtctcgtctggagcagacgctcagctttgtgtatggaacacggatggatgggagaagcagaaaagcaaggttctgcaaattccacagggaagatcgacgggtgctctttcagacacgcgtgttcaatttcatcaagatcaagtacacttcctcgtggtccatgaaactcagctcgctatatacgaaacaaccaagcttgagtgcatgaaacagtggcctgtacgtgagtcatcagctccaatcacacatgccacattctcatgtgatagccaattgatatacgcaagtttcatggatgctacaatctgtgtcttcagctctgcaaaccttcgattgcgttgcagaatcaatccctcggcgtatttgccagcttctctcagcaactcgaatgtgcatccactggtgattgcggcacatccgcaagaatccaatatgcttgctgtgggcctctcagacggtggtgtccatatatttgagccgcttgagtcagaaggtaaatggggagtggctccaccgcctgagaatggctctgccagcgctgtggcgtccacaccttccgcctccgatcagcctcagagatgatataaaaccgaccctgcttctgtgaatggattcatgtaacataaaatctatagcaagttgaaacagttcccaattggttgattcgttgtt

SEQ ID NO: 9232 - DNA, 3663 bp, Eutrema halophilum
tttttgttacttttccttcttttttttcggtcgagagaatgaaaaagagtccaaaaccaaattccttcgcctctttcatctgaggagagagaaaccgaagctctggccttccttgtgaaatcgatctctctctctcttgttcatgatctggtgatagatttggtgggttttctgcatctgagttgaaaacgtctcggagtgagtaaacaaaaaacatgtcgtctcttagtagagagctcgtcttcttgatcttacagtttctagatgaggagaagttcaaagagactgttcataagcttgaacaagaatctggatttttcttcaatatgaagtattttgaggatgaggtgcacaatggaaactgggatgaggtggagaagtatctctctggttttacaaaagtagatgataatagatactccatgaagatattcttcgagataaggaagcagaagtatctcgaggccttggataagcatgatcgtccaaaggctgttgaaattttagtgaaagatttgaaagttttttccacttttaatgaggagcttttcaaggaaatcactcagctcctgaccttagaaaacttccgggagaacgagcagttatccaagtatggagacacaaagtcagccagatctatcatgttggtggagcttaagaagttgatagaggcgaatccattattccgtgataaactgcagtttcctacccttcgaaattcacggctgaggacgctgattaaccagagcttaaattggcaacatcagctttgtaaaaacccaaggccaaatcctgatataaagactctctttgtggatcactcctgtcgcctaccaaatgatgcacgagcaccatcccctgtcaacaatccgctgcttggatcattaccaaaagccgggggatttcctcctttaggcgcacacgggccatttcaaccaacaccgtctccagttccgacacctcttgctggttggatgtctagtccttcctctgtccctcatccagctgtgtctggaggagctattgctctcggtgctccatccatccaagcagccttgaagcacccgagaactcctccaagtaattccgctgtagactacccatcaggtgactcagaacatgtctccaaaagaacaagacctatgggaatctctgacgaggtgaatctaggtgtgaacatgttaccgatgacattcccggggcagggccatggtcatactcaaacctttaaagcacctgatgacttgcctaagacagtagcacgaactctgagccaaggctcatctcccatgagcatggatttccatccaatcaaacaggctctgctactagttggtacaaacgtaggggatattgggctctgggaagtcggttctcgagaacgtctagtacagaagactttcaaagtctgggacctgagtaaatgttcgatgcccttgcaggctgctttggtgaaagaacctgtcgtttctgtcaaccgtgtgatttggagcccggatggttccttattcggagttgcttattcgagacatattgtacagctatactcttatcacggtggtgaagatatgaggcaacacctcgagatagatgctcacgttggtggtgttaatgacattgcattctccactccaaacaagcaactatgtgttactacttgtggtgatgacaaaaccatcaaggtttgggatgctgcaacgggtgtaaaacggcatacttttgaaggccacgaagctcccgtgtactctatctgccctcactacaaggaaaacattcagttcatcttttcgactgcgcttgacgggaaaataaaagcgtggttatatgataatatgggttctcgggttgactacgaagctcctggtcgctggtgtacaacgatggcctacagtgctgatggaaccaggctattttcttgtgggacgagtaaagatggggattcgtacatagttgagtggaatgaaagcgaaggagcggttaaaagaacttatcaaggattccacaagcgttctcttggtgttgttcagtttgatactactaaaaaccgctatcttgctgcgggtgatgacttctccattaagttctgggatatggacaatatacagcttttgactgcaattgatgctgatgggggtctccaggcaagccctcggatccggtttaacaaggaaggctctctcttggccgtttctgcaaatgacaatatgattaaggttatggcaaacacagatggtctgaggctattgcacacggtcgagaacttatcttctgaatcctccaagcctgcaattaacaacattgcggtggcagagagacctgcctctgtggtttccatccccggaatgaatggagattcgcggaatatggtggatgtgaagccagtgatcactgaagaatcaaatgataagtctaagatatggaagcttactgaagtcggtgaaccctctcaatgccgctcgttgagactccctgagaatatgagagtcaccaagatatcgagattgattttcacaaattctggaaatgcgattttggcattagcatcaaatgctattcatctgctttggaaatggcagcgaaatgaccgaaacgcaactggaaaggcaacggcttctttacctcctcagcagtggcaaccagcgagcgggatcttaatgacaaacgatgtgactgaaactaatccagaggaagccgtaccgtgttttgctttgtccaagaatgattcctatgtgatgtcagcatccggaggaaagatctctttgtttaatatgatgacgtttaagacaatggctactttcatgccgcctccgcctgctgcaacgtttctggcttttcaccctcaagacaacaatataattgcaattggaatggatgatagtacaatacagatttataatgttcgcgttgatgaggtcaagagcaagcttaaaggacattctaagaggataaccggcctcgccttctccaacgtcctaaacgttctggtctcgtctggagcagacgctcagctttgtgtatggaacacggatggatgggagaagcagaaaagcaaggttctgcaaattccacagggaagatcgacgggtgctctttcagacacgcgtgttcaatttcatcaagatcaagtacacttcctcgtggtccatgaaactcagctcgctatatacgaaacaaccaagcttgagtgcatgaaacagtggcctgtacgtgagtcatcagctccaatcacacatgccacattctcatgtgatagccaattgatatacgcaagtttcatggatgctacaatctgtgtcttcagctctgcaaaccttcgattgcgttgcagaatcaatccctcggcgtatttgccagcttctctcagcaactcgaatgtgcatccactggtgattgcggcacatccgcaagaatccaatatgcttgctgtgggcctctcagacggtggtgtccatatatttgagccgcttgagtcagaaggtaaatggggagtggctccaccgcctgagaatggctctgccagcgctgtggcgtccacaccttccgcctccgatcagcctcagagatgatataaaaccgaccctgcttctgtgaatggattcatgtaacataaaatctatagcaagttgaaacagttcccaattggttgattcgttgttgcttgcc

SEQ ID NO: 9233 - DNA, 3536 bp, Arabidopsis lyrata
gagagagagactgaagctctggcctttgtttctgaaatcgatcttgttcttcttcttcttcatgatcgatctggtgcatctgacttgaaagcttatcggagtgagtgaagaaatattatcatgtcttctctgagcagagagctcgtgttcttgatcttacagtttttagatgaagagaagttcaaagagactgttcataagcttgaacaagaatctgggtttttcttcaatatgaagtattttgaggatgaggtccacaatggtaactgggatgaggttgagaggtatctctctggttttaccaaagttgatgataatagatactccatgaagattttcttcgagattaggaagcagaagtatctcgaggccttggataggcatgatcgtcccaaggctgtggaaattctagtcaaagatttgaaagtcttttccacttttaatgaggagcttttcaaggaaatcactcagctcttgaccttagaaaacttccgggagaacgagcagttatccaagtatggggacacaaagtccgcccgagctatcatgttggtggaactcaagaagttgattgaagctaatccattgttccgtgataaattgcagtttcctacccttcgaaattcacggctgaggactctcattaatcagagcttaaattggcaacatcagctttgtaaaaacccaaggcctaatcctgatattaagactctctttgtggatcattcctgccgcctaccaaatgatgcacgagcaccatcccctgtcaacaatccgctgcttggatcattaccaaaagctgggggatttcctcctttaggcgcacacgggccatttcaaccaacaccttctcctgttcctacacctcttgctggttggatgtctagtccttcctctgtcccacatccagctgtgtctggaggagccattgctcttggtgctccatccatccaagcagccttgaagcacccgagaactcctccaactaattccgctgtagactatccatcaggtgattcagaccatgtctcaaagcgaacaagacctatgggaatctctgacgaggtgagtctaggtgtcaacatgttaccaatgacattcccgggacaggctcatggtcataatcaaaccttcaaagtacctgatgacttgcccaagacagtagcacgaactttgagccaaggctcatctcccatgagcatggatttccatcctattaaacagactctgctactagttggtacgaatgtaggggatattgggctctgggaagtcggttctcgagaacgactagtccagaagactttcaaagtttgggacttgagtaaatgttcaatgcccttgcaggctgctttggtgaaagaacctgtcgtttctgtcaaccgtgtgatttggagcccggatggttccctattcggagttgcttattcaagacatattgtacagctatactcttatcacggtggtgaagatatgaggcaacacctcgagattgatgctcatgttggcggtgtcaatgacattgcattctccactccgaacaagcaactatgtgttactacttgtggtgatgacaaaaccatcaaggtctgggatgctgcaacgggtgtaaaacggcatacttttgaaggccatgaagctcctgtttactctatctgccctcactacaaggaaaacattcagttcatcttttcaactgcgcttgacgggaaaataaaagcatggttatatgataatatgggttctcgggttgactatgaagctcctggtcgctggtgtacaacgatggcctacagtgctgatggaactaggctattttcttgtgggacgagtaaagatggggagtcgttcatagttgagtggaatgaaagcgaaggagcagttaagagaacttatcaaggattccacaagcgttctcttggtgttgtgcagtttgatactactaaaaaccgttatctcgctgcgggtgacgacttctccattaagttctgggatatggacactatacagcttttgactgccattgatgctgatggaggtctccaggcaagtccacggatcagatttaacaaggaaggctctctcttggccgtttctgcaaatgacaatatgattaaggttatggcaaactcagatggtcttaggctattgcacacagtcgagaacttatcttctgaatcctccaagcctgcaatcaatagcattccggtggcagagagacctgcctctgtcgtttccattcctggaatgaatggagattcacggaatatggtggatgtgaagccagtgatcactgaagaatcaaatgataagtctaaggtatggaagcttactgaactcggcgaaccctctcaatgccgttcattgagactccctgagaatatgagagccaccaagatatcgagattgattttcacaaattcgggaaatgcaattttggcattggcatcaaatgctattcatctgctatggaagtggcagcgaaatgaccgcaatgcaactggaaaggcaacggcttctgtacctcctcagcagtggcaaccagcgagcgggatcttaatgacaaacgatgtggttgaaactaatccagaagaagccgtaccatgttttgctttatccaaaaatgattcctacgtaatgtcagcatcgggaggaaagatctctttgtttaatatgatgacgtttaagacaatggctactttcatgccgccgccccctgctgcaacgtttcttgcttttcaccctcaagataacaatatcattgcgatcgggatggatgatagtacaatacagatttacaatgttcgtgttgatgaggttaagagcaagcttaaaggacattctaagagaataaccggcctcgctttctccaatgtactaaacgttctggtttcgtctggagcagatgctcagctttgtgtatggaacacggatggatgggagaagcagaaaagcaaggtcctgcaaattccacagggaagatcgacgtctgctctgtcagacacgcgtgttcagtttcatcaagatcaagtacacttccttgtggtccatgaaactcagctcgccatatacgaaacaaccaagcttgaatgcatgaaacagtggcctgtgcgtgaatcatcagctccaatcacacatgccacattctcatgtgatagccaactgatatacacaagtttcatggacgctacgatatgtgtcttcagctctgcaaaccttagattgcgttgcagagtcaatccctcagcatatttgccagcttctctcagcaactcgaacgtccatccgctggtgatagcggctcatccgcaagaatcgaatatgtttgcagtgggtctgtcagacggaggggtccatatattcgagccgcttgagtcagaaggtaaatggggagtagctccaccgcctgaaaatggctcagcgagcgctgtcacggctacagcttccgttggagcttctgcctctgaccaggctcagagatgatgctgcttcagttccttactctgtttatttttggggttttagatcttttccga

SEQ ID NO: 9234 - DNA, 3619 bp, Arabidopsis lyrata
gaagctctggcctttgtttctgaaatcgatcttgttcttcttcttcttcatgatcgatctggtgcatctgacttgaaagcttatcggagtgagtgaagaaatattatcatgtcttctctgagcagagagctcgtgttcttgatcttacagtttttagatgaagagaagttcaaagagactgttcataagcttgaacaagaatctgggtttttcttcaatatgaagtattttgaggatgaggtccacaatggtaactgggatgaggttgagaggtatctctctggttttaccaaagttgatgataatagatactccatgaagattttcttcgagattaggaagcagaagtatctcgaggccttggataggcatgatcgtcccaaggctgtggaaattctagtcaaagatttgaaagtcttttccacttttaatgaggagcttttcaaggaaatcactcagctcttgaccttagaaaacttccgggagaacgagcagttatccaagtatggggacacaaagtccgcccgagctatcatgttggtggaactcaagaagttgattgaagctaatccattgttccgtgataaattgcagtttcctacccttcgaaattcacggctgaggactctcattaatcagagcttaaattggcaacatcagctttgtaaaaacccaaggcctaatcctgatattaagactctctttgtggatcattcctgccgcctaccaaatgatgcacgagcaccatcccctgtcaacaatccgctgcttggatcattaccaaaagctgggggatttcctcctttaggcgcacacgggccatttcaaccaacaccttctcctgttcctacacctcttgctggttggatgtctagtccttcctctgtcccacatccagctgtgtctggaggagccattgctcttggtgctccatccatccaagcagccttgaagcacccgagaactcctccaactaattccgctgtagactatccatcaggtgattcagaccatgtctcaaagcgaacaagacctatgggaatctctgacgaggtgagtctaggtgtcaacatgttaccaatgacattcccgggacaggctcatggtcataatcaaaccttcaaagtacctgatgacttgcccaagacagtagcacgaactttgagccaaggctcatctcccatgagcatggatttccatcctattaaacagactctgctactagttggtacgaatgtaggggatattgggctctgggaagtcggttctcgagaacgactagtccagaagactttcaaagtttgggacttgagtaaatgttcaatgcccttgcaggctgctttggtgaaagaacctgtcgtttctgtcaaccgtgtgatttggagcccggatggttccctattcggagttgcttattcaagacatattgtacagctatactcttatcacggtggtgaagatatgaggcaacacctcgagattgatgctcatgttggcggtgtcaatgacattgcattctccactccgaacaagcaactatgtgttactacttgtggtgatgacaaaaccatcaaggtctgggatgctgcaacgggtgtaaaacggcatacttttgaaggccatgaagctcctgtttactctatctgccctcactacaaggaaaacattcagttcatcttttcaactgcgcttgacgggaaaataaaagcatggttatatgataatatgggttctcgggttgactatgaagctcctggtcgctggtgtacaacgatggcctacagtgctgatggaactaggctattttcttgtgggacgagtaaagatggggagtcgttcatagttgagtggaatgaaagcgaaggagcagttaagagaacttatcaaggattccacaagcgttctcttggtgttgtgcagtttgatactactaaaaaccgttatctcgctgcgggtgacgacttctccattaagttctgggatatggacactatacagcttttgactgccattgatgctgatggaggtctccaggcaagtccacggatcagatttaacaaggaaggctctctcttggccgtttctgcaaatgacaatatgattaaggttatggcaaactcagatggtcttaggctattgcacacagtcgagaacttatcttctgaatcctccaagcctgcaatcaatagcattccggtggcagagagacctgcctctgtcgtttccattcctggaatgaatggagattcacggaatatggtggatgtgaagccagtgatcactgaagaatcaaatgataagtctaaggtatggaagcttactgaactcggcgaaccctctcaatgccgttcattgagactccctgagaatatgagagccaccaagatatcgagattgattttcacaaattcgggaaatgcaattttggcattggcatcaaatgctattcatctgctatggaagtggcagcgaaatgaccgcaatgcaactggaaaggcaacggcttctgtacctcctcagcagtggcaaccagcgagcgggatcttaatgacaaacgatgtggttgaaactaatccagaagaagccgtaccatgttttgctttatccaaaaatgattcctacgtaatgtcagcatcgggaggaaagatctctttgtttaatatgatgacgtttaagacaatggctactttcatgccgccgccccctgctgcaacgtttcttgcttttcaccctcaagataacaatatcattgcgatcgggatggatgatagtacaatacagatttacaatgttcgtgttgatgaggttaagagcaagcttaaaggacattctaagagaataaccggcctcgctttctccaatgtactaaacgttctggtttcgtctggagcagatgctcagctttgtgtatggaacacggatggatgggagaagcagaaaagcaaggtcctgcaaattccacagggaagatcgacgtctgctctgtcagacacgcgtgttcagtttcatcaagatcaagtacacttccttgtggtccatgaaactcagctcgccatatacgaaacaaccaagcttgaatgcatgaaacagtggcctgtgcgtgaatcatcagctccaatcacacatgccacattctcatgtgatagccaactgatatacacaagtttcatggacgctacgatatgtgtcttcagctctgcaaaccttagattgcgttgcagagtcaatccctcagcatatttgccagcttctctcagcaactcgaacgtccatccgctggtgatagcggctcatccgcaagaatcgaatatgtttgcagtgggtctgtcagacggaggggtccatatattcgagccgcttgagtcagaaggtaaatggggagtagctccaccgcctgaaaatggctcagcgagcgctgtcacggctacagcttccgttggagcttctgcctctgaccaggctcagagatgatgatatgaaaccgatctgcttcagttccttactctgtttatttttggggttttagatcttttccgaaagcattctaacaaggtgaatgaatcaatgtaaaatattatctatagcttacaagttgcctaattggttaattcgatgttgc

SEQ ID NO: 9235 - DNA, 3867 bp, Eutrema parvulum
aaataattttggagagagagaaaacttgtttacttttccttcttttttttcggtcgagagaatgaaaaagagtccaaaaccaaattccttcgcctctttcatctgaggagagagaaaccgaagctctggccttccttgtgaaatcgatctctctctctcttgttcatgatctggtgatagatttggtgggttttctgcatctgagttgaaaacgtctcggagtgagtaaacaaaaacatgtcgtctcttagtagagagctcgtcttcttgatcttacagtttctagatgaggagaagttcaaagagactgttcataagcttgaacaagaatctgggtttttcttcaatatgaagtattttgaggatgaggtgcacaatggaaactgggatgaggtggagaagtatctctctggttttacaaaagtagatgataatagatactccatgaagatattcttcgagataaggaagcagaagtatctcgaggcgttggataagcatgatcgtccaaaggctgtagaaattttagtgaaagatttgaaagtcttttccacttttaatgaggagcttttcaaggaaatcactcagctcctgaccttagaaaacttccgggagaacgagcagttatccaagtatggagacacaaagtcagccagatctatcatgttggtggaacttaagaagttgatagaggcgaatccattattccgtgataaactgcagtttcctacccttcgaaattcacggctgaggacgctgattaaccagagcttaaattggcaacatcagctttgtaaaaacccaaggccaaatcctgatataaagactctctttgtggatcactcctgtcgcttaccaaatgatgcacgagcaccatcccctgtcaacaatccgctgcttggatcattaccaaaagccgggggatttcctcctttaggcgcacacgggccatttcaaccaacaccgtctccagttccgacacctcttgctggttggatgtctagtccttcctctgtccctcatccagctgtgtctggaggagctattgctctcggtgctccatccatccaagccttgaagcacccgagaactcctccaagtaattctgctgtagactatgcattgggtgattcggaccatgtctcaaaaagaacaagacccatgggaatctctgacgaggtgaatctaggtgtcaacatgttgccaatgacattcccggggcaggcccatggtcatacccaaaccttcaaagcacccgatgacttgcctaagacagtagcacgaactttgagccaagggtcatctcccatgagcatggattttcatccgatcaaacagactcttctactagttggtacaaacgtaggggatattggcctctgggaagtcggttctcgagaacgtctagtacagaagactttcaaagtttgggacttgagtaaatgttcaatgcccttgcaggctgctttggtgaaagaacctgtcgtttcggtcaaccgtgtgatttggagcccggatggttccttattcggagttgcttattccagacatattgtacagctatactcttatcacggtggtgaagatatgaggcaacacctcgagattgatgctcatgttggtggtgtaaatgacattgcattctccactccaaacaagcaactatgtgttactacttgtggtgatgacaaaaccatcaaggtctgggatgctgcaacgggtgtaaaacggcatacttttgaaggccatgaagctcccgtgtactctatctgccctcactacaaggaaaacattcagttcatcttttcgactgcgcttgacgggaaaataaaagcgtggttatatgataatatgggttctcgggttgactacgaagctcctggtcgctggtgtacaacgatggcctacagtgctgatggaaccaggctattttcttgtgggacgagtaaagatggggattcgtacatagttgagtggaatgaaagcgaaggagcggttaaaagaacttatcaaggattccacaagcgttctcttggtgttgttcagtttgatactactaaaaaccgctatcttgctgcgggtgatgacttctccattaagttctgggatatggacaatatacagcttttgactgcaattgatgctgatgggggtctccaggcaagcccacggatccggtttaacaaggaaggctctctcttggccgtctctgccaatgacaatatgattaaggttatggcaaacacagatggtctaaggttattgcacacggtcgagaacttatcttctgaatcctccaagcctgcaattaacaacattgcggtggcagagagacctgcctctgtggtttccatccccggaatgaatggagattcgcggaatatggtggatgtgaagccagtgatcactgaagaatcaaatgataagtctaagatatggaagcttactgaagtcggtgaaccctctcaatgccgctcgttgagactccctgagaatatgagagtcaccaagatatcgagattgattttcacaaattctggaaatgcgattttggcattagcatcaaatgctattcatctgctttggaaatggcagcgaaatgaccgaaacgcaactggaaaggcaacggcttctttacctcctcagcagtggcaaccagcgagcggaatcttaatgacaaacgatgtgactgaaactaatccagaggaagccgtaccgtgttttgctttgtccaagaatgattcctatgtgatgtcagcatccggaggaaagatctctttgtttaatatgatgacgtttaagacaatggctactttcatgccgcctccgcctgctgcaacgtttctggcttttcaccctcaagacaacaatataattgcaattggaatggatgatagtacaatacagatttataatgttcgcgttgatgaggtcaagagcaagcttaaaggacattctaagaggataaccggcctcgccttctccaacgtcctaaacgttctggtctcgtctggagcagacgctcagctttgtgtatggaacacggatggatgggagaagcagaaaagcaaggttctgcaaattccacagggaagatcgacgggtgctctttcagacacgcgtgttcaatttcatcaagatcaagtacacttcctcgtggtccatgaaactcagctcgctatatacgaaacaaccaagcttgagtgcatgaaacagtggcctgtacgtgagtcatcagctccaatcacacatgccacattctcatgtgatagccaattgatatacacaagtttcatggatgctacaatttgtgtcttcacctctgcgaaccttcgattgcgttgcagagtcaatccctctgcgtatttgccagcgtctctcagcaactcaaatgtccatccactggtgattgcggctcatccccaagaatccaatatgtttgccgtgggtctctcagacggtggggtccatatattcgagccgcttgagtcagaaggtaaatggggagtggctccaccgcctgagaatggctcagccagtggtgttgcatctacaccttccgttggagcttccgcctccgatcagcctcaaagataatatgaaacaggtcctgctccaattttttactctgtttttttttgttggttttagatcttttccgaatttttttttggaagaaagcattcattctaacaaggtgaatgtattaatgtaacatatatatagcaaggtgaaacagttcctaattggttgattcgttgttgctttttttttggaatagtgattcgttgttgcttggttctactgtcttcttaagtttggagaaagaagtttggatgaatcttcaatctcaaatttttctaattt

SEQ ID NO: 9236 - DNA, 4007 bp, Eutrema halophilum
cgaagagagagaaaatcctttcctctagatagagagagagagaagaagctcctttttaatttctttctttcaagtttccttttttcggtagagagaaaaaagagtccaaaaatcaatccatcacctctttcgtctctggagagagaaacgttggtctttcatcgatctctttcttcctccatgagatgcgaagtttttggatggtttttcagatataggttcaatttctagttataagtattcagatctggtgatagttttggttggacttgtgcatctgagttgaaatagtctaaggaagtgagagaaacatgtcttctctaagtagagagctcgtgttcttgatcttacagtttctcgatgaggagaagtttaaagagactgttcacaagcttgagcaagaatctgggtttttcttcaatatgaagtattttgaggatgaggtgcataatggaaactgggatgaggttgagaagtatctctctggtttcacaaaagtagatgataatagatactcaatgaagatattcttcgagataagaaagcagaaatatctcgaggctttggataagcatgatcgtcccaaggccgtggatatactagtgaaggatttgaaagtgttttcaacttttaacgaggagctttttaaagaaataacgcagctcttgacgttagagaacttccgggagaatgaacagttatccaagtatggggacaccaagtctgcaagagctatcatgttggtggagctcaaaaagcttattgaggcgaatccgttgttccgtgataaactgcagtttcctactcttagaaattcaaggcttcgcactttgatcaaccagagcttaaattggcaacatcagctttgtaaaaatccaaggccaaatccggatataaagactctttttgtggatcattcgtgtggccctccaaatggtgcacgggcttcatcgcctgtgaacaatcctctgcttggaggattaccaaaagctggaggctttcctcctttaggcgcccacgggccatttcaaccaacggcctcacccgttccaacgcctcttgctggttggatgtctagtccatcctctgtcccacatcctgctgtgtctgcaggagccattgctcttggtggtccatcgatcccagcggcattgaagcacccgagaactcctccaactaatgctggtttagactacccgtcagcggattctgagcatgtctcaaaaagaacaaggcctatgggaatctcagacgaggtgaatctaggtgtgaacatgttgccaatgtcatttccagggcaggccgcccatgggcacagtccggctttcaaagcaccagatgacttgcccaagacagttgcacgaactttgactcagggctcatctcccatgagcatggatttccatccaattaaacagactctgcttctagttggtacaaatgtaggggatatcgggctgtgggaagttggatctcgggaaagattagtgcagaagaccttcaaagtctgggatttgagtaaatgttcaatgcccttacaggctgctctggtgaaagaacctgttgtttctgtcaaccgtgtgatatggagccctgacggttccttgtttggagttgcttactcgagacatatagtacaactatactcttatcatggaggtgaagacatgaggcaacaccttgagattgatgctcatgttggtggtgtgaatgatatttccttctcgactccaaacaagcaactatgtgtaataacctgtggagatgacaaaaccatcaaggtgtgggacgctgcaacgggtgtcaaaagacatacctttgaaggccatgaagctcctgtttactctgtctgtcctcactacaaggaaaatattcagttcatattctcgacagctctcgatgggaaaataaaggcatggttgtatgataatatgggttctcgagttgactatgatgcacctggtcgctggtgtacaacaatggcttatagtgctgatggaactaggttattctcttgtgggactagtaaagatggagagtcatacatagttgagtggaatgaaagtgaaggagctgtgaaaagaacttatcaaggattccacaagcgttctctcggtgttgtgcagtttgataccactaaaaaccgttatttagctgcgggtgatgacttttccattaagttctgggatatggacactgtacagcttttaactgccattgatggcgatggaggcctccaggcaagcccgcgtatccggtttaacaaagaaggctctctcttggctgtttctggaaacgagaatgtgatcaaggttatggcaaactcagatggtctaagactattgcacacttttgagaacatttcatctgaaacctccaagcctgcgataaacagcattgcagcggcagcagcagcagctgctacgagtgctggacttgcagatcgatcagccaatgtagtttccatgcaaggaatgaatggagattcgcggaatatggtggatgtgaagccagtgattacagaagaatcaaatgataagtctaagatatggaagcttactgaagtcagcgagccttctcaatgcaggtcactgagactccctgagaatttgagagttgctaagatatcaagattgattttcacgaattcaggaaacgctatcttggctttggcatcaaacgctattcatcttctatggaaatggcagcggaatgaccgcaacacaactggaaaggcgacagcttctttaccgcctcagcaatggcaaccagcaagtgggatcctcatgactaacgacgctgctgaaaccaatcccgaggaagctgtaccttgttttgctttatccaagaatgattcttatgtaatgtcggcctctggaggaaagatctccttatttaacatgatgacttttaagacgatggccactttcatgccaccaccgcctgctgccacttttcttgcttttcatcctcaagacaacaatattattgctatcggaatggatgatagtactattcagatttacaacgtccgtgttgatgaggtgaagagtaagcttaaaggtcattcgaagcgaattactggtcttgccttctccaacgtattaaatgtgctggtttcttctggagcagatgctcagctttgtgtttggaacacagatggatgggagaagcagagaagcaaggttctgccacttccacagggaagaccaaacgctgcaccttcagatacgcgtgttcagttccatcaagatcaagcgcacttcctcgtcgtgcacgagacgcagctcgctatctacgaaacaaccaagctcgaatgcatgaaacagtggccagtgagagaatcatcagctccgatcactcatgccaccttctcatgtgatagccaattggtctacgcgagttttatggatgctacgatttgtgtatttagctctgcaaatctaagattgcgttgccgggtcaacccttctgcgtatctaccagctagtctcagcaactcgaacgtacatccactggtgattgcggcacatccccaagaaccaaacatgtttgcggttggcctctcagacggaggagttcatattttcgaaccggttgagtcggaaggtaaatggggagtggctccaccagctgagaacgggtcagcaagcggtgcagtggccgcaccatcggttggagcctctgcctctgatcagccacagagataatctgattcaagagtcatctacctctctctctgattctcttttttcttttcttaagcatttttcgttttttttttttatttttggtagaaagatttatgacccagagattctaacatgtttagatgtaacatataatcacagcaatttagtagtaaatttggataaaaacagtgactgatgttgtttacgtctcttttccttatctttgaccttcacataaattttattttgtggcaagaaaagattttcaatttcaattatatacatgtgatacagaggatacttagaatttacata

SEQ ID NO: 9237 - DNA, 4014 bp, Eutrema halophilum
cgaagagagagaaaatcctttcctctagatagagagagagagaagaagctcctttttaatttctttctttcaagtttccttttttcggtagagagaaaaaagagtccaaaaatcaatccatcacctctttcgtctctggagagagaaacgttggtctttcatcgatctctttcttcctccatgagatgcgaagtttttggatggtttttcagatatagatctggtgatagttttggttggacttgtgcatctgagttgaaatagtctaaggaagtgagagaaacatgtcttctctaagtagagagctcgtgttcttgatcttacagtttctcgatgaggagaagtttaaagagactgttcacaagcttgagcaagaatctgggtttttcttcaatatgaagtattttgaggatgaggtgcataatggaaactgggatgaggttgagaagtatctctctggtttcacaaaagtagatgataatagatactcaatgaagatattcttcgagataagaaagcagaaatatctcgaggctttggataagcatgatcgtcccaaggccgtggatatactagtgaaggatttgaaagtgttttcaacttttaacgaggagctttttaaagaaataacgcagctcttgacgttagagaacttccgggagaatgaacagttatccaagtatggggacaccaagtctgcaagagctatcatgttggtggagctcaaaaagcttattgaggcgaatccgttgttccgtgataaactgcagtttcctactcttagaaattcaaggcttcgcactttgatcaaccagagcttaaattggcaacatcagctttgtaaaaatccaaggccaaatccggatataaagactctttttgtggatcattcgtgtggccctccaaatggtgcacgggcttcatcgcctgtgaacaatcctctgcttggaggattaccaaaagctggaggctttcctcctttaggcgcccacgggccatttcaaccaacggcctcacccgttccaacgcctcttgctggttggatgtctagtccatcctctgtcccacatcctgctgtgtctgcaggagccattgctcttggtggtccatcgatcccagcggcattgaagcacccgagaactcctccaactaatgctggtttagactacccgtcagcggattctgagcatgtctcaaaaagaacaaggcctatgggaatctcagacgaggtgaatctaggtgtgaacatgttgccaatgtcatttccagggcaggccgcccatgggcacagtccggctttcaaagcaccagatgacttgcccaagacagttgcacgaactttgactcagggctcatctcccatgagcatggatttccatccaattaaacagactctgcttctagttggtacaaatgtaggggatatcgggctgtgggaagttggatctcgggaaagattagtgcagaagaccttcaaagtctgggatttgagtaaatgttcaatgcccttacaggctgctctggtgaaagaacctgttgtttctgtcaaccgtgtgatatggagccctgacggttccttgtttggagttgcttactcgagacatatagtacaactatactcttatcatggaggtgaagacatgaggcaacaccttgagattgatgctcatgttggtggtgtgaatgatatttccttctcgactccaaacaagcaactatgtgtaataacctgtggagatgacaaaaccatcaaggtgtgggacgctgcaacgggtgtcaaaagacatacctttgaaggccatgaagctcctgtttactctgtctgtcctcactacaaggaaaatattcagttcatattctcgacagctctcgatgggaaaataaaggcatggttgtatgataatatgggttctcgagttgactatgatgcacctggtcgctggtgtacaacaatggcttatagtgctgatggaactaggttattctcttgtgggactagtaaagatggagagtcatacatagttgagtggaatgaaagtgaaggagctgtgaaaagaacttatcaaggattccacaagcgttctctcggtgttgtgcagtttgataccactaaaaaccgttatttagctgcgggtgatgacttttccattaagttctgggatatggacactgtacagcttttaactgccattgatggcgatggaggcctccaggcaagcccgcgtatccggtttaacaaagaaggctctctcttggctgtttctggaaacgagaatgtgatcaaggttatggcaaactcagatggtctaagactattgcacacttttgagaacatttcatctgaaacctccaagcctgcgataaacagcattgcagcggcagcagcagcagctgctacgagtgctggacttgcagatcgatcagccaatgtagtttccatgcaaggaatgaatggagattcgcggaatatggtggatgtgaagccagtgattacagaagaatcaaatgataagtctaagatatggaagcttactgaagtcagcgagccttctcaatgcaggtcactgagactccctgagaatttgagagttgctaagatatcaagattgattttcacgaattcaggaaacgctatcttggctttggcatcaaacgctattcatcttctatggaaatggcagcggaatgaccgcaacacaactggaaaggcgacagcttctttaccgcctcagcaatggcaaccagcaagtgggatcctcatgactaacgacgctgctgaaaccaatcccgaggaagctgtaccttgttttgctttatccaagaatgattcttatgtaatgtcggcctctggaggaaagatctccttatttaacatgatgacttttaagacgatggccactttcatgccaccaccgcctgctgccacttttcttgcttttcatcctcaagacaacaatattattgctatcggaatggatgatagtactattcagatttacaacgtccgtgttgatgaggtgaagagtaagcttaaaggtcattcgaagcgaattactggtcttgccttctccaacgtattaaatgtgctggtttcttctggagcagatgctcagctttgtgtttggaacacagatggatgggagaagcagagaagcaaggttctgccacttccacagggaagaccaaacgctgcaccttcagatacgcgtgttcagttccatcaagatcaagcgcacttcctcgtcgtgcacgagacgcagctcgctatctacgaaacaaccaagctcgaatgcatgaaacagtggccagtgagagaatcatcagctccgatcactcatgccaccttctcatgtgatagccaattggtctacgcgagttttatggatgctacgatttgtgtatttagctctgcaaatctaagattgcgttgccgggtcaacccttctgcgtatctaccagctagtctcagcaactcgaacgtacatccactggtgattgcggcacatccccaagaaccaaacatgtttgcggttggcctctcagacggaggagttcatattttcgaaccggttgagtcggaaggtaaatggggagtggctccaccagctgagaacgggtcagcaagcggtgcagtggccgcaccatcggttggagcctctgcctctgatcagccacagagataatctgattcaagagtcatctacctctctctctgattctcttttttcttttcttaagcatttttcgttttttttttttatttttggtagaaagatttatgacccagagattctaacatgtttagatgtaacatataatcacagcaatttagtagtaaatttggataaaaacagtgactgatgttgtttacgtctcttttccttatctttgaccttcacataaattttattttgtggcaagaaaagattttcaatttcaattatatacatgtgatacagaggatacttagaatttacataaatttacaagagtgattagtttcttctgatagtt

SEQ ID NO: 9238 - DNA, 3779 bp, Eutrema parvulum
aaaaccaaatccttcgcctctttcatctgaggagagagaaactgaagctctctggccttccttgtgaaatctctttctctctctctcttcttcatgatctggtgatagatttggtgggttttctgcatctgagttgaaaacgtctccgagtgagtaaaaacatgtcttctcttagtagagagctcgtcttcttgatcttacagtttctagatgaagagaagttcaaagagactgttcataagcttgaacaagaatctgggtttttcttcaatatgaagtattttgaggatgaggtgcacaatggaaactgggatgaggtggagaagtatctctctggttttacaaaagtagatgataatagatactccatgaagatattcttcgagataaggaagcagaagtatctcgaggcgttggataagcatgatcgtccaaaggctgtagaaattttagtcaaagatttgaaagtcttttccacttttaatgaggagcttttcaaggaaatcactcagctcttgaccttagaaaacttccgggagaacgagcagttatccaagtatggagacacaaagtcagccagagctatcatgctggtggaactaaagaagttgattgaagcaaatccattattccgtgataaactgcagtttcctactcttagaaattcacggctgaggacgctgattaaccagagcttaaattggcaacatcagctttgtaaaaacccaaggccaaatcctgatataaagactctctttgtggatcactcctgtcgcttaccaaatgatgcacgagcaccatcccctgtcaacaacccgctgcttggatcattaccaaaagctgggggatttcctcctttaggcgcacatgggccattccaaccaacaccttctccggttccgacacctcttgctggttggatgtctagtccttcctctgtccctcatccagctgtgtctggaggagccatagctcttggtgctccatccatccaagccttgaagcacccgagaactcctccaagtaattctgctgtagactatgcattgggtgattcggaccatgtctcaaaaagaacaagacccatgggaatctctgacgaggtgaatctaggtgtcaacatgttgccaatgacattcccggggcaggcccatggtcatacccaaaccttcaaagcacccgatgacttgcctaagacagtagcacgaactttgagccaagggtcatctcccatgagcatggattttcatccgatcaaacagactcttctactagttggtacaaacgtaggggatattggcctctgggaagtcggttctcgagaacgtctagtacagaagactttcaaagtttgggacttgagtaaatgttcaatgcccttgcaggctgctttggtgaaagaacctgtcgtttcggtcaaccgtgtgatttggagcccggatggttccttattcggagttgcttattccagacatattgtacagctatactcttatcacggtggtgaagatatgaggcaacacctcgagattgatgctcatgttggtggtgtaaatgacattgcattctccactccaaacaagcaactatgtgttactacttgtggtgatgacaaaaccatcaaggtctgggatgctgcaacgggtgtaaaacggcatacttttgaaggccatgaagctcctgtttactctatctgccctcactacaaggaaaacattcagttcatcttttcaactgcgcttgacggaaaaattaaagcgtggctatatgataatatgggttctcgggttgactacgaagctcctggtcgctggtgtacaacgatggcctacagtgctgatggaactaggctattttcttgtgggacgagtaaagatggggattcgtacatcgttgagtggaacgaaagcgaaggagctgttaaaagaacttatcaaggattccacaagcgttctcttggtgtcgttcagtttgatactacgaaaaaccgctatcttgctgcgggtgatgacttctccattaagttctgggatatggacaatatacagcttttgactgcaattgatgctgatgggggtctccaggcaagcccacggatccggtttaacaaggaaggctctctcttggccgtctctgccaatgacaatatgattaaggttatggcaaacacagatggtctaaggttattgcacactgtcgagaacttatctactgaatcctccaagcctgcagttaacaacattgcggtggcagagagacctgctgagagacctgcctctgtggtttccatccccggaatgaatggagattcgcgaaatatggtggatgtgaagccagtgatcactgaagaatcaaatgataagtctaaaatatggaagcttactgaagtcggtgaaccctctcaatgccgttcgttgagacttcctgagaatatgagagtcaccaagatatcgagattgattttcacaaattctggaaatgcgatattggcattggcatcaaatgctattcatctgctttggaaatggcagcgaaatgaccgtaacgcaactggaaaggcaacggcttctttacctcctcagcagtggcaaccagcgagcggaatcttaatgacaaacgatgtgactgaaactaattcagaggaagctgtaccgtgttttgctttatccaagaatgattcctatgtcatgtcagcatctggaggaaagatttctttatttaatatgatgacgtttaagacaatggctactttcatgccgccgccccctgctgcaacgtttctggcatttcaccctcaggacaacaatataattgcaattggaatggatgatagtacaatacagatttataatgttcgcgttgatgaggtcaagagcaagcttaaaggacattctaagagaataaccggcctcgccttctccaacgtactaaacgttctggtttcatctggggcagacgctcagctttgtgtatggaacacagatggatgggagaagcagaaaagcaaggttctgcaaattccacagggaagattgacgggtgctctttcagacacgcgtgttcagtttcatcaagatcaagtacacttcctcgtggtccatgaaactcagctcgctatatatgaaacaaccaagcttgaatgcatgaaacagtggcctgtgcgtgaatcatcagctccaatcacatatgccacgttctcatgtgatagccaattgatatacacaagtttcatggatgctacaatttgtgtcttcacctctgcgaaccttcgattgcgttgcagagtcaatccctctgcgtatttgccagcgtctctcagcaactcaaatgtccatccactggtgattgcggctcatccccaagaatccaatatgtttgccgtgggtctctcagacggtggggtccatatattcgagccgcttgagtcagaaggtaaatggggagtggctccaccgcctgagaatggctcagccagtggtgttgcatctacaccttccgttggagcttccgcctccgatcagcctcaaagataatatgaaacaggtcctgctccaaaggtgaatgtattaatgtaacatatatatagcaaggtgaaacagttcctaattggttgattcgttgttgctttttttttggaatagtgattcgttgttgcttggttctactgtcttcttaagtttggagaaagaagtttggatgaatcttcaatctcaaatttttctaatttggtgcagagtcccatcatttcacaaaaacaactgggagaaaaaagttataac

SEQ ID NO: 9239 - DNA, 3938 bp, Arabidopsis lyrata
cgaagagagagaaaatccctttctctagatagagagagagagaagaagaagcttttttattttctttctttcaagtttccttttttcgatagagagaaaaagagtccaaaaatcaatccatcacctatttcgtctctgtggtcttcatcgatctctctttcttctttcatgagatgcgaagtttctggatattttttcagatatagatctggtgatagttttggtaggtgttgtgaatctgatttaaggaagtgagaaaaaaacatgtcttctcttagtagagagctcgttttcttgatcttacagtttcttgatgaagagaagtttaaagagactgttcacaagcttgaacaagaatctgggtttttcttcaatatgaagtattttgaggatgaggtgcacaatggtaattgggatgaggttgagaagtatctctctggtttcactaaagtagatgataatcgatactctatgaagattttcttcgagataagaaagcagaagtatctcgaggctttggataagcatgatcgtcccaaggctgtggatatactagtgaaggatttgaaagtgttttcaacttttaatgaggagcttttcaaggaaataacgcagctcttgacattggagaacttccgggagaatgaacagctgtccaagtatggggacaccaagtctgcaagagctatcatgttggtggaactcaaaaagctgattgaggcgaatccgttgttccgtgataaattgcagttccctactcttagaaattcaaggctgaggactttgatcaaccagagcttaaattggcagcatcagctttgtaaaaatccaaggccaaatccagatataaagactctttttgtggatcactcttgtggtcctccaaatggcgcacgggctccatcgcctgtgaacaatcctctgcttggaggaataccaaaggctggaggatttcctcctttaggcgcacacgggccatttcaaccaacggcgtcacccgttccaacgcctcttgctggttggatgtctagtccatcctctgtcccacatccagctgtctcagcaggagccattgcacttggtggtccatcaatcccagctgcattgaagcacccgagaactcctccaactaatgctgctttagactacccgtcagcagattctgaacatgtctcaaaaagaacaaggccaatgggaatctctgacgaggtgaatctaggcgtgaacatgttaccgatgtcattttcagggcaggcccatggtcatactccggcttttaaagcacctgatgacttgcccaagacagttgcgcgaactttgagtcagggctcatctcccatgagcatggatttccatccaattaaacagactctgcttctagttggtacaaatgtaggtgatatcgggctgtgggaagttggttctcgcgaaagattagtacagaagaccttcaaagtctgggatttgagtaaatgttcaatgcccttgcaggctgctctggtgaaagaacctgtcgtttctgtcaaccgtgtgatatggagccctgacggttccttgtttggagttgcttactcgagacatattgtacaactatattcttatcacggaggtgaagacatgaggcaacaccttgagattgatgctcatgttggtggtgtgaatgatatttccttctcgactccaaacaagcaactatgtgtaataacttgtggtgatgacaaaaccatcaaggtttgggacgctgcaacaggtgtcaaaaggcatacttttgaaggccatgaagctcctgtttattctgtttgtcctcattacaaggaaaacattcagttcatattttcaacagctcttgatgggaaaattaaggcttggttgtatgataatatgggttcccgagttgactatgatgcacctggtcgctggtgtactacaatggcttatagtgccgatggtactaggctattctcttgtgggacgagtaaagatggagagtctttcattgttgagtggaatgaaagcgaaggagctgttaaaagaacttatcaaggattccacaagcgttctctaggtgttgtgcagtttgatacaacgaaaaaccgttatctagctgcgggtgatgatttctccatcaagttctgggatatggacactgtacagcttttaactgccattgatggcgatggaggcctccaggcaagcccgcgtatccggtttaacaaggaaggctctctcttggccgtgtctggaaacgagaatgtgatcaagattatggccaactcagatggtctaaggctattgcacacttttgagaacatatcatctgaatcctccaagcctgcaataaacagcattgcagcggcagcggcagctgctgcaacgagtgctggtcacgcagatcgatcagccaatgtagtttccatccaaggaatgaatggagattcgcggaatatggtggatgtgaagccagtgattactgaagaatcaaatgataagtctaagatatggaagcttactgaagtcagcgagccttctcaatgcaggtcactgagactccctgagaatctgagagtcgccaagatatcaagattgattttcacgaattcgggaaacgcaattttggctttggcatcaaacgccattcatcttctatggaaatggcagcggaatgagcgcaacgcaactggaaaggcgacagcttctttaccgcctcagcagtggcaaccagctagtgggatcctcatgactaacgacgttgctgaaaccaatactaccgaggaagctgtaccttgttttgctttatccaagaatgattcatatgtaatgtcagcctccggaggaaagatctccttatttaacatgatgacgtttaagacaatggcgactttcatgcccccaccgccggctgcaacttttcttgcttttcatcctcaagacaacaatatcatcgctatcggaatggatgatagcacgattcagatttataacgtccgtgttgatgaggtgaagagtaaacttaaaggtcattcaaagagaataactggtcttgccttctccaacgtattaaacgtgttggtttcgtctggagcagatgcacagctctgtgtttggaacacagatggatgggaaaagcagagaagcaaggttttgccacttccacagggaagaccaaacagtgccccttcagatacgcgtgttcagttccatcaagatcaagctcacttcctcgttgtgcacgagacgcagctcgctatatacgaaacgaccaagctcgaatgcatgaaacagtgggctgtacgagaatcattagctccaatcactcatgccacattctcatgcgatagccaattggtctacgcgagttttatggatgcaacagtttgtgtatttagctctgcaaatctaagattgcgttgccgggtcaacccttctgcgtatctaccagctagcctcagcaattcaaacgtacatccactagtgattgcggcacatccgcaagaaccaaacatgtttgcagttggtctctcagacgggggagtgcacatattcgaaccgctcgagtctgaaagtaaatggggagtcgctccacctgctgagaacgggtcggctagcggggcagccactgcaccttccgttggagcctctgcatctgatcagcctcagagataatctgagccgagagtcacctacctctctgattccctttcttctttttaaaagtctttctttttattttatttttttggtagaaagatttatgacccaaagattctaacatttagatgtaacatattattcacagtaattcagtagtaaagttggataaaaacagtgactgatgttgtttctctctctttccttttctgagattttaccttcacatagattttcttttgtgcaagattttcatttatgtaatacaatcgatgtttcgaatttacata

SEQ ID NO: 9240 - DNA, 3944 bp, Arabidopsis lyrata
cgaagagagagaaaatccctttctctagatagagagagagagaagaagaagcttttttattttctttctttcaagtttccttttttcgatagagagaaaaagagtccaaaaatcaatccatcacctatttcgtctctgtggtcttcatcgatctctctttcttctttcatgagatgcgaagtttctggatattttttcagatatagatctggtgatagttttggtaggtgttgtgaatctgacttgaaaaagtctttaaggaagtgagaaaaaaacatgtcttctcttagtagagagctcgttttcttgatcttacagtttcttgatgaagagaagtttaaagagactgttcacaagcttgaacaagaatctgggtttttcttcaatatgaagtattttgaggatgaggtgcacaatggtaattgggatgaggttgagaagtatctctctggtttcactaaagtagatgataatcgatactctatgaagattttcttcgagataagaaagcagaagtatctcgaggctttggataagcatgatcgtcccaaggctgtggatatactagtgaaggatttgaaagtgttttcaacttttaatgaggagcttttcaaggaaataacgcagctcttgacattggagaacttccgggagaatgaacagctgtccaagtatggggacaccaagtctgcaagagctatcatgttggtggaactcaaaaagctgattgaggcgaatccgttgttccgtgataaattgcagttccctactcttagaaattcaaggctgaggactttgatcaaccagagcttaaattggcagcatcagctttgtaaaaatccaaggccaaatccagatataaagactctttttgtggatcactcttgtggtcctccaaatggcgcacgggctccatcgcctgtgaacaatcctctgcttggaggaataccaaaggctggaggatttcctcctttaggcgcacacgggccatttcaaccaacggcgtcacccgttccaacgcctcttgctggttggatgtctagtccatcctctgtcccacatccagctgtctcagcaggagccattgcacttggtggtccatcaatcccagctgcattgaagcacccgagaactcctccaactaatgctgctttagactacccgtcagcagattctgaacatgtctcaaaaagaacaaggccaatgggaatctctgacgaggtgaatctaggcgtgaacatgttaccgatgtcattttcagggcaggcccatggtcatactccggcttttaaagcacctgatgacttgcccaagacagttgcgcgaactttgagtcagggctcatctcccatgagcatggatttccatccaattaaacagactctgcttctagttggtacaaatgtaggtgatatcgggctgtgggaagttggttctcgcgaaagattagtacagaagaccttcaaagtctgggatttgagtaaatgttcaatgcccttgcaggctgctctggtgaaagaacctgtcgtttctgtcaaccgtgtgatatggagccctgacggttccttgtttggagttgcttactcgagacatattgtacaactatattcttatcacggaggtgaagacatgaggcaacaccttgagattgatgctcatgttggtggtgtgaatgatatttccttctcgactccaaacaagcaactatgtgtaataacttgtggtgatgacaaaaccatcaaggtttgggacgctgcaacaggtgtcaaaaggcatacttttgaaggccatgaagctcctgtttattctgtttgtcctcattacaaggaaaacattcagttcatattttcaacagctcttgatgggaaaattaaggcttggttgtatgataatatgggttcccgagttgactatgatgcacctggtcgctggtgtactacaatggcttatagtgccgatggtactaggctattctcttgtgggacgagtaaagatggagagtctttcattgttgagtggaatgaaagcgaaggagctgttaaaagaacttatcaaggattccacaagcgttctctaggtgttgtgcagtttgatacaacgaaaaaccgttatctagctgcgggtgatgatttctccatcaagttctgggatatggacactgtacagcttttaactgccattgatggcgatggaggcctccaggcaagcccgcgtatccggtttaacaaggaaggctctctcttggccgtgtctggaaacgagaatgtgatcaagattatggccaactcagatggtctaaggctattgcacacttttgagaacatatcatctgaatcctccaagcctgcaataaacagcattgcagcggcagcggcagctgctgcaacgagtgctggtcacgcagatcgatcagccaatgtagtttccatccaaggaatgaatggagattcgcggaatatggtggatgtgaagccagtgattactgaagaatcaaatgataagtctaagatatggaagcttactgaagtcagcgagccttctcaatgcaggtcactgagactccctgagaatctgagagtcgccaagatatcaagattgattttcacgaattcgggaaacgcaattttggctttggcatcaaacgccattcatcttctatggaaatggcagcggaatgagcgcaacgcaactggaaaggcgacagcttctttaccgcctcagcagtggcaaccagctagtgggatcctcatgactaacgacgttgctgaaaccaatactaccgaggaagctgtaccttgttttgctttatccaagaatgattcatatgtaatgtcagcctccggaggaaagatctccttatttaacatgatgacgtttaagacaatggcgactttcatgcccccaccgccggctgcaacttttcttgcttttcatcctcaagacaacaatatcatcgctatcggaatggatgatagcacgattcagatttataacgtccgtgttgatgaggtgaagagtaaacttaaaggtcattcaaagagaataactggtcttgccttctccaacgtattaaacgtgttggtttcgtctggagcagatgcacagctctgtgtttggaacacagatggatgggaaaagcagagaagcaaggttttgccacttccacagggaagaccaaacagtgccccttcagatacgcgtgttcagttccatcaagatcaagctcacttcctcgttgtgcacgagacgcagctcgctatatacgaaacgaccaagctcgaatgcatgaaacagtgggctgtacgagaatcattagctccaatcactcatgccacattctcatgcgatagccaattggtctacgcgagttttatggatgcaacagtttgtgtatttagctctgcaaatctaagattgcgttgccgggtcaacccttctgcgtatctaccagctagcctcagcaattcaaacgtacatccactagtgattgcggcacatccgcaagaaccaaacatgtttgcagttggtctctcagacgggggagtgcacatattcgaaccgctcgagtctgaaagtaaatggggagtcgctccacctgctgagaacgggtcggctagcggggcagccactgcaccttccgttggagcctctgcatctgatcagcctcagagataatctgagccgagagtcacctacctctctgattccctttcttctttttaaaagtctttctttttattttatttttttggtagaaagatttatgacccaaagattctaacatttagatgtaacatattattcacagtaattcagtagtaaagttggataaaaacagtgactgatgttgtttctctctctttccttttctgagattttaccttcacatagattttcttttgtgcaagattttcatttatgtaatacaatcgatgtttcgaatt

SEQ ID NO: 9241 - DNA, 3631 bp, Brassica napus
tatttttctttctttcttttgagtaccctaaaaagtacaatcaatctcttcttcttctttccgtcgtatcctctttcttccttcatggtaagtaaagcttcgtctctgttttatttctctcctaccctttatgatctggtgatagtgtttggtggtctgagttgaaaaaagtctcatgtcttctcttagtagagagcttgtgttcctgatcttacagtttctcgatgaagagaagtttaaagagactgttcacaagcttgaacaagaatctggatttttcttcaacatgaagtactttgaggacgaggtgcataacggaaactgggatgaggttgagaagtatctctctggtttcactaaagtggatgataatagatactctatgaagatattcttcgagataagaaagcagaagtatctcgaggctttggataagcatgatcgtcccaaggcggtggagatactagtgaaggatttgaaagtgttttcaacttttaacgaggagcttttcaaagagataactcagctcttgacgttagagaacttcagggagaatgaacagttatcaaagtatggggacaccaagtccgcaagatcgatcatgttggtggaactcaagaagcttatcgaggcgaatcctttgttccgtgataaactgcagtttcctactcttagaaactcaaggcttaggactcttatcaaccagagcttaaattggcaacatcagctttgtaaaaacccaaggccaaatccggatataaagactctttttgttgatcattcgtgtggtcctccaaatggtgcacgtgctccatctcctgtgagcaatccactgcttggtggattgccaaaagctggagggtttcctcctttaggcgcacacgggccgtttcaaccaacggcctcacccgttccaactcctcttgctggttggatgtctagtccctcctctgtcccacatccagctgtttctgcaggacccattgctcttggtggtccttctatcccagcggcgttgaagcatccgagaacacctccaactaatcctgctttagactacccatcagcagagtctgaacacgtctcgaaaagaacaaggcctatgggaatctctgaggaagtgagtctaggtgtcaacatgttgccaatgtcatttccagggcaggctcatggtcacagtccagctttcaaagcacctgatgacttgcctaagacggttgcacgaactttgactcagggctcatctcccatgagcatggatttccatccaattaaacagactctacttctagttggtactaatgtaggagatattgggctatgggaagttggttctcgagaaagattagtacagaagaccttcaaagtctgggatataagtaaatgttcaatgcctttacaggctgctctggtgaaagagcctgttgtatctgtcaaccgtgtgatatggagcccagacggttccctgttcggagttgcctactcgagacatattgtgcaactatactcttaccatggaggtgaagacatgaggcaacaccttgagattgatgctcacgttggtggtgtgaatgatatttccttctcgactccaaacaagcaactgtgtgtgataacctgcggtgatgacaaaaccatcaaggtctgggacgctgcgactggtgtcaaaagacatacttttgaaggccatgaagctcctgtttactccgtttgtcctcactacaaggaaaacattcaattcatattttctacagcactcgatgggaaaataaaggcatggttgtatgataacatgggttctcgagttgactacgatgcacctggtcgctggtgtaccacaatggcttacagtgcggatggaactaggctattctcttgtggaacaagcaaagatggagagtcttacatagttgagtggaatgaaagcgaaggagctgttaaaagaacttatcaaggattccacaagcgttctctcggtgttgtgcagtttgacacaactaaaaaccgttatctagctgctggcgatgacttctccatcaagttctgggatatggacaatgtgcagcttttaaccgccattgatggtgacggaggcctccaggcaagcccgcgtatccggtttaacaaggaaggatctctcttggctgtgtctggaaacgaaaatgtgattaaggttatggcaaactcggatggtttgagattgttgcacacttttgagaacgtttcatctgaatcctctaagcctgcaataaacagtcttgcagcggcagctgctgctacgagtgctgcagcagatcgatcagccaatgtggtttccatccaagcaatgaatggagatgcgaggagtatggtggatgtgaagccagtgattacagaggaatcaaatgataagtccaagatatggaagcttactgaagtcagcgagccttctcaatgcaggtcactgagactacctgagaatctgagagtggctaagatatcaagattgattttcaccaactcaggaaacgctattttggctttggcatcaaacgctattcatcttctgtggaaatggcagaggaatgagcgcaacgcaactggaaaggcaacagcttctttaccacctcagcaatggcaaccagcaagtgggatactcatgactaacgacgcagctgaaaacaaccctgaggaagcagtaccttgttttgctttatccaagaatgattcgtatgtaatgtcagcctccggtggaaagatctccttgtttaacatgatgacgtttaagacgatggctacttttatgccaccgccgcctgctgcaacttttcttgcattccatcctcaagacaataacatcattgctatcggaatggatgatagtactattcagatttataacgtccgtgttgatgaggtgaagagtaagcttaaaggtcattcaaagagaataactggtcttgccttctccaatgtgttgaatgtgctggtttcttctggagctgatgctcagctttgtgtttggaacacagatggatgggagaagcaaagaagcaaggttctgccacttccacagggaagaccaaacactgcaccttcagacacgcgtgttcaattccaccaagatcaagctcacttcctcgtggtgcacgagacgcagcttgctatttatgaaacaacgaagctcgaatgcatgaaacagtggccagtgagagaatcatcagctccgatcactcatgccacgttctcatgtgatagccaattggtctatgcgagttttatggatgcaacgatttgtgtatttagctctgctaatctaaggttgcgttgccgagtcaacccttctacgtatctaccagctagtctcagtaactcgaacgtacatcctctggtgattgcggcacatccgcaagaaccaaacatgtttgcagttggtctctcagacggaggtgttcatatattcgaaccggttgagtcggaaggtaaatggggagtggctccacctgctgagaatgggtctgcaaatggcgcagttgctacaccatccgttggagcctctgcttctgatcagccacagagatgatctgatcatagattcacctacctctccgattctctttcttgtttaaagtctttcctttttaaatttttt

SEQ ID NO: 9242 - DNA, 3937 bp, Eutrema parvulum
gaagagagagaaaatcccttctctagatagatagagagagagaagaagaagaaagtctttttttttctttctttcaagtttccttttttcggtagagagaaaaaagagtccaaaaatcaatccacacctgtttcttctctggagagagaaaggttggtcttcatcgatctctttcttcctccatgagatgcgaagtttgtggataatttttcagatataggttcaatttctagttataagtattcagatctggtgatagttttggtgggtattgtgcatctgagttgaaaagagtctaggggagtgagaggaacatgtcttctcttagtcgagagctcgtgttcttgatcttacagtttctcgatgaagagaagtttaaagagactgttcacaagcttgaacaagaatctgggtttttcttcaatatgaagtattttgaggatgaggtgcacaacggaaactgggatgaggtcgagaagtatctctctggtttcacaaaagttgatgataatagatactcaatgaagatattcttcgagatacgaaagcagaaatatctcgaggctttggataagcatgatcgtcccaaggccgtggacatactagtgaaggatttgaaagtgttttcaacttttaacgaggagctttttaaggaaataacgcagctcttgacgttagagaacttccgggagaatgaacagttatccaagtatggggacaccaagtcggcaagatcgatcatgttggtggaactcaaaaagttgattgaggcgaatccgttattccgcgataaattgcagtttcctactcttagaaattcaaggctgagaactttgatcaaccagagcttaaattggcaacatcagctttgtaaaaatccaaggccaaatccggatataaagacactttttgtggatcattcgtgtggccctccaaatggggcacgggctccatcgcctgtgaacaatccgctgcttggaggattaccgaaagctggaggatttcctcctttaggcgcacacgggccatttcaaccaacggcctcaccggttccaacgcctcttgctggttggatgtctagtccatcctctgtcccacatccagctgtgtctgcaggagccattgctcttggtggtccatcaatcccagcggcattgaagcacccgagaacccctccaactaatgctgctttagactacccgtcagcagagtctgaacatgtctcgaaaagaacaaggcctatgggaatctctgacgaggtgaatctaggtgtgaacatgctgccaatgtcatttccagggcaggcccatggtcacggtccggctttcaaggcacctgatgacttgcccaagacagttgcacgaactttgactcagggctcatctcccatgagcatggatttccatccaattaaacagactctgcttctagttggtacaaatgtaggtgatatcggcctgtgggaagttggttctcgggaaagattagtacagaagaccttcaaagtctgggatataagtaaatgttcaatgcccttacaggctgctctggtgaaagaacctgtcgtatctgtcaaccgcgtgatatggagccctgatggttccttgttcggagttgcttactcgagacatattgtacaactatactcttatcatggaggtgaagacatgaggcaacaccttgagattgatgctcatgttggtggtgtgaatgatatttccttctcaactccaaataagcaactgtgtgtgataacctgtggtgatgacaaaaccatcaaggtctgggacgctgcaacaggtgtcaagagacatacttttgagggccatgaagctcctgtttactccgtctgtcctcactacaaggaaaacattcaattcatattttcgacagctctcgatgggaaaattaaggcatggttgtatgataatatgggttctcgagttgactatgatgcacctggtcgctggtgtactacaatggcttatagtgccgatggaactaggctattctcttgtggaacaagtaaagatggagagtcttacatagttgagtggaatgaaagtgaaggagctgttaaaagaacttatcaaggattccacaagcgctctctcggtgttgtgcagtttgatacaactaaaaaccgttatctagctgcgggtgatgacttttccatcaagttctgggatatggacactgtacagcttttaactgccattgatggcgatggaggcctccaggcaagcccgcgtatccggtttaacaaggaaggctctctcttggccgtctctggaaacgagaatgtgatcaaggttatggcaaactcagatggtctaagactattgcacacttttgagaacatttcgtctgaatcctccaagcctgcgataaacagccttgcagcagcagctgctgcagctgctgctacgagtgctggactcacagatcgatcagccaatgtagtttccatccaaggaatgaatggagattcacggaatatggtggatgtgaagccagtgattacggaagaatcaaatgataagtctaagatatggaagcttactgaagtcagcgagccttctcaatgcaggtcactgagactccctgagaatctgagagtcgctaagatatcaagattgattttcacgaattcaggaaacgctatcttggctttggcatcaaacgctattcatcttctatggaaatggcagcggaatgaccgcaacacaactggaaaggcgacagcttctttaccgcctcagcaatggcaaccagcaagtgggatcctcatgactaacgacgctgctgaaaacaatcccgaggaagctgtaccttgttttgctttatccaagaatgattcatatgtaatgtcagcctctggtggaaagatctccttatttaacatgatgacatttaagacgatggctactttcatgccaccaccgcctgctgcaacttttcttgctttccatcctcaagacaacaatatcattgctatcggaatggatgatagtacgattcagatatataatgtccgtgttgatgaggtgaagagtaagcttaaaggtcattcaaagagaataacaggtcttgccttctccaacgtgttaaatgtgctggtttcctctggagcagatgctcagctttgtgtatggaacacagatggatgggagaagcagagaaacaaggttctgccacttccacagggaagaccaaacactgcaccttcagatacacgtgttcaattccatcaagatcaagctcacttcctcgtcgtgcacgagacacagcttgctatctacgaaacaaccaagcttgaatgcatgaaacagtggccagtgagagaatcatcagctccgatcactcatgcaacgttttcatgtgatagccaattggtctacgcgagttttatggatgcaacgatctgtgtatttagctctgcaaatctgagattgcgttgccgggtcaacccttctgcgtatctaccagctagcctcagcaactcgaacgtacatccactggtgattgcggcacatccgcaagaaccaaacatgtttgcggtcggcctctcagacggaggagttcatatattcgaaccagttgagtcggaaggtaaatggggagtggctccaccggctgagaacgggtcagcaagcggcgcagtggctgcaccatccgttggagcctccgcctctgatcagccacagagatgatctgatccgagagtcatctacctcttttccttccttttaaaagtctttcttttttattttttggtagaaatatttattatgacccagagattctaacatgtcttagctgtaacatatattcacagtaatttagtagtaaagttgtttctctcttttccttaccttagctttgacccttccaagattttcttttgtgccagaaaagattttcaattttctcaatt

SEQ ID NO: 9243 - DNA, 3828 bp, Arabidopsis thaliana
gagagagaaaacttgttttttttttttccattagtttttttcttactttctggtcgagagaggagagtccaaaaaacccaaatccttggcctctttcaatatcaggagagagaaactgaagctctggcctttgtttctgaaatcgatcgtcttcttcttcttcatggttatcatcgtcgccattatattgatatgcagatctggtgggtttttctgcatctgacttgatagctttatcggactgagtggcaaaatcaatcatgtcttctctgagcagagagctcgtcttcttgatcttacagtttttagatgaagagaagtttaaagagactgttcataagcttgaacaagaatctgggtttttcttcaatatgaagtattttgaggatgaggtgcacaatggtaactgggatgaggttgagaagtatctctctggttttactaaagttgatgataatcgatactccatgaagattttcttcgagattaggaagcagaagtatctcgaggccttggataggcatgatcgtcccaaggctgtcgatattttagtcaaagatttgaaagtgttttccacttttaatgaggagcttttcaaggaaatcactcagctcttgaccttagaaaacttcagggagaacgagcagttatccaagtatggggacacaaagtccgccagagctatcatgttggtggaactcaagaagttgattgaagctaatcctttattccgtgataaattgcagtttcctacccttagaacttcacgcctcaggactctgattaatcagagcttaaattggcaacaccagctttgtaagaacccaaggcctaatcctgatattaagactctctttgtcgatcattcctgccgcctaccaaatgatgcacgagcaccatcccctgtcaacaatccgcttcttggatcattaccaaaagccgagggatttcctcctctaggcgcacacgggccttttcaaccaacaccttctccggttccgacacctcttgctggttggatgtctagtccttcctctgtcccacatccagctgtgtctggaggacccattgctcttggtgctccatccatccaagcagccttgaaacacccgagaactcctccttctaattccgctgtagactatccatcaggtgactcagaccatgtctcaaagcgaaccagacctatgggaatctctgacgaggtgagtctaggtgtgaacatgttaccaatgacattcccggggcaggctcatggtcataatcaaaccttcaaagcacctgatgacttgcccaagacagttgcacgaactttgagccaaggctcatctcccatgagcatggatttccatcctattaaacagactctgctactagttggtacgaatgtaggggatattgggctctgggaagtcggttctcgagaacgtctagtccagaagactttcaaagtttgggacttgagtaaatgttcgatgcccttgcaggctgctttggtgaaagaacctgtcgtttctgtcaaccgtgtgatttggagcccggacggttccctattcggagttgcttattcgagacatattgtacagctatactcttatcacggtggtgaagacatgaggcaacaccttgagattgatgctcatgttggcggtgtcaatgacattgcattttccactccgaacaagcaactatgtgttactacttgtggtgatgacaaaaccatcaaggtctgggatgctgcaacgggtgtaaaacggtatacttttgaaggccatgaagctcctgtttactctatctgccctcactacaaggaaaacattcagtttatcttttcaactgctcttgacggaaaaataaaagcatggttatatgataatatgggttctcgggttgactacgaagctcctggtcgctggtgtacaacgatggcctacagtgctgatggaactaggctattttcttgtgggacgagtaaagatggggaatcgttcatagttgagtggaatgaaagcgaaggagctgtgaagagaacttatcaaggattccacaagcgttcccttggtgttgtccagtttgatactactaaaaaccgttatctcgctgcgggtgacgacttctccattaagttctgggatatggacaccatacagcttttgactgccattgatgctgatggaggtctccaggcaagtccacggatcagatttaacaaggaaggctctctcttggctgtttccgcaaatgacaatatgattaaggttatggcaaactcagatggtctaaggctattgcacacagtcgagaacttatcttctgaatcctccaagcctgcaatcaacagcattccgatggtagagagacctgcctctgtcgtttccatccctggaatgaatggagattcgcggaatatggtggatgtgaagccagtgattaccgaagaatcaaatgataagtctaaggtatggaagcttactgaagtcggcgaaccctctcagtgccgttcattgagactccctgagaatatgagagtcaccaagatatcgagattgattttcacaaattcgggaaatgcaattttggcattggcatcaaatgctattcatctgctatggaagtggcagcgaaatgaccgtaatgcaactgggaaggcaacggcttctttacctcctcagcagtggcaaccagcgagcgggatcttaatgacaaacgatgtggctgaaactaatccagaagaagccgtaccctgttttgctttatcgaaaaatgattcctacgtgatgtcagcatcgggaggaaagatctctttgtttaatatgatgacgtttaagacaatggctactttcatgccgcctcctcctgccgcaacgtttcttgcttttcaccctcaagataacaatatcattgcgatcgggatggatgacagtacaatacagatttacaatgttcgtgttgatgaggttaagagcaagcttaaaggacattctaagagaataaccggcctcgctttctccaatgtattaaacgttctggtttcgtctggagcagacgctcagctttgcgtatggaacacggatggatgggagaagcagaaaagcaaggttctgcaaattccacagggaagatccacgtcttctttgtcagacacgcgtgttcagtttcatcaagatcaagtacacttccttgtggtccatgaaactcagctcgctatatacgaaacaaccaagcttgaatgcatgaaacagtggcctgtgcgtgaatcagcagctccaataacacatgccacattctcatgtgatagccaattgatatacacaagtttcatggacgctacaatatgcgtcttcagctctgcaaaccttcgattgcgttgcagagtcaatccctctgcatatttgccagcttctctcagcaactcgaatgtccatccactggtgatagcggctcatccgcaagaatccaacatgtttgcagtgggtctgtcagacggaggggtccatatattcgagccgcttgagtcagaaggtaaatggggagtagctccaccgcctgaaaatggctcagccagcgctgtcacggctacaccttccgttggagcttctgcctctgaccagcctcagagatgatctgcttcagtttcttactctgttttttttgtgggggttttagatcttttccgatttattattgttttgtttgtgtggggggaagaaagcattctaacaaggtaaatgaattaatagcttacaagttcttcttaattggttaattcgatgttgcttgcctctgatattttggtcttgagaaatatcagttttgcaaaaggacgaa

SEQ ID NO: 9244 - DNA, 3898 bp, Arabidopsis thaliana
ccattagtttttttcttactttctggtcgagagaggagagtccaaaaaacccaaatccttggcctctttcaatatcaggagagagaaactgaagctctggcctttgtttctgaaatcgatcgtcttcttcttcttcatgatctggtgggtttttctgcatctgacttgatagctttatcggactgagtggcaaaatcaatcatgtcttctctgagcagagagctcgtcttcttgatcttacagtttttagatgaagagaagtttaaagagactgttcataagcttgaacaagaatctgggtttttcttcaatatgaagtattttgaggatgaggtgcacaatggtaactgggatgaggttgagaagtatctctctggttttactaaagttgatgataatcgatactccatgaagattttcttcgagattaggaagcagaagtatctcgaggccttggataggcatgatcgtcccaaggctgtcgatattttagtcaaagatttgaaagtgttttccacttttaatgaggagcttttcaaggaaatcactcagctcttgaccttagaaaacttcagggagaacgagcagttatccaagtatggggacacaaagtccgccagagctatcatgttggtggaactcaagaagttgattgaagctaatcctttattccgtgataaattgcagtttcctacccttagaacttcacgcctcaggactctgattaatcagagcttaaattggcaacaccagctttgtaagaacccaaggcctaatcctgatattaagactctctttgtcgatcattcctgccgcctaccaaatgatgcacgagcaccatcccctgtcaacaatccgcttcttggatcattaccaaaagccgagggatttcctcctctaggcgcacacgggccttttcaaccaacaccttctccggttccgacacctcttgctggttggatgtctagtccttcctctgtcccacatccagctgtgtctggaggacccattgctcttggtgctccatccatccaagccttgaaacacccgagaactcctccttctaattccgctgtagactatccatcaggtgactcagaccatgtctcaaagcgaaccagacctatgggaatctctgacgaggtgagtctaggtgtgaacatgttaccaatgacattcccggggcaggctcatggtcataatcaaaccttcaaagcacctgatgacttgcccaagacagttgcacgaactttgagccaaggctcatctcccatgagcatggatttccatcctattaaacagactctgctactagttggtacgaatgtaggggatattgggctctgggaagtcggttctcgagaacgtctagtccagaagactttcaaagtttgggacttgagtaaatgttcgatgcccttgcaggctgctttggtgaaagaacctgtcgtttctgtcaaccgtgtgatttggagcccggacggttccctattcggagttgcttattcgagacatattgtacagctatactcttatcacggtggtgaagacatgaggcaacaccttgagattgatgctcatgttggcggtgtcaatgacattgcattttccactccgaacaagcaactatgtgttactacttgtggtgatgacaaaaccatcaaggtctgggatgctgcaacgggtgtaaaacggtatacttttgaaggccatgaagctcctgtttactctatctgccctcactacaaggaaaacattcagtttatcttttcaactgctcttgacggaaaaataaaagcatggttatatgataatatgggttctcgggttgactacgaagctcctggtcgctggtgtacaacgatggcctacagtgctgatggaactaggctattttcttgtgggacgagtaaagatggggaatcgttcatagttgagtggaatgaaagcgaaggagctgtgaagagaacttatcaaggattccacaagcgttcccttggtgttgtccagtttgatactactaaaaaccgttatctcgctgcgggtgacgacttctccattaagttctgggatatggacaccatacagcttttgactgccattgatgctgatggaggtctccaggcaagtccacggatcagatttaacaaggaaggctctctcttggctgtttccgcaaatgacaatatgattaaggttatggcaaactcagatggtctaaggctattgcacacagtcgagaacttatcttctgaatcctccaagcctgcaatcaacagcattccgatggtagagagacctgcctctgtcgtttccatccctggaatgaatggagattcgcggaatatggtggatgtgaagccagtgattaccgaagaatcaaatgataagtctaaggtatggaagcttactgaagtcggcgaaccctctcagtgccgttcattgagactccctgagaatatgagagtcaccaagatatcgagattgattttcacaaattcgggaaatgcaattttggcattggcatcaaatgctattcatctgctatggaagtggcagcgaaatgaccgtaatgcaactgggaaggcaacggcttctttacctcctcagcagtggcaaccagcgagcgggatcttaatgacaaacgatgtggctgaaactaatccagaagaagccgtaccctgttttgctttatcgaaaaatgattcctacgtgatgtcagcatcgggaggaaagatctctttgtttaatatgatgacgtttaagacaatggctactttcatgccgcctcctcctgccgcaacgtttcttgcttttcaccctcaagataacaatatcattgcgatcgggatggatgacagtacaatacagatttacaatgttcgtgttgatgaggttaagagcaagcttaaaggacattctaagagaataaccggcctcgctttctccaatgtattaaacgttctggtttcgtctggagcagacgctcagctttgcgtatggaacacggatggatgggagaagcagaaaagcaaggttctgcaaattccacagggaagatccacgtcttctttgtcagacacgcgtgttcagtttcatcaagatcaagtacacttccttgtggtccatgaaactcagctcgctatatacgaaacaaccaagcttgaatgcatgaaacagtggcctgtgcgtgaatcagcagctccaataacacatgccacattctcatgtgatagccaattgatatacacaagtttcatggacgctacaatatgcgtcttcagctctgcaaaccttcgattgcgttgcagagtcaatccctctgcatatttgccagcttctctcagcaactcgaatgtccatccactggtgatagcggctcatccgcaagaatccaacatgtttgcagtgggtctgtcagacggaggggtccatatattcgagccgcttgagtcagaaggtaaatggggagtagctccaccgcctgaaaatggctcagccagcgctgtcacggctacaccttccgttggagcttctgcctctgaccagcctcagagatgatctgcttcagtttcttactctgttttttttgtgggggttttagatcttttccgatttattattgttttgtttgtgtggggggaagaaagcattctaacaaggtaaatgaattaatagcttacaagttcttcttaattggttaattcgatgttgcttgcctctgatattttggtcttgagaaatatcagttttgcaaaaggacgaatttgcaattttgcactccgaatctaagcacgaactaaggattgaatgccacgtgcagcttcgagataggtttggatattcgttttgagatacgaaggaagaattactaaggcctatgcggcccacggcccac

SEQ ID NO: 9245 - DNA, 3799 bp, Brassica rapa
gtatttatatatctcgaagagagagagagaaataaaaggaagaagctttatattttctttctttcttgagtccaaaaatcaatcaatcttcttcttcttcttcgtcgatctctttcttccttcatgatctggtgatagtgtttggtggtctgagttgaaaaaaagtctcatgtcttctcttagtagagagcttgtgttcctgatcttacagtttctcgatgaagagaagtttaaagagactgttcacaagcttgaacaagaatctggatttttcttcaacatgaagtactttgaggatgaggtgcataacgggaactgggatgaggttgagaagtatctctctggtttcactaaagtggatgacaatagatactctatgaagatattcttcgagataagaaagcagaagtatctcgaggcgttggataagcatgaccgtcccaaggcggtggagatactagtgaaggatttaaaagtgttttcaacttttaacgaggagcttttcaaagagataactcagctcttgacgttagagaacttcagggagaatgaacagttatcaaagtatggggacaccaagtccgcaagatcgatcatgttggtggaactcaagaagcttatcgaggcgaatcctttgttccgtgataaactgcagtttcctactcttagaaactcaaggctgaggactcttatcaaccagagcttaaattggcaacatcagctttgtaaaaatccaaggccaaatccggatataaagactctttttgttgatcattcgtgtggtcctcctaatggtgcacgtgctccatctcctgtgagtaatccactgcttggtggattgccaaaagctggagggtttcctcctttaggcgcacacgggccgtttcaacctacggcctcacccgttccacctcctcttgctggttggatgtctagtccctcctctgtcccacatccagctgtttctgcaggacccattgctcttggtggtccttctatcccagcggcgttgaagcatccgagaacacctccaactaatcctgctttagactacccatcagcagagtctgaacacgtctcgaaaagaacaaggcctatgggaatctctgaggaagtgagtctaggtgtcaacatgttgccaatgtcatttccagggcaggctcatggtcacagtccagctttcaaagcacctgatgacttgcctaagacggttgcacgaactttgactcagggctcatctcccatgagcatggatttccatccaattaaacagactctacttctagttggtactaatgtaggagatataggtctgtgggaagttggttctcgggaaagattagtacagaagaccttcaaagtctgggatataagtaaatgttcaatgcccttacaggctgctctggtgaaagagcctgttgtatctgttaaccgtgtgatatggagcccagacggttccttgttcggagttgcctactcgagacatattgtgcaactatactcttaccatggaggtgaagacatgaggcaacaccttgagattgatgctcacgttggtggtgtgaatgatatttccttctcgactccaaacaagcaactgtgtgtgataacctgcggtgatgacaaaaccatcaaggtctgggacgctgcgactggtgtcaaaagacatacttttgaaggccatgaagctcctgtttactccgtttgtcctcactacaaggaaaacattcaattcatattttctacagcgctcgatgggaaaatcaaggcatggttgtatgataacatgggttctcgagttgactacgatgcacctggtcgctggtgtactacaatggcttacagtgcggatggaactaggctattctcttgtgggacgagtaaagatggagagtcttacatagttgagtggaatgaaagcgaaggagctgtcaaaagaacttaccaaggattccacaagcgttctctcggtgttgtgcagtttgacacgactaaaaaccgttatctagctgctggcgatgacttctccatcaagttctgggatatggacaatgtgcagcttttaactgccattgatggcgacggaggcctccaggcaagcccgcgtatccggtttaacaaggaaggatctctcttggccgtgtctggaaacgagaatgtgatcaaggttatggcaaactcggatggtttacgactgttgcacactttcgagaacgtttcatctgaatcctccaagcctgcaataaacagtcttgcagcggcagctgcagctgctgctacaagtgctgcagcagatcgatcagccaatgtggtttccatccaagcaatgaatggagatgcgaggaatatggtggatgtgaagccagtgataacagaggaatcaaatgataagtctaagatatggaagcttactgaagtcagcgagccttctcaatgcaggtcactgagactccctgagaatcttagagtcgctaagatatcaagattgattttcaccaattcaggaaacgctattttggctttggcatccaacgctattcatcttctatggaaatggcagaggaatgagcgcaacgcaactggaaaggctacagcttctttgccacctcaacagtggcaaccagcaagtgggatcctaatgactaacgacgcagctgaaaacaatcctgaggaagctgtaccttgttttgctttatccaagaatgattcgtatgtaatgtcagcctccggtggaaagatctccttgtttaacatgatgacgtttaagacgatggctacttttatgccgccgccgcctgctgcaacttttcttgctttccatcctcaagacaacaatatcattgctattggaatggacgatagtactattcagatttataacgtccgtgttgatgaggtgaagagtaagcttaaaggtcattcaaagagaataactggtcttgccttctccaatgtgttaaatgtgctggtttcttctggagctgatgctcagctttgtgtttggaacacagatggatgggagaagcaaagaagcaaggttctgccacttccacagggaagaccaaacactgcaccttcagacacgcgtgttcaattccaccaagatcaagctcacttcctcgtggtgcacgagacgcagcttgctatttatgaaacaacgaagctcgaatgcatgaaacagtggccagtgagagaatcgtcagctccaatcactcatgccacgttctcatgtgatagccaattggtctatgcgagttttatggatgcaacgatttgtgtatttagctctgctaatctaagactccgttgtcgtgtcaacccttctgcatatctaccagctagtctcagtaactcgaacgtaaatcctctggtgattgcggcccatccgcaagaaccaaacatgtttgcagttggtctctcagacggaggtgttcatatattcgaaccggttgagtcggaaggtaaatggggagtggctccaccagctgagaacgggtctgcaaatggcgcagttgctgcaccatccgttggagcctctgcctctgatcagccacagagatgatctgatcatatggatccatctacctctctgattctctttctttctgttaaagttcttttttatcttttttttttgggtagaaatatttatgatccagagattcttgacatgtttagttgtaacatatattcagcgtaatttagtagtaaagtttgtttcttgtgacatcatagattttcatgcagacgatacttagaatttacatggcatttacaagagtgattagtttatgtcgac

SEQ ID NO: 9246 - DNA, 3588 bp, Brassica napus
ttcagctgaggagagagaaactgaagctctggccttgtgaaatcgatctctcttcttcttcatgatctggtgattggtttggtggggattgcgcatctgagttgaaaagacatgtcttctcttagtagagagctcgtgttcttgatcttacagtttctagatgaagagaagttcaaagagactgttcataagctggagcaagagtctgggtttttcttcaatatgaagtattttgaggatgaagtgcacagtggaaactgggatgaggtggagaagtatctctccggatttaccaaagttgatgataatagatactccatgaagatattcttcgagattaggaagcagaagtatctcgaggccttggataagcatgatcgtccaaaggctgttgaaattttagtgaaagatttgagagtgttttccacttttaatgaggagcttttcaaggaaatcactcagctcttgaccttagaaaacttcagggagaacgagcagttatccaagtatggagacacaaagtcggccagatccatcatgttggtggaacttaagaagttgattgaagcgaatccattattccgtgataagctgcagtttcccacccttagaaattcacggctgagaacgctgattaaccagagcttaaactggcaacatcagctctgtaaaaacccaaggccaaatcctgatatcaagactctctttgtggatcactcctgtcgcttacctaatgatgcacgagcaccatcacctgtcaacaacccgctgcttggatcactaccaaaagccggaggatttcctcctttaggcgcacatgggccatttcaaccaacaccttctcaggttccgacacctcttgctggttggatgtctagttcttcctctgttcctcatccagctgtgtctggaggagccatagctctaggttctccatccatccaagccttgaagcacccgagaactcctccaagtaattccgctgtagaatatccatcaggtgattcggaacatgtctcaaaaagaacaagacctatgggaatctctgacgaggtgaatcttggtgtgaacatgttaccgatgacattcccgggacaggcacatggtcatacccaagccttcaaagcacctgatgacttgcctaagacagtagcacgaactttgagccaagggtcatctcccatgagcatggattttcatccaatcaaacagactctcctactagttggtacaaatgttggggatattgggctctgggaagtcggttctcgagaacgtctagtacaaaagactttcaaagtctgggacttgagtaaatgttcaatgcccttgcaggctgcattagtgaaagaacctgtcgtttctgtcaaccgtgtgatttggagcccagatggttctttattcggagttgcttattcgagacatattgtacagctatactcttatcacggtggtgaagatatgagacaacaccttgagattgatgctcatgttggtggtgtaaatgacattgcattctccactccaaacaagcaactatgttttactacttgtggtgatgacaaaaccatcaaggtctgggatgctgcaacgggtgttaaaaggcatacttttgaaggccatgaagctcctgtttactctatctgccctcactacaaggaaaacattcagttcatcttttcaactgcgcttgacgggaaaataaaagcgtggctatatgataatatgggttctcgggttgactacgaagctcctggtcgctggtgtacaacgatggcctacagtgctgatgggactaggctattttcttgtgggacgagtaaagatggggattcatacatagttgagtggaatgaaagcgaaggagctgttaagagaacttatcaaggattccacaagcgttctcttggagtcgttcagttcgatactactaaaaaccgctatcttgctgctggtgatgacttctccattaagttctgggatatggacaatgtacagctgttgactgccattgatgctgatgggggtcttcaggcaagcccgcggatccggtttaacaaggaaggctctctcttggccgtttctgccaatgacaatatgattaaggttatggcaaacacagatggtttaaggctgttgcatacggtcgacaacttatcttctgaatcctccaagcctgcaatcaacaacattgcggtggcagagagagctgctgagagacctgcctctgtagtttccatccctggaatgaatggagattcacggaatatggtagatgtgaagccagtgatcactgaagaatcaaatgataagtctaagatatggaagcttactgaagtcggtgaaccctctcagtgccgctcgttgagactccctgagaatatgagagtcaccaagatatcgagattgatcttcacaaattctggaaatgcgatattggcattggcatcaaatgctattcatctgctctggaaatggcagcgaaatgaccgtaacgctactggaaaggcaacggcttcgttacctcctcagcagtggcaaccagcgagcggaatcttaatgacaaacgatgtgactgaagctaattcagaggaagctgtgccgtgttttgctttatctaagaatgattcctatgtgatgtcagcatctggaggaaagatctctttatttaacatgatgacgttcaagacaatggctactttcatgccgcctccgcctgctgcaacgtttctggcttttcaccctcaggacaacaatataattgcaattggaatggatgatagtacaatacagatttacaatgttcgcgttgatgaggtcaagagcaagcttaaaggacattccaagagaataaccggcctcgccttctccaacgtactaaacgttctggtttcgtctggagcagacgctcagctttgtgtatggaacacggacggatgggagaagcagaggagcaaggttctgcaagttccacagggaagatcaacgggtgctctttcagacacgcgtgttcagtttcatcaagatcaagtacacttcctcgtggtccatgaaactcagctcgctatatacgaaacaacgaagcttgaatgcatgaaacagtggcctgtgcgtgaatcatcagctccaatcacacatgccacattctcatgtgatagccaattgatatacgcaagtttcatggacgctacaatatgtgtcttcacctctgcaaaccttcgattgcgttgcagagtcaatccctctgcatatctgcctgcttctctcagcaactcgaacgtccatccgctggtgattgcagctcatccacaagaatccaacatgtttgctgtgggtctctcagacggtggggtccatatattcgagccacttgagtcagaaggtaaatggggagtggctccaccacctgagaacggctcatccagcgctttggcgtctacaccttccgttggagcttccgcatccgatcagcctcagagatgatatgaaacagaacctgctccggtgaatgtattaatgtaacatattatctatagcaaggtgacgaaacagtttcctaattggttgattcgttggcacttttgtttt

SEQ ID NO: 9247 - DNA, 3767 bp, Silene vulgaris
tttaattttgcagtttttagatgaagaaaagttcaaagagactgttcacaagcttgaacaagaatctggatttttcttcaatatgaagtactttgaggatgaagtacataatggtaattgggatgaggttgagaagtacctttctggctttactaaagtagatgataatcgctactcgatgaagatattctttgaaatccgtaagcagaagtatttggaggctttggacaggcatgatcgttcgaaagctgtggatatacttgtgaaggatttaaaggtttttgcctcttttaatgaggagctttttaaggagattacccaactgttgacattggagaatttcagagagaatgagcagctttccaagtatggagatacaaaatctgcaagggctattatgttggttgagctcaagaagctcattgaagccaatccgttgtttcgtgacaagttgcagtttccaaacctcaagaattcaaggttgaggactctcatcaaccaaagtctgaattggcagcatcagctctgtaaaaaccctaggccgaatccagatataaaaactttatttgtggatcatacctgcggacaaccgaatggcgctcaagctccatctactgcgagtaatccactcttggggggattgcctaaagcaggaggatttcctccaatgggtgctcacgggccttttcaaaccacacctggacaagttccagctccacttgctggttggatgtccaattctccggctgtgagccactctccagttcctggtggaccaattgggcttggtggtccatcaattcctgctgcaccgaagcatccaaggaccccacccacaaactcttccatggattttccatctggcgactctgatcatgttcccaaaaggacaagacccctgggtattggtgatgaggtgaatttacctgtcaatgtattgccagtatctttcccaggccatggttatggtcagccgttcaatatacccgatgacttgccgaagactgtcaccaggacgttgaatcagggatcatctcctatgagcatggattttcaccctgttcaactaacactacttctggtcggtacaaatgtcggtgacatagcattgtgggaagttggctcccgagagaggctggtcgtaaagaattttaaagtctgggatattagtacctgttcaatgtctctgcaggcagcactggtgaaagatccagctgtttcagttaatcgtgtgatttggagtccggatggatccttattcggtgttgcatattcaaggcacattgtacaaatatattcatatcatggtggtgaagaagttcgacaacatctggaaattgatgcacacattggcggagtgaatgatattgcattttccactcccaataagcaactatgtgttatcacctgtggcgatgacaagaccattaaggtgtgggatgctgctactggttcaaagcaacacacttttgaagggcatgaggcccctgtttattcagtgtgcccccactacaaagaaagtattcagttcatattttcaactgccattgatgggaaaataaaagcatggttatatgacaatttgggctctcgagtggactatgacgctccaggtcgctggtgcacaactatggcttatagtcaagatggaaccaggctgttttcttgcggcacgagtaaagatggagaatcacatattgttgagtggaatgaaagtgaaggtgctgtgaaaagaacctatctaggatttcggaaaaaatctttgggtgtcatacaatttgatactactaagaatcgatatctggctgctggggatgatttctctattaagttctgggatatggataatgtgcagctgctgacttccattgatgctgaaggggggctcccagcaagtcctcgtattcggttcaacaaagatggtacacttttggctatctctacaagtgagaatgggatcaaagttctagctaattctgatggactacggctgttacgaacatatgaaacttatgattcatccagagcacctgaatctttgaccaagccatccataaactccatctctgctgccgctgccgtggccgctgcaggtgttgctactagttccggacttcctgagagaggcccccctatagtctccatgggtggaatgaatggggattctagaacacttggcgatgtaaaatctagaattattgaagaaagcaatgataaatcaaagatttggaagcttactgaaataaacgaacctgctcaatgccggtcgtcacgactccctgaacacatgagagcagcaaaaattgcaagattaatttatactaattcaggtaatgctatcttggcgttagcttcaaatgcaattcatttgctatggaaatggcagcggaatgaacgtaatacaagtggaaaggcgacagctagtgtttcacctcagctttggcaaccttctagtggaattctcatgacaaatgatgtgtcagatgcaagttctgaagaggctgttccctgctttgcattgtccaaaaacgattcttatgttatgtctgcatccggaggcaagatttcgctgttcaatatgatgacattcaagacaatgacggtctttatgcctccacctccagcagcaacatttcttgcattccatccccaagataacaatatcattgctattgggatggatgattcgagtattcagatatataatgttcgagtagatgaggtcaaaagcaagttaaaaggtcactcgaaaagagtaactgggttggctttctcacatttattaaatgttctggtctcatcaggtgcagattcgcagatttgtgtgtggagttctgatgggtgggaaaagcaaagatctaagtttctacagcttccacaaggaagagcgccaacatcagtgtcagatactcgtgtacagtttcatcaagaccagacacatttccttgtcgttcacgagactcagctagctatatttgaaacaaagcagttagattgcgtaaaacagtgggttccacacgagtcctctgctcccatctctcatgcagcattttcgtgtgatagtcaactagtgtatgccagcttcctggacgccactgtttgcgtgtttaactcttcaaatctcagactaaggtgccgcataaatccttctgcctacctccccgcaagcgtcagtagctctaatgtgcatccactagtcatcgcggcacatccacaagaagcaaaccagtttgcagtaggactgtcagatggaggcgttcacgtatttgagcccctcgagtctgaagcaaaatggggcaccccgcctcctttggagaacggctcaggtggtagcattccgactacaccttcagtaggagcttcagcatcagatcaacaacaaagatgatccattaggcgtctattctacttatgttcccgtccaagcctgtgctcctatccaggtatggccagttgctccatgccagtcatgcatccatcaacatggctcagcactcagtcgatcagatgtcgtcttttgttgcaaaatatgatgatttttgatccatcatctcagcttaaatgcagatttcgggattggacgggtttaatgtcttccattgtgcagtttagtttattagtgtgtttgggtaacagcaacttaatatatagactagggttagagtatttattgtcagttcttcctttttcgtgtgaatgtaatagcttcttatgactccgacttgagccgctaagtttagttttagaccataatggtgctcttgtgg

SEQ ID NO: 9248 - DNA, 5246 bp, Brassica rapa
gtatataaatattgaagagagagaaaatcccatctctagatagatagaaaaaagaagctttgttcggtgagagaaaaaaaaaagagtccaaaaaaaccaatccatcatctgtttcgtctgtggagagagagaaacgttggtcttcttcttcatcaacatcgatctctttctacttttatgatctggtgatagtctaggcggttcttgtgcatctgagttgaaaaagtccgagagaaacatgtcttctcttagtagagagctcgtgttcctgatcttacagtttctagatgaggagaagtttaaagagactgttcacaagcttgaacaagaatctggatttttcttcaacatgaagtattttgaggatgaggtgcataatgggaactgggatgaggttgagaagtatctctctggtttcacaaaagttgatgataatagatactctatgaagatattcttcgagattagaaagcagaagtatctcgaggctttggataagcatgatcgtcccaaggcggtggaaatattagtgaaggatttgaaagtgttttcaacttttaacgaggagcttttcaaagaaataactcagctcttgacgttagagaacttcagggagaatgaacagttatccaaatatggagacaccaagtcagcaagatcaatcatgttggtggaactcaagaagttgattgaggctaatcccttgttccgtgataagttgcagtttcctactcttagaaactcaaggctcaggactctgatcaaccagagcttgaattggcaacaccagctctgtaaaaacccaaggccaaatccggatataaagacactttttgtggatcattcgtgtggccctccaaatggtgcacgagctccatctcctgtgaacaatccattgcttggagggataccaaaagctggagggtttcctcctttgggtgcacatgggccatttcaaccaacggcctcacctgttccaactcctcttgctggttggatgtctagtccatcttctgtcccacacccagctgtctctgctggtcccattgctcttggtggtccatctatctcagcggcattgaagcatccgagaactcctccaactgctttagactacccatcagcagactctgagcatgtctcaaaaagaacaaggcctatgggaatctctgacgaggtgagtctaggtgtgaacatgttgccaatgtcttttccagggcaggcacatggtcacagcccggctttcaaagcacctgatgacttgcccaagacagttgcacgaaccttgactcagggctcatctcccatgagcatggacttccacccaattaaacagacactgcttctagttggtacaaatgtaggagatatagggctgtgggaagttggttctcgagaaagattagtgcagaagaccttcaaagtctgggatataagcaaatgttcaatgcccttacaggctgctctggtgaaagagcctgtcgtatctgtcaaccgtgtgatatggagtcctgacggttccttgttcggagttgcttactcgagacatattgtacaactatactcttatcatggtggtgaagacatgaggcaacaccttgagattgatgctcatgttggtggtgtgaatgatatttccttctcaactccaaacaagcaactgtgtgtgataacttgtggtgatgacaaaaccatcaaggtctgggacgcggcaactggtgtcaaaagacatacttttgaaggccatgaagctcctgtttactccatctgtcctcactacaaagaaaacattcagttcatattctcgacagctctagatgggaaaatcaaggcatggttgtatgataacatgggttctagagttgactatgacgcacctggtcgctggtgtactacaatggcctatagtgcagatggaactaggctgttctcttgtgggacgagtaaagatggagagtcttacatagttgagtggaacgaaagcgaaggagctgttaaaagaacttaccaaggcttccacaagcgttccctcggcgttgtgcagtttgatacgactaaaaaccgttacctagctgcgggcgatgacttctccatcaagttctgggatatggacaatgtgcagcttttaactgccattgatggcgacggaggcctccaggcaagcccgcgtatccggtttaacaaggaaggatctctcttggccgtgtctggaaacgagaatgtgattaaggttatggcgaactcggatggtttaagactgttgcacacctttgagaatgtttcatctgaatcctccaagcctgcaataagtagccttgcagcagcagcagccgcagctgctgctacgagtgctggactcacagatcgaccagccaatgtagtttccatccaaggaatgaatggagattcgaggaacatggtagatgtgaagccagtgattacagaagaaccaaatgataagtctaagatatggaagcttactgaagtcagcgagccttctcaatgcaggtcactgagactccctgagaatctgagagttgcgaagatatcaagattgattttcacgaattcaggaaacgctatactggccttggcatcaaacgctattcatcttctatggaaatggcagaggaatgaccgcaacgcaactggaaaggcgacagcttctttaccgcctcagcaatggcaaccagcaagtgggatcctcatgactaacgacgctgctgaaaacaatcctgaagaagctgtaccttgttttgctttatccaagaatgattcatatgtgatgtcagcctctggaggaaagatctccttgtttaacatgatgacctttaagacgatggctactttcatgccaccaccacctgctgcaacttttcttgctttccaccctcaagacaacaacatcattgctattggaatggatgatagtactattcagatttataacgtccgtgttgatgaggtgaagagtaagcttaaaggtcattcaaagagaataactggtcttgccttctccaatgtgttaaacgtgctggtttcttctggagcagatgctcagctttgtgtttggaacacagatggatgggagaagcaaagaagcaaggttcttccacttccacagggaagaccaaacactgcaccttcggatacgcgtgttcagttccaccaagatcaagctcacttcctcgtggtgcacgagacacagcttgctatttacgaaacaaccaagctcgaatgcatgaaacagtggccagtgagagaatcatcagctccgatcactcatgccacgttctcatgtgatagccaactggtctatgcgagttttatggatgcaactatctgtgtgtttagctctgcaaatctaaggttgcgttgccgagtcaacccttctgcgtatctaccagctagtctcagcaactcgaacgtacatccactggtgattgcggcacatccgcaagaaccaaacatgtttgctgttggactctcagacggaggagttcatatattcgaacctgttgagtctgaaggtaaatggggagtggctccacctgccgagaacgggtcagcaagcggtgcagcggctgcaccatctgttggagcctctgcctctgatcagccacagagatgatctgatccagagtcgcctacctcccagactcttttctttctaaaagtctttctttatttgtttttggtagaaagacttgtgacccaaggattctgacatgttttagatgtaacatattgtttcacagtaattcagtagcgaagttgtttctctcctttccttatctgagcttaaacctttccaagattttctttcttgccagggaaaaataaatttaaaattatataagaatacaaacgatgtttcagatctttacatacatttacaagaccaatcagttcacttcagtaaataagctgacaacatagaagagcaacgaagactcttttgtccaaaccatagcttgtaaaagctttatttacagtttcttctgcaattaaatcgaagaagagcatttgttttggacgccatgtatatacaaggaagacaggtgactttgtctgaaaccataagagatcgatctatttacagagatagtgaatttgccacttgaaaatatttcattcagggcggaaggtgaccaggtttggcagatcggtcgcctgaagcttcctgatgtcgttagcagagaccttgcaggactccaaggtcagagatctcaggttcttcaatggcttcaggtgacgtagtcctgagtttgatactcgagagtttgagacgttaagagacaccaatgccgtcaaccctgcggttataacgagatcatggttcaggtttcaagcacatatgactagtctgatgaattcaagaaacaaccagttttgaatacttaccagaaatcaactccagagttttgtctgtgaggttcgagttttgagataggttgaggagtgtaagggatgaaagatcttttatgttcttgacaccagcatcagttaatccaccaccacatatctcaagtgactgtagtttcttcaggtctgtatcaaaacaaaacaaacaaaacagtcaggaaacaggagaagatgagtatctagttaagcaatcaaaacttacttcgtagatgatttgttccagagtctgtgatacgagcaccgaagagatcaaggtgagtcaatccagtcaaacctataacaaaaaacagacaagacagcttagcttttactcttgaggaacatgtaacatgttgatagtcacagtttatggactgaagcgagaagcattgggatgacttactcgtgagcgcggaaagtccagcatcagtgacatgacgagcatccagattcagtgttcgaagagatgtcaaaccagataacttccttaaaccactatcggttacaacagtgaatgataggtttatgctctccaggttcgagagacctataacgtaacataaatgcgcaaaatcaaagaatacaaaagatgcaaaagggaaaggtcaaaggaataatgttttaccagagagatggcgaagcccatggcttcctacttcggtatcagacaactccagagatttcaacccaagcatacctaaaaccacatgagtatattttgaatatggaagaatccgtgataagagcaagaaaagtaagcaagcaatcacctgataaatgcaccagtccttcgtcaccaattctacaagaatccaagttcaagctctccaactttgtcaatc

SEQ ID NO: 9249 - DNA, 3810 bp, Amorphophallus konjac
agtgtagtgtggtgtggtggggagcagacatgtcttccttgagcagggaactggtgttcctgatcctgcagttcctcgacgaggaaaaattcaaagagacagttcacaagcttgagcaggaatcgggtttcttcttcaacatgaagtatttcgaggaggaggtgcacaatgggaactgggatgaggtcgagaagtacctctccggcttcacaaaggtggacgacaatcggtactcgatgaagatattcttcgaaatccggaagcagaagtaccttgaggcactggacaaacatgaccgcgcgaaggccgtagatattctaataaaggacttgaaggtctttgcatcatttaatgaagagttattcaaagaaataactcagcttttgactttagataatttcagggagaatgaacaactttccaagtatggagacacaaaatcagcaagagcaataatgctggttgagctcaagaaattgattgaagctaaccctcttttccgcgacaagctgcagtttcctaacctgaagaattccagactgcgtacacttataaaccaaagcttaaattggcaacaccaactttgcaagaatccaaggccaaatccagatattaaaactctttttgttgatcactcttgtggacaaccaaatggggcacgtgctccatcaccagcgaataatcctttgcttggttccattccaaaggctggagggttccctcccttgggtgccacacatgggccttttcagcctacgcctgcacctgttccaactcctctagctggatggatgtccagtccacctactgcgacacatgctgctgtttcaggtggaactattggacttggtggtgctgcaaaccaagcaatcctgaagcatcccaggactcctccatcaaataatcctgctatagattacccttcagcagattctgatcatgtatcaaaaagaacaaggcccattgggatttctgacgaggtaaacttgccagtaactatattgcctgtgacttacccgggtcagaaccacaatcaagctatgtattcaccagatgatttgcccaagactgttgctcggactctaagtcagggatcaaaccccatgagcatggactttcatcctatccaacagacaatacttcttgttggtacaaatgttggagacattgcactgtgggatgttggaactcgggaaagattggttttaagaaacttcaaggtatgggaacttgggcaatgttctgtgcctctgcagacatctttagttaaagatccaggtgtgtcagttaaccgcatcatatggagtccagatggttctctatttggagttgcatattcaaggcatattgtgcaaatatattcttatcatggtggtgatgagattaagccacacttggagattgatgcacatgttggtggtgttaatgatctggcatttgctcatccaaataagcaactatgtgtaataacctgtggagacgacaagaccatcaaggtctgggatgcaaccaatggaacaaaacaatatacttttgaggggcatgaggcgccagtttactctgtttgccctcatcacaaggagaacattcagttcatattttccactgctctagatggaaagataaaagcatggttgtatgataacatgggttctagagttgattatgatgccccaggtcactggtgtactacaatggcttatagtgctgatggttccaggctcttttcttgcgggaccagcaaagaaggagagtcatttattgtggaatggaatgaaagtgaaggtgctgtgaagagaacttaccaaggattccgcaaacgatctttaggtgttgttcaatttgatactaccaggaatagatttttggctgctggggatgaatttatgattaagttctgggatatggataatgtaaatctattaacaactgttgatgccgagggtggcttacctgcaagcccacgcattcgtttcaacaaagagggcgcgctattggctgtttctacaaatgacaatggtatcaaaatattggcaaatgctgagggacttcgattgcttcggacatttgaaaatcgttcatttgacacttctaggcctgcctctgagaccgtgacaaagcctataataagcccaatgtctgctgttggtgttgcaactagtgctggaatcacagacagaggtgcatctacagtgaccatggctggaatgaatggagatgccagaaatatagatgtgaaacctagaataacagaagagcctatggacaaatctaagatatggaagctcactgaaatcaatgaaccagctcagtgccgatccttgagactcatggataacctaagagcaagcaagatatcaagattgatttatacaaattctggtatagcacttttggctttagcatcaaatgccatccatctactttggaaatggccacggagtgatcgcaactccagtggaaaggcaactgccagtgtccaacctcagttatggcaaccaccaagtggcatattgatgactaacgacatcactgacacaaatccagaagaagcaattccctgttttgctttatcaaagaatgattcctatgtcatgtcggcatcaggagggaagatttcgctcttcaacatgatgacatttaagaccatgacaactttcatgcctccaccacctgctgcaacatttcttgcatttcatcctcaagataacaatataattgctattggtatggacgactcaacgattcagatttataatgtccgtgttgatgaggtgaaaagcaagctcagggggcactcaaaaaggatcactggacttgctttctcacatgtgatgaatgttcttgtctcatctggagcggatgctcagctctttgtttgggggaccgatggctgggagaagcagaggagcagattcttgcagattccagctgggagaacacccagtgcaaattcagagaccaaagtgcaatttcaccaggaccagattcatttcttggctgtgcatgaaactcaacttgctatttatgaaacaacaaaattggagtgcatgaagcagtatgttccccgagagccttctgcaccaattacacatgcgacattctcatgtgacagccagctgatatatgcgagctttcttgatgctacagtttgcatattcagtgctccacacctcactttgcggtgtcggattagtccaacgtcttatttgccagctaatatcagctcgaacgtctacccgcttgtgattgcagcgcatccatcagaaccaaatcagtttgctctgggactgacagatgggggagttcatgtcttggaaccacttgaatcggaaggaaaatggggtgtagccccacctgctgagaatgggtcagctagtagcctgtccgtggcacctcccgctggggcgtcaggttcagagcaacaacaaaggtgatgagagaagaaccagaagcatgtatcttcaccctttcccctccctctgcaatacaggtaagatgcagctagagaagtgtaaggtctcagcctgctctgtgctgcacggcactgtgttttcatgtgctaagctttgagggcaatcctaatttactcgagccctctcttctcatcattttcctttttaactgcaacttggatcatgtaacttctccaagaatcaggtctgtatggtaggttcttacatgtagatggttgttgaaggatctcagtagaggttttgctttattttgcagtttgtaaggctccaaagagtaaatatttgatgcctgacatgattgtgctttagtttaattcaaaggtttccatctccc

SEQ ID NO: 9250 - DNA, 3695 bp, Brassica napus
agtccaaaaaaccaatccatcatctgtttcgtctgtggagagagagaaacgttggtcttcttcttcatcaacatcgatctctttcttcttttatgatctggtgatagtctaggcggttcttgtgcatctgagttgaaaaagtccgagagaaacatgtcttctcttagtagagagctcgtgttcctgatcttacagtttctagacgaggagaagtttaaagagactgttcacaagcttgaacaagaatctggatttttcttcaacatgaagtattttgaggatgaggtgcataatgggaactgggatgaggttgagaagtatctctctggtttcacaaaagtagatgataatagatactctatgaagatattcttcgagattagaaagcagaagtatctcgaggctttggataagcatgatcgtcccaaggcggtggaaatactagtgaaggatttgaaagtgttttcaacttttaacgaggagcttttcaaagaaataacgcagctcttgacgttagagaacttcagggagaatgaacagttatccaagtatggagacaccaagtcagcaagatcaatcatgttggtggaactcaagaagttgattgaggctaatcccttgttccgcgataaactgcagtttcctactcttagaaactcaaggctgaggactctgatcaaccagagcttgaattggcaacatcagctttgtaaaaacccaaggccaaatccggatataaagactctttttgtggatcattcttgtggccctccaaacggtgcacgagctccctctcctgtgaacaatcccctgcttggagggataccaaaagctggagggtttcctcctttaggtgcacatgggccatttcaaccaacggcctcaccggttcaaactcctcttgctggttggatgtctagtccatcgtcggtcccacacccagctgtctctgctggagccattgctcttggtggtccatctatctcagcggcattgaagcaccctagaactcctccaactgctttagactacccatcagcagagtctgaacacgtctcaaaaagaacacggcctatgggaatctctgacgaggtgagtctaggtgtgagcatgttgccaatgtcgtttccagggcaggctcatggtcacagcccggctttcaaagcacctgatgacttgcccaagacagttgcacgaactttgattcaaggctcatctcccatgagcatggacttccacccaattaaacaaactctgcttctagttggtacaaatgtaggagatatagggctgtgggaagttggttctcgtgaaagattagtccagaagacattcaaagtctgggatataagcaaatgttcaatgcccttacaggctgctctggtgaaagagcctgtcgtatctgtcaaccgtgtgatatggagccctgacggttccttgttcggagttacttactcgagacatattgtacaactatactcttatcatggtggtgaagacatgaggcaacaccttgagattgatgctcatgttggtggtgtgaatgatatctccttctcaactccaaacaagcaactgtgtgtaataacctgtggtgatgacaaaaccatcaaggtctgggacgctgcaactggtgtcaaaagacatacttttgaaggccatgaagctcctgtttactccatctgtcctcactacaaggaaaacattcagttcatattctcgacagctctagatgggaaaatcaaggcatggttgtatgataacatgggttctcgagttgactacgatgcacctggtcgctggtgcactacaatggcctatagtgcagatggaactaggctgttctcttgtgggacgagtaaagatggagagtcttacatagttgagtggaatgagagtgaaggagctgttaaaagacttaccaaggattccacaagcgttctcttggcgttgtgcagtttgatacgactaaaaaccgttacctagctgcgggtgatgacttctccatcaagttctgggatatggacaatgtgcagcttttgactgccattgatggcgatggaggtcttcaggcaagtccgcgtatccggtttaacaaggaaggctctctcttggccgtgtctggaaacgagaatgtgatcaaggttatggctaactcagatggtttaagactgttgcacacttttgagaatgtttcatctgaatcctccaagcctgcgataagtagccttgcagcagcagccgcagctgctgctactagtgctggactcacagatcgaccagccaatgtagtttccatccaaggaatgaatggagattcgaggaacatggtggatgtgaagccagtgattacagaagaaccaaatgataagtctaagatatggaagcttactgaagtcagcgagccttctcaatgcaggtcactgagactccctgagaatctgagagttgctaagatatcaagactgattttcactaattcaggaaacgctatactggccttggcatcaaacgctattcatcttctatggaaatggcagaggaacgaccgcaacgcaaccggaaaggcgacagcttctttaccgcctcagcaatggcaaccagcaagtgggatcctcatgactaacgacgctgctgaaaacaatcctgaagaagctgtcccttgttttgctttatccaagaatgattcgtatgttatgtcagcctctggaggaaagatctccttgtttaacatgatgacgtttaagacgatggctactttcatgccaccaccacctgctgcaacttttcttgctttccaccctcaagacaacaatatcattgctataggaatggatgatagtactattcagatttataacgtccgtgttgacgaggtgaagagtaagcttaaaggtcattcaaagagaataactggtcttgccttctccaatgtgttaaatgtgctggtttcttctggagcagatgctcagctttgtgtatggaacacagatggatgggagaagcagagaagcaaggttctgccacttccacaaggaagaccaaacactgcaccttcagacacgcgtgttcagttccaccaagatcaagctcacttcctcgtggtgcacgagacacagcttgcaatttacgaaacaaccaagctcgaatgcatgaaacagtggccagtgagagaatcatcagctccgatcactcatgcaacgttctcatgtgatagccaactggtctatgcgagttttatggatgcaacgatctgtgtgtttagctctgcaaatctaaggttgcgttgccgagtcaacccttctgcgtatctaccagctagtctcagcaactcgaacgtacatccactggtgattgcggcacatcctcaagaaccaaacatgtttgcggttggactctcagacggaggagttcatatattcgagcctgttgagtctgaaggtaaatggggagtggctccacctgccgagaacgggtcagcaagcggtgcagcggctgcaccatctgttggagcctctgcctctgatcagccacagagatgatctgatccagagtcgcctacctcccagactcttttcttttcaaaagtctttctttatttgtttttggtagaaagacttgtgacccaaggattctgacatgttttagatgtaacatattgtttcacagtaattcagtagcgaagttgtttctct

SEQ ID NO: 9251 - DNA, 3470 bp, Brassica napus
gatctggtgatagtctaggcggttcttgtgcatctgagttgaaaaagtccgagagaaacatgtcttctcttagtagagagctcgtgttcctgatcttacagtttctagatgaggagaagtttaaagagactgttcacaagcttgaacaagaatctggatttttcttcaacatgaagtattttgaggatgaggtgcataatgggaactgggatgaggttgagaagtatctctctggtttcacaaaagttgatgataatagatactctatgaagatattcttcgagattagaaagcagaagtatctcgaggctttggataagcatgatcgtcccaaggcggtggaaatattagtgaaggatttgaaagtgttttcaacttttaacgaggagcttttcaaagaaataacgcagctcttgacgttagagaacttcagggagaatgaacagttatcaaagtatggagacaccaagtcagcaagatcaatcatgttggtggaactcaagaagttgattgaggctaatcccttgttccgtgataaactgcagtttcctactcttagaaactcaaggctcagaactctgatcaaccagagcttgaattggcaacaccagctctgtaaaaacccaaggccaaatccggatataaagacactttttgtggatcattcgtgtggccctccaaatggtgcacgagctccatctcctgtgaacaatccactgcttggagggataccaaaagctggagggttcccctttaggcgcacatgggccatttcaaccaacggcctcacccgttccaactcctcttgctggttggatgtctagtccatcttctgtcccacacccagctgtctctgctggtcccattgctcttggtggtccatctatatcagcggcattgaagcatccgagaactcctccaactgctttagactacccatcagcagactctgagcatgtctcaaaaagaacaaggcctatgggaatctctgacgaggtgagtcttggtgtgaacatgttgccaatgtcttttccagggcaggctcatggtcacagtccggctttcaaagcacctgatgacttgcccaagacagttgcacgaactttgactcagggctcatctcccatgagcatggacttccacccaattaaacagacactgcttctagttggtacaaatgtaggagatataggactgtgggaagttggttctcgagaaagattagtgcagaagaccttcaaagtctgggatataagcaaatgttcaatgcccttacaggctgctctggtgaaagagcctgtcgtatctgtcaaccgtgtgatatggagtcctgacggttccttgttcggagttgcttactcgagacatattgtacaactatactcttatcatggaggtgaagacatgaggcaacaccttgagattgatgctcatgttggtggtgtgaatgatatttccttctcaactccaaacaagcaactgtgtgtgataacttgtggtgatgacaaaaccatcaaggtctgggacgcggcaactggtgtcaaaagacatacttttgaaggccatgaagctcctgtttactccatctgtcctcactacaaagaaaacattcagttcatattctcgacagctctagatgggaaaatcaaggcatggttgtatgataacatgggttctagagttgactatgacgcacctggtcgctggtgtactacaatggcctatagtgcagatggaactaggctgttctcttgtgggacagtaaagatggagagtcttacatagttgagtggaatgagagtgaaggagctgttaaaagacttaccaaggattccacaagcgttccctcggcgttgtgcagtttgatacgactaaaaaccgttctagctgcgggtgatgacttctccatcaagttctgggatatggacaatgtgcagcttttgactgccattgatggcgatggaggtcttcaggcaagcccgcgtatccggtttaacaaggaaggctctctcttggccgtgtctggaaacgagaatgtgatcaaggttatggcgaactcagatggtctaagactgttgcacacttttgagaatgtttcatctgaatcctccaagcctgcaataagtagccttgcagcagcagcagcagccgcagctgctgctacgagtgctggactcacagatcgaccagccaatgtagtttccatccaaggaatgaatggagattcgaggaacatggtggatgtgaaaccagtgatcacagaagaaccaaatgataagtctaagatatggaagcttactgaagtcagcgagccttctcagtgcaggtcactgagactccctgagaatctgagagtcgctaagatatcaagattgattttcactaattcaggaaacgctatactggccttggcatcaaacgctattcatcttctatggaaatggcagaggaatgaccgcaacgcaaccggaaaggcgacagcttctttaccgccacagcaatggcaaccagcaagtgggatcctcatgactaacgacgctgctgaaaacaatcctgaagaagctgtaccttgttttgctttatccaagaatgattcatatgtgatgtcagcctccggaggaaagatctccttgtttaacatgatgacctttaagacgatggctactttcatgccaccaccacctgctgcaacttttcttgctttccaccctcaagacaacaacatcattgctattggaatggatgatagtactattcagatttataacgtccgtgttgatgaggtgaagagtaagcttaaaggtcattcaaagagaataactggtcttgccttctccaatgtgttaaatgtgctggtttcttctggagcagatgctcagctttgtgtatggaacacagatggatgggagaagcaaagaagcaaggttctgccacttccacagggaagaccaaacactgcaccttcagatacgcgtgttcagttccaccaagatcaagctcacttcctcgtcgtgcacgagacacagcttgcaatttacgaaacaaccaagctcgaatgcatgaaacagtggccagtgagagaatcatcagctccgatcactcatgccacgttctcatgtgatagccaactggtctatgcgagttttatggatgcaacgatctgtgtgtttagctctgcaaatctaaggttgcgttgccgagtcaacccttctgcttatctaccagctagtctcagcaactcgaacgtacatccactggtgattgcggcacatccgcaagaaccaaacatgtttgccgttggactctcagacggaggagttcatatattcgaacctgttgagtctgaaggtaaatggggagtggctccacctgccgagaacgggtcagcaagcggcgcagcggctgcaccatctgttggagcctctgcctctgatcagccacagagatgatctgatccagagtcacctacc

SEQ ID NO: 9252 - DNA, 3397 bp, Flaveria ramosissima
ttttgaggatgaggtgcataatgggaattgggatgaggttgagaagtatctttcaggtttcactaaagtggatgataatcgttattcgatgaaaatattcttcgaaattaggaagcaaaagtatcttgaagcattggataagcatgacaggtccaaggctgtagagatccttgtaaaagatcttaaggtttttgcctcatttaatgaagacctttttaaggagataactcagttattaactttggagaactttagggagaatgaacaattatccaaatatggagatactaaatcagctagagctataatgttggttgaacttaagaagctaattgaagcaaatcccttgtttcgtgacaaattgcaatttccaaatcttaagaattcaaggttaaggacactcataaaccaaagcttgaattggcaacaccaactttgtaaaaaccctaggccaaatccagatatcaaaacattattcgttgatcattcgtgtggtcagccaaacggtgcacgtgctccatcacctgcaagcaatccacttcttggatcgttaccaaaagctggaggttttcctcctttgggtgcacatgggccatttcaacctacaccggctccagtgcctgctccacttgcagggtggatgtctaatccgccagctgtatctcatccaacggtttctggtagtgcgattggtcttggtagtccctctatttcagctgctttgaagcacccaagacctccaacaaattcatctttggattacccatctgcagatgctgatcatatgagcaaaagaacaaggcccttgggaataactgacgaggtaaatctgccagttaatgtgttacccgtgtcgttccctgggcattctggtcatagtcaagcttttaatgcacctgatgatctgccaaaaaccgttgcacgaaccttaaaccagggttcatctcctatgagcatggactttcaccctattcaacaaacattactcttagttggaacaaatgtgggagatgtaggattatgggaagtcggttcacgggaaagattggttcttaaaaatttcaaagtttggaatcttagtgcatgttcaatgcctcttcaggctgctctggtaaaagatccaggtgtctcagtgaaccgcgtaatctggagtccagatggttccttgtttggagttgcatattcaaggcacattgtacaaatatattcgtatcatggaggtgatgatgttagacaaagtatagagattgatgctcatgttggtggagtaaatgatctggcattctctaatccaaacaagcagctttgtgtgataacctgtggggacgacaaaacaatcaaggtttgggatgcatcaaatggtgtaaaaaagtacacctttgaaggccatgaagcacctgtttattctgtatgccctcactataaagaaaacattcagtttatcttttcaacggctcttgacggaaagataaaagcatggttatatgataacatggggtcacgcgttgattatgaggcacctggtcgttggtgcacaacaatggcatacagcgctgatggaacaaggcttttctcatgtgggaccagcaaagaaggggagtctcacattgtagaatggaacgaaagtgaaggggctgtaaaaagaacatatattggtttccgtaaacgatctttaggtgttgttcaatttgatacaacaaaaaaccgatatttagcagctggtgatgatttcgcaattaaatattgggatatggacaatgttcagcttttaacaagtgttgatgctgatggaggtcttccggcaagcccacgaatccgatttaacaaagatggtgctcttttggctgtttctgctaatgataacggtatcaaaattttggcaaattctgatggactgcgattacttcgaacttttgaaaatctttcatttgatggttctgcttcaagaactcctgaagctgcaaagcctacggttatttcgttatctcctgctgctgctagcagtgctgcattagcagaaagggttgcatccgttggatccatctctgcgatgaatggggacgccagaagcttgccagatgttaaacctaggattgtggaagaaaccaatgacaaatcaaagatttggaaactgtctgagattaatgaggcttctcaatgtcggtcactaaagctccctgagaacatgagagtaacaaagatatcaagattgatatatacaaattccggaaatgctcttttagcattagcatcaaatgctattcatttgctatggaaatggcagcgcaatgagcgtaattcaagtggcaaggcaacagctgctgtttcaccacagttatggcaaccttcaagtgggattttgatgactaatgatgtggcagagaccaaccctgaagaatctgttgcctgctttgctttgtctaaaaacgattcttatgttatgtctgcatcaggaggaaagatttcattgttcaatatgatgacattcaagacaatgacaacattcatgccaacgccacctgcagcaacatttcttgctttccatcctcaagataacaatattatagcaattggcatggaagactccacaatccagatttataacgttcgtgtcgatgaggttaaaagcaagcttagaggccactccaaaagaataacaggtcttgccttttctcatgtgctgaatgtgctagtctcgtctggtgctgatgctcagatttgtgtatggagttctgatggatgggaaaaacaaaagacccgatatgttcaactcccacctgggagaacaccatcaccacaatccgacactcgtgtgcagtttcatcatgatcagatccattttcttcttgttcatgagactcaactcgccatttatgaagcaacaaaactagaatgcgtaaagcagtggattcaacgtgaaaacttagctccaatatcacatgcaactttttcatgtgatagccagttggtatatgcaagtttctttgatgcaaccatctgtgtgttcactgcttctaaccttcgtctcagatgcaagattaacccgtctgcgtatcttactggtaaccttactgtgcacccggtggtgattgctgctcatccacaagaaccgaatcaatttgcattagggctttctgatggaactgttcatgttttggagccccttgaatccgatggcagatggggtgtgccaccaccggccgacaacgggtcaacaagcaccacaccagctacaccaccagctgctggttcagggtcagaacaaaccgcccagaggtgacctgggtgtttccactggactaaacacttctttactgtgcagttccaacttagcagttatgatcatacttctagtgctactgttattattgtggacttattattattaaaaagctca

SEQ ID NO: 9253 - DNA, 3447 bp, Eutrema parvulum
aacatgtcttctcttagtcgagagctcgtgttcttgatcttacagtttctcgatgaagagaagtttaaagagactgttcacaagcttgaacaagaatctgggtttttcttcaatatgaagtattttgaggatgaggtgcacaacggaaactgggatgaggtcgagaagtatctctctggtttcacaaaagttgatgataatagatactcaatgaagatattcttcgagatacgaaagcagaaatatctcgaggctttggataagcatgatcgtcccaaggccgtggacatactagtgaaggatttgaaagtgttttcaacttttaacgaggagctttttaaggaaataacgcagctcttgacgttagagaacttccgggagaatgaacagttatccaagtatggggacaccaagtcggcaagatcgatcatgttggtggaactcaaaaagttgattgaggcgaatccgttattccgcgataaattgcagtttcctactcttagaaattcaaggctgagaactttgatcaaccagagcttaaattggcaacatcagctttgtaaaaatccaaggccaaatccggatataaagacactttttgtggatcattcgtgtggccctccaaatggggcacgggctccatcgcctgtgaacaatccgctgcttggaggattaccgaaagctggaggatttcctcctttaggcgcacacgggccatttcaaccaacggcctcaccggttccaacgcctcttgctggttggatgtctagtccatcctctgtcccacatccagctgtgtctgcaggagccattgctcttggtggtccatcaatcccagcggcattgaagcacccgagaacccctccaactaatgctgctttagactacccgtcagcagagtctgaacatgtctcgaaaagaacaaggcctatgggaatctctgacgaggtgaatctaggtgtgaacatgctgccaatgtcatttccagggcaggcccatggtcacggtccggctttcaaggcacctgatgacttgcccaagacagttgcacgaactttgactcagggctcatctcccatgagcatggatttccatccaattaaacagactctgcttctagttggtacaaatgtaggtgatatcggcctgtgggaagttggttctcgggaaagattagtacagaagaccttcaaagtctgggatataagtaaatgttcaatgcccttacaggctgctctggtgaaagaacctgtcgtatctgtcaaccgcgtgatatggagccctgatggttccttgttcggagttgcttactcgagacatattgtacaactatactcttatcatggaggtgaagacatgaggcaacaccttgagattgatgctcatgttggtggtgtgaatgatatttccttctcaactccaaataagcaactgtgtgtgataacctgtggtgatgacaaaaccatcaaggtctgggacgctgcaacaggtgtcaagagacatacttttgagggccatgaagctcctgtttactccgtctgtcctcactacaaggaaaacattcaattcatattttcgacagctctcgatgggaaaattaaggcatggttgtatgataatatgggttctcgagttgactatgatgcacctggtcgctggtgtactacaatggcttatagtgccgatggaactaggctattctcttgtggaacaagtaaagatggagagtcttacatagttgagtggaatgaaagtgaaggagctgttaaaagaacttatcaaggattccacaagcgctctctcggtgttgtgcagtttgatacaactaaaaaccgttatctagctgcgggtgatgacttttccatcaagttctgggatatggacactgtacagcttttaactgccattgatggcgatggaggcctccaggcaagcccgcgtatccggtttaacaaggaaggctctctcttggccgtctctggaaacgagaatgtgatcaaggttatggcaaactcagatggtctaagactattgcacacttttgagaacatttcgtctgaatcctccaagaatggagattcacggaatatggtggatgtgaagccagtgattacggaagaatcaaatgataagtctaagatatggaagcttactgaagtcagcgagccttctcaatgcaggtcactgagactccctgagaatctgagagtcgctaagatatcaagattgattttcacgaattcaggaaacgctatcttggctttggcatcaaacgctattcatcttctatggaaatggcagcggaatgaccgcaacacaactggaaaggcgacagcttctttaccgcctcagcaatggcaaccagcaagtgggatcctcatgactaacgacgctgctgaaaacaatcccgaggaagctgtaccttgttttgctttatccaagaatgattcatatgtaatgtcagcctctggtggaaagatctccttatttaacatgatgacatttaagacgatggctactttcatgccaccaccgcctgctgcaacttttcttgctttccatcctcaagacaacaatatcattgctatcggaatggatgatagtacgattcagatatataatgtccgtgttgatgaggtgaagagtaagcttaaaggtcattcaaagagaataacaggtcttgccttctccaacgtgttaaatgtgctggtttcctctggagcagatgctcagctttgtgtatggaacacagatggatgggagaagcagagaaacaaggttctgccacttccacagggaagaccaaacactgcaccttcagatacacgtgttcaattccatcaagatcaagctcacttcctcgtcgtgcacgagacacagcttgctatctacgaaacaaccaagcttgaatgcatgaaacagtggccagtgagagaatcatcagctccgatcactcatgcaacgttttcatgtgatagccaattggtctacgcgagttttatggatgcaacgatctgtgtatttagctctgcaaatctgagattgcgttgccgggtcaacccttctgcgtatctaccagctagcctcagcaactcgaacgtacatccactggtgattgcggcacatccgcaagaaccaaacatgtttgcggtcggcctctcagacggaggagttcatatattcgaaccagttgagtcggaaggtaaatggggagtggctccaccggctgagaacgggtcagcaagcggcgcagtggctgcaccatccgttggagcctccgcctctgatcagccacagagatgatctgatccgagagtcatctacctcttttccttccttttaaaagtctttcttttttattttttggtagaaatatttattatgacccagagattctaacatgtcttagctgtaacatatattcacagtaatttagtagtaaagttg

SEQ ID NO: 9254 - DNA, 3824 bp, Musa acuminata
tttggctgaagaattagggttttggaggtggagactggggcaacactatgtcatctctcagtagagagcttgtgtttctgatcctgcagtttctcgatgaggagaagttcaaagaaacagttcacaagcttgaacaggagtctggcttctattttaatatgaagtattttgaggatgaggtgcataatgggaattgggataacgtggagcgttacctctctggcttcaccaaggttgatgacaaccggtattcgatgaagatattctttgaaatacggaagcagaagtatcttgaagcgttggacaagcatgaccgatcaaaggcagttgaaatccttgtgaaggatttgaaggtctttgcctcatttaacgaggagctatttaaggaaatcacacaacttttaactttggagaatttcagggaaaatgagcaactttccaaatatggggacacaaaatcagcacggacaataatgcttgttgagcttaagaagctgattgaagcaaaccccctattcagagataaacttcagtttccaaacctaaaaagttctagattgcgcaccctaatcaaccagagtttgaactggcagcaccagctatgcaaaaaccctcggccaaatccagatattaaaacactttttgttgatcattcatgtgggcaaccaaatggtgcacttgctccatcaccagtgaacaattcactgcttggatccatgcccaaagcaggaggatttcctccattgggtgctcatgggccttttcaacctgcgccagcaccagttcctatgcccctggctggctggatgtctaacccttcagctgtaacccatccagctgtttctggtggagctattggactgaatgcacctacaaatcctgttgcaattttgaagcatccaaggactcctccaacggcgaaccctggtatagagtatgcatctgcagattctgaccatgtatctaaaagaacaagacccattgggatttctgatgaggtaaatctgcccgtgaatatacttccagtttcctatcctcagagccacaaccaggctacatacaccctggaggacttgccaaaaacagttgcacgaaccctgagccaaggctcgaatcccatgagcatggattttcatccagttcagcagactattcttctcgttggaacaaatgtgggtgacattgcattatgggatgtcggcactagggagagattaattcttaagaacttcaaggtttgggaacttggatcttgctccatgtcccttcaggcttctttggttaaggatcctgctgtatcagttaatcgcataatatggagcccagatggctccttgtttggtgttgcttattcaaggcacattgtccaaatatattcttatcatggtggcgatgatatcaggcagcacctggagattgaggctcatgttggtggtgttaatgatattgcatttgcttatccgagtaagcagctttctgtaataacatgtggcgatgacaagacaattaaggtgtgggacgcaactagtggcacaaagcagtacacctttgaagggcatgaggcacctgtttattctgtttgcccacatcacaaggaaaacatccaggcattcatcttttcaacagcattagatgggaaaataaaggcatggttgtatgacaatttgggatccagggtggattatgatgccccaggacactggtgtactacaatggcttacagtgctgatggttcaagacttttttcatgtgggaccagtaaagaaggggaaacattcattgtggagtggaatgaaagtgaaggagctgtgaagagaacatatcaaggatttcgaaaacgttctctgggtgttgtgcaatttgataccacacggaaccggtttttggctgctggtgatgagtttctgataaagttctgggatatggacaatactaatatactaactactgttgatgctgatggtggcctaccggcaagtccaaggattcggttcaacaaggaaggaacactattggccatttctacgcatgataatggaattaaaattttggcaaatactgatggacttcgtctgttgcgcacacttgaaaatcgttcttttgatgcctctaggactgtttcagaaacagtgacaaagcctgtgataagcccattgtctgctgctgcttctgctgcaacaagttctggaataattactccaccgatggcaattgctggaatgaatggagatagcagaaacttggtggatgcaaaacctagaattactgatgaatcaatggacaaatcaaagatctggaagctcactgaagtcaatgaaccaactcaatgtcgatctttaaggctcgtggataatcttagaacaagcaagatttcaagattgatttacaccaactctggaattgcaatcttggctttagcatcaaatgccattcacctactctggaagtggcctcgtaatgaacgcaattcgagtggaaaggcaacagcaagtgttgcccctcaactgtggcaaccaccaagtggcatattgatgactaatgagataactgacacaaatcctgaagaagcagtccactgctttgcattgtcaaagaacgattcttatgttatgtcagcatcaggagggaaaatatctctattcaatatgatgacatttaagactatgacgacattcatggcgcctccacctgcagcaacttttcttgcatttcatccacaagacaataatataattgctataggaatggaagattctacaattcagatatataatgtccgagttgatgaggtcaagagcaaacttagaggccactcaaagagaattactggtcttgctttttcaaatgtcttaaatgtgctggtctcatctggagctgatgctcagctttgtttgtggggaactgatgggtgggagaaacacagaagcagatttctgcaaattccccctgggcgtactccagcagccatctcagatacacgagttcagttccatcaagatcagatacacttcctagctgtgcatgagacccagattgctttgtatgaaactactaaactagaatgtgtgaaacagtgggctcctcgtgaaggttctgcacccatttcacatgcaacattttcttgtgacagtcagttgatatatgctagtttcttagatgccaccatatgtgtattcaatgccacaaacttcaggctgcgatgtcggatccttccagctgcttatctccctgccagtgtcagcacaactttgtaccctcttgtgattgctgcacatccatcagaaccaaaccagtttgccttgggtctgacagatggtggtgtacatgtactagagccgttagaatctgaaggaaaatggggtgttaacccacctacggacaatggatcggcaagcagcatctccgcaccgctccctgctggagcctctaattcagatcaaccacagaggtgatgcaaataattgcatcacagtatttaaccctttcactctctctgtcataaccttaattgttggttggctaactgaggtatgcagcagaatctgcattattatcaatttctcacaacaataactggtgttgatctttaaatcggttgtctctgtttacatcagacttaactatagtttcgcggccttcatgtgcaatcatgtcatgtagtccccatcaggctttgccatcatatgctgttgcctcttgtatgttggaaaagaagtatcccatggcagagtttgataatctttgatgtggatataaatgcagaaatgtttggtttgtttgaaccgcaacttctcttggatcgttattcaagtgaaatatctggc

SEQ ID NO: 9255 - DNA, 3658 bp, Elaeis guineensis
atcctgcagttccttgatgaggagaagttcaaggagactgttcacaagctcgagcaagagtctggtttctatttcaatatgaagtattttgaggatgaagtgcataatgggaattgggatgaagttgagcggtacctttctggttttaccaaggttgacgacaatcgctattcaatgaagattttctttgaaattcggaagcagaagtacctcgaagcattggataagcatgaccgggcaaaggcggttgacatccttgtaaaggatttgaaagtctttgcctcattcaacgaggaattatttaaggaaatcactcaacttctaactctagagaacttcagggagaatgagcagctctccaaatatggggataccaaatcagcaagagcaataatgcttgttgagcttaagaaactgattgaagcaaaccctctattccgtgacaaactgcagtttcccagcctaaaaagttccagattgcggacacttatcaatcaaagcttaaactggcagcaccagctctgcaaaaaccctcggccaaatcctgacattaaaacactttttgtcgatcattcttgtggacaaccaaatggtgcacgggcgccatcaccagcaaacagtccacttcttggatcaatacctaaagcaggaggttttcctccattgggtacacatgggcctttccaacctatgccagcaccagttcctgcaccactggctgggtggatgtctagtccaccagctgttactcatccagctgtctctggtggtgccattggaatcaatactcctacaaatcctgctgcaatgttaaaacatccaagaacacctccgactaccaaccatgctgtagattacccatcagcagattctgatcacgtatccaaaagaacaaggccaattgggatttcagatgaggtaaatcttcccataaatatattgccagttacgtatcctcagaatcatagtcaggctatgtacacgctggatgacttacccaaaactgttgcacggatgttgagtcaaggctcgactcccatgagcatggattttcatcccatccagcagaccattctccttgttggtacaaatgtgggtgacattggattgtgggatgtcggtaccagggagagattagtcctaaggaatttcaaggtttgggaacttggagcttgttccgtgtccctgcaggcttctctagtgaaggatcctagtgtatcagttaaccgtgtaatatggagctcggatggctcgttgtttggtgttgcttattcaaggtatatcatacaaatatattcttatcatagtggtaatgatatcagacaacacttggagattgatgctcatgttggtggtgtcaatgatattgcatttgctcatcctaataagcaattatgcataataacctgtggagatgataagacaatcaaggtatgggatgcaactactggtaccaaactgtatacctttgaaggtcatgaggcgcctgtttattctgtttgcccacactacaaggagaacattcagtttatcttttcaacagcattggatggaaaaataaaggcgtggttgtatgacaatttgggttctagagtggattatgatgctccaggtcactggtgtactacaatggcttacagtgccgatggttccaggctcttttcctgtgggaccagcaaagaaggtgaatcattcattgtagaatggaatgaaagtgagggagctgtcaagaggacctatcaaggatttcgaaaacgatctttgggtgtcgtgcaatttgataccactaggaatcggtttttggctgctggtgatgagttcttaatcaagttctgggatatggacaatactaatcttttgacaactgttgatgctgatggtggtctgccagcaagtcctcggatacgcttcaacaaggagggtacattgctggctgtttctacacatgataatgggataaaaatcttggcaaatgctgatggacttcgtttgttgcgcacatttgaaaatcgttcttttgagacttctagggctatttcagagtcagtaacaaagcctataataagcccattatctgctgctgctgctgctgttgcaacgagttctggaataacggagagagctgctcctgcagtggctatagctggaatgaatggagacaacagaaacttggtggatgtaaaacctagattaaccgatgaatccatggacaaatcgaagatctggaagcttactgaaatcagcgaaccaactcaatgtcgatccttgaggctcattgataacttgagaacaagcaagatttcaagattgatctatactaattctggagttgccatcttggctctagcatctaatgccattcatctgctttggaagtggcctcgtaatgaacggaattctagtggaaaggcgacagcaagtgtcgcccctcaattatggcaacccccgagtggcatattgatgactaatgagataactgatacaaatcctgaagaagcagttccctgctttgctttgtcaaagaatgattcttatgtcatgtcagcatctggaggaaaaatttcccttttcaacatgatgacatttaagaccatgacaacattcatgcctccaccaccagcagcaacatttctcgcgttccaccctcaagacaacaatataattgccatagggatggatgactccacaattcagatatataatgtccgagttgatgaggtcaagagcaagcttaaaggccattcaaaaaaagttactggtcttgccttctcgaatgtattaaatgtgttggtctcatctggagctgatgctcagatttgtgtgtggggaactgatggatgggaaaagcaaaagagcagacttttgcaaattccctctgggcggactgcattcactatatcagatacgcgtgttcggttccatcatgatcagatacacttcttagctgtacatgagacccagattgctttatatgaaaccactaggctagagtgcttaaagcagtgggtccctcgtgaaggttctgcacctatctcccatgccacattttcgtgtgacagtcagtttatatatgctagcttcctggatgcaaccatatgcatatttaatgctgcaaacttcatactgagatgtcggattcttccagctgcttatctccctgccaatgttagcacaactgtttatccccttgtggttgctgcacatccatcggaaccaaatcaattcgccttaggcctgacagacggaggtgtccatgtattggagccactagaatctgaaggaaaatggggagttgctccacctgctgagaatgggtcagcaagcagcatgtcgacaccgcctcctgcaggagcctcaagttcggatcaaccacagaggtgatggaagaatcagcaatcagtctttaaccttttttgttcccttgtctaaggaatggctaactgataagtcagggcatgaaaaatatatagttaccaagagcaggcatagattatatagatgcttacgaagtaactatgtgttttccatcaggctttgctttggtgtgatgttcctcttaggtggtaaatagttgcagtgtgaaattattctgtttgtgttttggaaggttttttcctttgacatgcatgagagtttaatggagtttgtttaactgcaa

SEQ ID NO: 9256 - DNA, 3401 bp, Panax ginseng
agattaggaagcagaagtatcttgaggcattggataagaatgatcgatccaaggctgtggaaatcctcgtgaaggatcttaaagttttttcatcatttaatgaagagctttttaaggaaattactcagctcttaacattggagaatttcagggagaatgaacagctatccaaatatggagatacaaaatctgcaagagctattatgttggttgaactcaagaagcttatcgaagcaaatcccttgttccgtgacaaattgcaatttcctaatcttaaaaattcgaggttacgtactctcatcaaccaaagcttgaattggcagcatcaactttgtaaaaacccaaggccaaatccagatatcaaaactctttttgtggatcattcatgtgcacaaccaaatggtgcacgtgctccatcacctgcaaataatccactgcttggatccttgccaaaagctggagtttttcctccgctgggtgcacatgggcccttccaacctacaggagctccagttccaactcctcttgctgggtggatgtctaatccatctgctgttactcatcctccagtttctggtggagctattggtcttggtggtccatccatgccagctgctttgaagcatcctaggacgccgccagcaaacccttctttagattacccatctggagattcagatcatgtaaccaaaagaacaaggcccatgggcatatctgatgaggtaaatcttccgataaatgtgttgcctgtgtcattcccggggcatactcatagtcaggctttcaatgcacctgatgacctgcccaaaagtgttgcacgaactttgaatcagggttcatctcctatgagcatggattttcacccaattcaacagactttacttttagttggtaccaatgttggggatataggattgtgggaaattggttccagggagagattggttcttagaaacttcaaagtttgggatcttggcgcatgttcaatgcctctgcaggctgctctagttaaagatcccggtgtctctgttaaccgtgtgatttggagccccgatggttctttgtttggagttgcatattcaagacacattgtacaaatatattcttatcacaggggcgatgatttaaggcagcatttggagattgatgctcatattggaggagtaaatgatcttgcattctctcatccaaataagcagctatgtgtgataacctgtggggacgacaagaccattaaggtttgggatgccacaactggtgcaaaacaatacacttttgaaggtcatgaagctcctgtctattctgtatgccctcactataaagaaaacattcagtttatattttcaacggctctagatggaaagataaaagcatggttatatgacaatttgggatctcgagttgattatgatgctcctggtcggtggtgcacaacaatggcgtacagcgctgatggaacaaggctcttttcatgtgggaccagcaaagatggggagtcacacatcgtagaatggaatgaaagtgaaggggctgtgaaaaggacatatttaggcttccggaaacgttctttaggtgtagtgcaatttgatacaactaaaaaccgatttttagcagctggtgatgaattttctattaaattctgggatatggacaatgttcaacttttgacgagtattgatggtgatggaggccttccagcaagtccacgtatccgcttcaacaaggatggctcgcttttggcagtctctaccaatgaaaatggaatcaaaattttagcgaattctgatggtcttcgattgctacgcacatttgaaaatcaatcttatgatgcttcaagggctcctgagactgtgaagtcttcaataaacacaatatctgctgctgctagtagttctggacttgcagagagggttgtctctactgctgctctttccggaatgaatggagattccagaaatttgggggacattaagccgagaataactgaagaatccaatgacaaatcaaagatttggaaacttgcagaggttaatgagccttctcagtgccggtcaatgaagctccctgaaaacatgagagtaactaagatatcaaggctgatatatactaactccggtaatgctatattggcgttagcatcaaatgcaattcatcttctgtggaaatggcagagaagtgatagaaattcaagtggcaaggctacagccagtgtctcacctcaattatggcaaccatcaagcggcattctaatgaccaatgacgtgactgacaccaacccggaggatgctgtaccatgctttgctttgtccaaaaatgattcttatgtgatgtcagcatcaggaggaaagatatctttattcaacatgatgactttcaagacaatgacaacattcatgcccccgccacctgcagctacatttcttgctttccatcctcaggacaacaatatcattgctattggcatggatgactccacaattcaaatatataatgttcgtgtggatgaggtcaaaagcaagcttaaaggccactctaagagaatcaccggccttgctttctctcatgtactgaatgtgctagtttcttccggagcagatgctcagctttgtgtgtggaattctgatggatgggaaaagcaaaagagcagatacctgcaagttccagctgggaggactacaacagcacagtccgacactcgggtacaatttcatcaggaccagatgcactttctggttgtacatgagactcaacttgccatatatgagacaataaaactagaatgtgtaaaacagtgggtcccacgagaatcttctgcccctatttctcatgcaacattttcatgcgatagtcagctggtatatgccagtttcttggatgctagtttgtgcgtattcagtgctgcacacctccgcttgcgatgtcgtattaatcctttggcttatctatcacctagtgtcagcaattcaaatatccatccactagtgattgctgcacatccacaagaaccaaatcagtttgcattgggtctgtcagatggaggagtccatgtctttgaaccccttgaatctgaaggcaaatggggtgtgcctcaaccagtcgaaaacgggtcagcaagcagtgtcacgactacaccttcagttggagcttcaggttcagatcaagcccagagatgagacaaagggttgccagcacacaagttctttaaatgctttgcttgctgggaaattccaaatttttgagtgcaggaaatgtaatttacttggtgaatgatttgcagacttgtagatctaacatgtgaatcaagatattatgcaaggtaaatgctttacaatagtaatagtaaatgttcgttctttattgctggaaggaatttcttctagaaaatggatctttgttaaaat

SEQ ID NO: 9257 - DNA, 3813 bp, Eucalyptus grandis
gagagagagagagagagagagagagagagagatggagaagagaggggcgtgagggaatttgcaggcatcgtttcttgagagagagagagagagagagagggagcttcctcgctctggaattcactgggccggcgcttctcaagaaccgatctctgctccggtcttcagtcgcaaggtggaaatcgtgcatttagatcagtggagcagagaggcggtcaagatgtcttccctcagcagagagctggtgttcttgatcttacagtttctcgatgaggaaaagttcaaagagaccgttcacaagcttgagcaggaatctgggttttactttaatgtgaggcattttgaggatgaggtccataatgggaattgggacgaggtcgagaggtacctctctgggttcacaaaggtggatgacaaccggtactcgatgaaaatcttcttcgagataaggaagcagaagtatctcgaggcattggacaagcatgatcggtccaaagctgtggatattttgataaaggatcttaaagtgttctccacctttaatgaggaactttttagggaaataacgcagctactgacactagagaacttcagggaaaatgagcaattatctaagtatggagatacaaaatctgcgagagcaattatgttggtggagcttaagaagcttattgaggcaaaccccttgttccgtgataagttgcaatttcctagcctcaagaactcaagactacgcactctcataaaccaaagtctgaattggcagcaccaactttgtaaaaatccaagatcaaatccagatataaaaactctatttgtggatcattcttgcgggcagccaaatggtgcacgggccccatctccagcgaacagcccgttgctaggacccttgccaaaagttggaggttttcctcctctgggagcacatgggccttttcaacctgctcctgccgctgttccaacgcctcttgctggttggatgtccaatccaccttccactgtgacacatccagttgtgcccggaggaggagtgattggtcttggtggtccatcaattccaggggatgcttctgatcctgtttcaaaaagaacgaggcccttgggaattgttgatgaggtgaatctgccggttaatgtcctccccgtaacttttcctggccatggtcatgcaccggcttttacttctgacgacttgccaaaggcagtaggacggattttaaatccaggttcatctccaatgagcatggattttcatcctgtgcagcagactttgcttctagttggcaccaatgtgggtgatattagcctttgggatgttgtctctagagagcgacttctttcaaagaacttcaaagtttgggatcttagctgctgtacgacgacccttcaggcagctctagttaaagatcctggtgtatctgtaaatcgcattatgtggagcccagatggttccctcttcggagttgcgtactctttgcacgttgtgcagttattttctttcaatgtaaacaatgaagtgcggcagcatctagagattgatgctcatgttggtggagtgaatgatcttgcatttgctcaacccaataagcaactttgtgtcataacctgcggtgatgacaaaacaatcaaggtgtgggatgcagttactggcgtaaagcggcacacgtttgaaggtcatgaggctcctgtttattctgtgtgccctcactctaaggagaacattcagtttatattttcgactgcactggatggaaagataaaagcatggttgtatgacaatatggggtctagagttgattatgatgcccctgggagatggtgcacaacaatggcttatagtgcggatggtacaaggctcttttcctgcgggacaagtaaagatggagaatcatttattgtcgagtggaatgaaagtgaaggggcagtgaagaggacatatcaaggattcaggaaacgttcttttggtgttatccagtttgacacaactagaaatcgttatttagccgctggcgatgatttctccattaaagtttgggatatggacaatgttaatctcttaacaactcttgatgctgatggaggcttgacggcaagtccacgtgtccgcttcaacaaggatggatctctcttggctgtttctatcaatgaaaatggaatcaaaatattggcgaattctgatggcatgaggttgttgcgcactttcgaaaatttttcatatgatgtatcaagaacaccagaaactctggtgaagccaaaagtaaatcccattacagctactgctgctactgctccaatcagtgctggacttgcagatagaggtgcccctgcagttgtgacttccggaatgaatggggatgcccgaattctaggggatgtgaaacccagaataactgaagaaagcaatgaaaaatctaaactttggaagctcactgaaataagcgaaccatctctgtgtcgatccttgaggctgcctgaaaaccaaagagcgaacaagatatcacgcttaatatatacaaactcagggagtgctattttggccttagcatcaaacgcagttcatcttctctggaaatggcagcgcaacgaccgcaattcaactggcaaggccactgccagtgtggcacctcaacaatggcaaccatcaagtggcattgttatgaccaatgatgtaaacaaaaataatccggaggaggcggttccctgctttgctctgtccaagaatgactcttatgtcatgtcggcatcaggaggaaaaatttccttgttcaatatgatgacattcaagacaatgacaacattcatgccgccgccgcctgcagcgacctttcttgctttccaccctcaggataacaatatccttgccataggcatggacgattccactgtccagatatataatgtccgtgtggatgaggttaagagtaagctcaagggccattctaaaaggataactggccttgcattctctaatacgctgaacgtgttagtttcatcgggtgcagatgctcagatttgtgtatggagttctgatgtctgggaaaagcaaaagagcacatacttgcagattccgcctggaaggacaccaggagcacagtcagatacacgagtgcaatttcatcaggaccaaatgcacttccttgctgttcatggtactcagcttgctgtatatgaagcaacaaaactagaatgcatgaaacagtgggttccatatgaatcttcggccccaatatctcatgctacgttctcttgcgatagccagcttgtttatgcgagtttctttgacgccagtatctgtgttttcaacgctgcaaacctcaggatgcagtgtcgcattaatccgtctgcttatcttcctgctactgtcagcaactcgaacgtgcatccactggtgattgctgcgcatccacatgagccaaatcagtttgcattgggactgtcagatggcggtgttcatgtctttgagcccctggactctcacagtagatggggcatgccgccaccggctgagaatggttcagcaagtggagtctcagcttcttcagctggcccttcaggctctgatcatgcagagagatgattttatagcctaaaaagtctcttttttaatgtttggcttgcatggccattgtgaatctaggaatgctttatgctgtcgtgctctttttatgttgcagacatcacaaacccatgctttatctatcaggaaatttttttatggtctctggtactgttactggctgcccattctccttcaaaatgccggcaaggcattataataataagtgagagaacagaagcaaattttcccaccaa

SEQ ID NO: 9258 - DNA, 4041 bp, Cajanus cajan
aatcacctctttctctctctatatatattttcgagtttctagagagagagcgagtagattagtccatttccgcgaggagagagaaagtgcgagaatcggaagagagagagggtttggtctgcgatgtgttagctttgaagatctagttcactgttgctcattctagtgtgtatctaatcgaagacgttgggggttctgatgtcgtctcttagtagggaattggtgttcttgatcttgcagtttcttgatgaggaaaagttcaaggagactgtgcacaagcttgagcaggagtcagggtttttctttaacatgaaatattttgaggatgaagtgcacaatgggaattgggacgaagtggaaaaatacctctctggtttcacaaaggtggatgataataggtattctatgaagatattttttgagataaggaagcagaagtatctggaggcattagataagcatgaccggtccaaagctgtagaaatattggtgaaggatttgaaagtatttgccacttttaacgaagaattgttcaaggaaatcacacagcttttgacattggaaaattttagggaaatgagcagttgtctaagtatggtgatacaaagtccgcccgagcaatcatgttggttgagctcaaaaagctcattgaagcaaatcccttatttcgtgacaaattgcaatttcccaaccttaaaaactcaaggttacggaccctcatcaatcaaagcttaaattggcagcatcaactttgcaagaatccacggccaaatccagatataaaaactctttttgtggatcactcatgtggacaaccaaatggtgcacgtgctccttcacctgctaataatccactactaggttccttgcctaaggctggaggatttcctccacttggtgcacatgggccttttcagcctacgccagcaccagtgccaacacccctggctggttggatgtcaaatcctaccacggtagcacatgctgcagtatctggaggtggagctataggtcttggtgctccatcgatccctgcttctttgaagcatcctaggacccccccaactaatccttctgttgactatccatctggagactcagatcatgttgctaagagaacaaggccaatgggaatttcagatgaggtgaatctacctgtcaatgtgttgtcagcaacattcccaggtcatggtcagcatagtcaagcttttaatgcacctgatgacatacctaaggctgtcgtgcgaactcttaatcagggttcatctcctatgagcatggactttcatccagttcaacaatctttacttcttgttggtacaaatgtgggggacattgctttgtgggaggtgggttctagggagcggttggtctcaagaaatttcaaagtttgggatcttagtgcatgttcaatgccatttcaggctgctcttgtcaaagatccgggtgtttctgtcaatcgtgtgatttggagtcctgatggtgctttatttggagttgcttactcaaggcacattgttcagatatactcttatcatggtggggaggaaatacgacaccacctggagattgatgctcatgttggtggagtaaatgatctagcattctcccatccaaataagcaactatgtgtgataacttgtggtgatgataagaccattaaggtatgggatgctgcttcgggtgcaaggcagtatatttttgaaggtcatgaggctcctgtttattctgtctgtccacattataaagaaaacattcagttcatcttttcaacagcattagatggaaaaataaaagcatggttgtatgacaatttgggatctcgtgttgattatgaagctccaggtcgatggtgcacaaccatggcttatagtgctgatggtacaaggctcttttcatgtgggacaagcaaagagggggaatcctctattgttgagtggaatgaaagtgaaggagctgtgaaaagaacttatcaaggatttcgtaaacgatctttgggagttgtgcaatttgatacaaccaaaaatcggtttttggctgctggtgatgatttctccatcaaattctgggatatggataatgttcagcttttgacaactgttgatgctgatgggggtcttccagcaagcccacgtattcgtttcaacaaggatggaactcttttagctgtctctgcgaatgagaatggaattaaaattttagccaatggggatggtattcgtttgttgcgtacactagagaattcttcatatgatgcatcaagacaaccagaagtcttggcaaagccaacaattaatccaatttctgctgctgctgctgctgcaaccagtgctgcactggcagagagggcttcgtctgtagtagctattgccggaatgaatggggatacccgaaacttgggtgatgttaaacctagaataagtgaagaatcgaatgacaagtcaaagatatggaagctcactgaaatcaatgaaccatctcaatgtagatccttgaagctacctgagaatgttagagtaaacaagatatcaaggttgatatatacaaattctggtaatgctattctggcattagcatcaaatgccattcacctgctttggaaatggcagcgaagtgagcgtaactcgtctggcaaggccactgctactttgcaacctcagttgtggcaaccatctagtggcatcctgatgaccaatgacattgctgatagcaatcccgaggatgctgtaccctgctttgccttgtccaaaaatgactcgtacgtaatgtctgcatcaggagggaagatatctctgttcaatatgatgacttttaagactatgacaactttcatgcctccgcctcctgcagcaacctttctagctttccatcctcaagataacaatattattgccataggcatggatgattcctctattcaaatatacaatgtccgtgttgacgaggttaaaagcaaactcaaaggccatactaaaagaattactggtcttgctttctctcatgtattgaatgtattagtttcatctggagcagatgctcagatttgtgtttggaatactgatggatgggaaaagcagaagtctagattcttacagcttcctcctgggaggacaccaccagcacagtctgatactcgtgtacagtttcatctagatcaattacaattcttggttgtacatgaaactcagctcgccatttatgaagcaacaaaactagatggtctaaaacagtggttcacgcgagattcatccgcaccaatatcacatgcaacttactcatgtgatagccagctgatatatgccagctttttagacgcaacaatctgtgtatttagtgcttcaaatctcagattacgttgtcgtatcaatccttcttcttatcttccttcaagtgtcagttccaacgtacaaccgcttgtaatcgccgcacacccacaagaaccaaatcagtttgctgtaggtctgtcagatgggggagttcatgtttttgaaccccttgaatctgagggtaagtggggtgtgcctcctcctatagagaatgggtcagcaagcaatgtggcagctacttcagttggaccttcttcagatcaagctcaaagatgatccctgtcagcctaagacaagtttcttttacatacttggcttgctggccagtcattttaagaactaaatttgtacttaagttaatgatgcagtgcagggcactctccaattcagttgatccaatccacaatcacgtcatgccagaactctggagcaactcttttggttgaaggccaaaaccacattgtaattttccaatagatgtgattttttttttcaagttttaatgctacagatgtacaagttcttttgagtactttcaaagcttcttctggctatttaattagattggttgatcctaacttattgccttttcttagttccattcctgtcttgcatgtgtgctaatcttgtcttcatcatactttctatacaatttgtaacttgtgtgacgtagtttaaccaagaatgaggagtaaagctgtagtcttctaccatc

SEQ ID NO: 9259 - DNA, 3782 bp, Brassica rapa
aaataatattgaagagagagagagagagagagaacccaaatccttcgcctctttcagctgaggagagagaaactgaagctctggctttgtgaaatcgatctctcttcttcttcatgatctggtgattggtttggtggggattgcgcatctgagttgaaaagacatgtcttctcttagtagagagctcgtgttcttgatcttacagtttctagatgaagagaagttcaaagagactgttcataagctggagcaagagtctgggtttttcttcaatatgaagtattttgaggatgaagtgcacagtggaaactgggatgaggtggagaagtatctctccggatttaccaaagttgatgataatagatactccatgaagatattcttcgagattaggaagcagaagtatctcgaggccttggataagcatgatcgtccaaaggctgttgaaattttagtgaaagatttgagagtgttttccacttttaatgaggagcttttcaaggaaatcactcagctcttgaccttagaaaacttcagggagaacgagcagttatccaagtatggagacacaaagtcggccagatccatcatgttggtggaacttaagaagttgattgaagcgaatccattattccgtgataagctgcagtttcccacccttagaaattcacggctgagaacgctgattaaccagagcttaaactggcaacatcagctctgtaaaaacccaaggccaaatcctgatatcaagactctctttgtggatcactcctgtcgcttacctaatgatgcacgagcaccatcacctgtcaacaacccgctgcttggatcactaccaaaagccggaggatttcctcctttaggcgcacatgggccatttcaaccaacaccttctcaggttccgacacctcttgctggttggatgtctagttcttcctctgttcctcatccagctgtgtctggaggagccatagctctaggttctccatccatccaagcagccttgaagcacccgagaactcctccaagtaattccgctgtagaatatccatcaggtgattcggaacatgtctcaaaaagaacaagacctatgggaatctctgacgaggtgaatcttggtgtgaacatgttaccgatgacattcccgggacaggcacatggtcatacccaagccttcaaagcacctgatgacttgcctaagacagtagcacgaactttgagccaagggtcatctcccatgagcatggattttcatccaatcaaacagactctcctactagttggtacaaatgttggggatattgggctctgggaagtcggttctcgagaacgtctagtacaaaagactttcaaagtctgggacttgagtaaatgttcaatgcccttgcaggctgcattagtgaaagaacctgtcgtttctgtcaaccgtgtgatttggagcccagatggttctttattcggagttgcttattcgagacatattgtacagctatactcttatcacggtggtgaagatatgagacaacaccttgagattgatgctcatgttggtggtgtaaatgacattgcattctccactccaaacaagcaactatgttttactacttgtggtgatgacaaaaccatcaaggtctgggatgctgcaacgggtgttaaaaggcatacttttgaaggccatgaagctcctgtttactctatctgccctcactacaaggaaaacattcagttcatcttttcaactgcgcttgacgggaaaataaaagcgtggctatatgataatatgggttctcgggttgactacgaagctcctggtcgctggtgtacaacgatggcctacagtgctgatgggactaggctattttcttgtgggacgagtaaagatggggattcatacatagttgagtggaatgaaagcgaaggagctgttaagagaacttatcaaggattccacaagcgttctcttggagtcgttcagttcgatactactaaaaaccgctatcttgctgctggtgatgacttctccattaagttctgggatatggacaatgtacagctgttgactgccattgatgctgatgggggtcttcaggcaagcccgcggatccggtttaacaaggaaggctctctcttggccgtttctgccaatgacaatatgattaaggttatggcaaacacagatggtttaaggctgttgcatacggtcgacaacttatcttctgaatcctccaagcctgcaatcaacaacattgcggtggcagagagagctgctgagagacctgcctctgtagtttccatccctggaatgaatggagattcacggaatatggtagatgtgaagccagtgatcactgaagaatcaaatgataagtctaagatatggaagcttactgaagtcggtgaaccctctcagtgccgctcgttgagactccctgagaatatgagagtcaccaagatatcgagattgatcttcacaaattctggaaatgcgatattggcattggcatcaaatgctattcatctgctctggaaatggcagcgaaatgaccgtaacgctactggaaaggcaacggcttcgttacctcctcagcagtggcaaccagcgagcggaatcttaatgacaaacgatgtgactgaagctaattcagaggaagctgtgccgtgttttgctttatctaagaatgattcctatgtgatgtcagcatctggaggaaagatctctttatttaacatgatgacgttcaagacaatggctactttcatgccgcctccgcctgctgcaacgtttctggcttttcaccctcaggacaacaatataattgcaattggaatggatgatagtacaatacagatttacaatgttcgcgttgatgaggtcaagagcaagcttaaaggacattccaagagaataaccggcctcgccttctccaacgtactaaacgttctggtttcgtctggagcagacgctcagctttgtgtatggaacacggacggatgggagaagcagaggagcaaggttctgcaagttccacagggaagatcaacgggtgctctttcagacacgcgtgttcagtttcatcaagatcaagtacacttcctcgtggtccatgaaactcagctcgctatatacgaaacaacgaagcttgaatgcatgaaacagtggcctgtgcgtgaatcatcagctccaatcacacatgccacattctcatgtgatagccaattgatatacgcaagtttcatggatgctacaatctgtgtcttcacctctgcaaaccttcgattgcgttgcagagtcaatccctctgcgtatcttcctgcttctctcagcaactcgaacgtccatccgctggtgattgcggctcatcctcaagaatccaatatgtttgctgtgggtctctcagacggtggggtccatatattcgagccgcttgagtaagaaggtaaatggggagcggctccaccgcctgagaacggctcatccagcgctctggcgtctacaccttccgttggagcttccgcatccgatcagcctcagagatgatatgaaacagaacctgctccggtgaatgtattaatgtaacatattatctatagcaaggtgaaacagtttcctaattggttgattcgttggcacttttgtttttgaatagtgaaataattcgttgttgcttgcttcttatggcttttaaagtttggatgaatctccaatatttaaggttttctaatttggtactaaatcccaatatcatttcacagaaaaactagaaggaaaaagttaaaccaga

SEQ ID NO: 9260 - DNA, 3538 bp, Musa acuminata
tgaggtggagtcaggggcaagacaatgtcgtctctcagcagagagctggtgtttctgattctgcagttcctcgatgaagagaagttcaaagaaacagttcacaagcttgagcaggaggctggcttctatttcaatatgaagtattttgaggatgaggtgcataacgggaattgggataacgtcgagcggtacctctctggcttcaccaaggttgatgacaaccggtactccatgaagatatttttcgaaataaggaagcagaagtatcttgaagcattggacaagcatgaccgagcaaaagcagttgaaatccttgtcaaggatttgaaggtctttgcctcatttaatgaggagctatttaaggaaatcacacaacttctaactttggagaatttcagggagaatgagcaactctcaaagtatggggatacaaaatcagcacggaccataatgcttgttgagctcaagaagctgattgaagcaaaccctctattccgagataaattacagtttccaaacctaaaaagttctagactacgtaccctaattaaccaaagtttaaactggcagcatcagctatgcaaaaaccctaggccaaatccagatattaaaactctttttgttgatcattcatgcggacaaccaaatggtgctcttgctccatcaccggcaaacaatccactacttggatccatgcccaaagcaggaggttttccaccgttgggtactcatgcgccttttcaaccagtgccagcaccagttcctacacccctggctggctggatgtctaatccttcagctgtaacccatccagttgtctctggtgcagctattggactcaatgcacctacaaatcctggtagtgtggtggactctgtgatagctgtggcaattttgaagcatccaaggactcctccaacagccaacccttctatagagtattcatcagcagattctgaccatgtatcaaaaagaacaagacccattggaatttctgatgaggtaaatctgcctgtaaatatactgccagtttcttatcctcagaatcataaccaggctacatacactatagaggacttgccaaaaacagttgcacgaacgctgagtcagggctcgaaccccatgagcatggattttcatccattacaacggactattcttctcgttggtacaaatgtgggagacattgctttatgggatgttggcactagggagagattaattcataagaacttcaaagtttgggagcttggaacttgctccatgtctcttcaggcatctctggttaaggatcctgctgtatcagttaatcgaataatatggaacccagatggctccttgtttggtgttgcttattcgaggcacattgtccaaatatactcttatcatggtagtgatgatatcaggcagcatttggagattgatgctcatgttggcggtgttaatgatattgcatttgctcatcccagtaagcagctttcttttataacttgtggagatgacaagacaattaaggtgtgggatgcaactagcggcacaaaacagtatacctttgaagggcatggggcacctgtgtattctgtttgccctcatcacaaggagaacattcagttcatcttttcaaccgcactagatggaaaaataaaggcatggttgtatgacaatctgggatccagggtggattatgatgccccaggacattggtgtactacaatggcctatagtgctgatggttcgaggctgttttcatgtgggactagtaaagaaggggaaacattcatagtggaatggaatgaaactgaaggagctgtgaagagaacataccaaggatttcgaaaacgttctttgggtgttgtgcaatttgacaccacacggaaccggtttttggctgctggagacgagtttttaatcaagttctgggatatggataatactaatttattaacaaccattgatgctgatggtggccttccagcaagcccaaggatacggtttaacaaggaaggaacattattagctgtttctacacatgataatggaattaaaattttggcaaatgctgatggaattcgtctgttgcgcacacttgaaaatcgttcttttgatgcgtctaggactgtttcagagactataacaaagcctatgatgagcccattgtctgctgctgctgttgcaactacctctggaataactgatagaactgctccatctatgccaatatctggaatgaatggagatggcagaaacttggtggatgtaaaacctagaattactgatgaatcgatggacaaatcaaagatctggaagcttacagaaatcaatgaaccaactcaatgtcggtctttaaggcttatggataatcttagaacaagcaagatttcgagactgatctacaccaattctggtgctgccattttggctttagcatcaaacgcaattcacctactctggaagtggcctcgtaatgaacgcaattcaagtggaaaggcaacggcaagtgttgcccctcaattatggcaaccaccaagtggcatattgatgactaatgaaattactgacacaaatcctgatgaagttgtccactgctttgcattgtcaaagaatgattcatacgtcgtgtcagcatcaggagggaaaatatctctattcaacatgatgacttttaagactatgacaacattcatgccaccaccacctacagcaacttttctcgcatttcatccactagacaacaatataattgctataggaatggatgactctacaattcagatatataatgttcgagttgatgaggtcaagagaaaacttagaggccactcgaagagaattactggtcttgccttttcgaatgccttacatgtgctggtctcatctggagctgatgctcagttgtgtgtttggggaactgaggggtgggagaaacagagaagcagatttctgcagatccaatctgctcgcactccatcaaccatctcagacacacgtgttcagttcgatcaagatcaaatacacttcctagctgtgcatgagacccagattgctatatatgaaactactaaactagaatgtgtcaagcagtggtctcctcgtgaaggttctgcgcccatatcacatgcaacattctcttgtgacagtcagtcgatatatgctagtttcttagatgccactgtatgtatatttaatgctgcaaacctcaagttgcgttgtcggatccttccggctgcatatctccctgccagtgtcagcacaaatgtacatccgctcgtgattgctgcacatccatcagagccaaaccaatttgcccttggtttgactgatggtggtgtccatgtggtaaagccactagaatctgaaggcaaatggggtgttaatccacctgctgagaatgggtcggcaagcagcttgtccgcgccgcccaccaccgctggaccctctagctcagatcaacctcagaggtgatgcaaattattgcgagcacattattagacctttttgttctcattctctctctctctctctctctctcttgagtggc

SEQ ID NO: 9261 - DNA, 3990 bp, Setaria italica
accgcaagtctccaacctgcctcggtgatttggtggtctccggcaaccaggatcgtcgccggcggcggtcgttcccgcggcgagatcgatcggatcgatccacgctcaaagcttccagagaccccataggatacgatcctgggcgcatccgcctccgcgtgggtgaggcggaggggagaggaggatgtcgtcgctcagccgggagctggtctttctcatcctgcagttcctcgatgaggagaagttcaaagagactgtccacaagctcgagcaggagtccgggttctacttcaacatgaagtactttgaggatgaggtcatcaatggcaattgggatgaggtggagcgctaccttggtggcttcaccaaggtcgatgacaaccgctactcgatgaagatattctttgagatccgcaagcagaagtatctcgaggctcttgataagcatgatcggtccaaggctgttgaaatcttggtcaaggacttgaaggtctttgcatccttcaatgaggagctttttaaggagatcacgcagcttctgaccttggagaacttcagggaaaatgagcagctctccaagtacggtgatacaaagtctgcaagagcgataatgcttgttgagctgaagaagctgattgaagctaatcccttatttcgcgacaagctacagtttcccaaccttaagaattctaggttgcggacacttatcaaccagagcttgaactggcagcatcagctttgcaaaaatcctaggcctaatcctgatatcaagactctttttgttgatcactcatgtggacaaccaaatggtgcacgtgctccatcaccagcaaacaatccgttgcttggatctatacccaaaccaggaggtttccctccattgggtgctcatggaccttttcaacctgcgccaacaccggtcccaccgctggctgggtggatgtcaaaccctccagcagtaacacaccctgccgtgtctggtggtgctattggatttggtactcctacgaatcccgccgctttattgaagcatcctaggacgcccacaacagctaatcctagtatggattatccatcaggagattctgatcacgtctcaaagagatctagaccagttggcatggctgaggaggtgaatcttcctgtgaacatgttgcctgtgacttacccgcagagccataattaccaacaagaagatttccataaaactgtggcacggaccttgaaccaaggatcagccccgatgagcatggatttccatccacttcagcaaactcttcttcttgttggtaccaatgttggtgacataggattatgggatgttggtacaaaagatagactagcattaagaaacttcaaagtttgggagcttggaaaatgttcgatgaccctccaggcatcgctcgttaaggatcctgctgtgtcagttaatcgcataatatggagtcctgatggaaccttgtttggtgttgcttattcaaggcatattgtacagatttattcctataacggtggcgatgatattaggcaacacttggagattgatgcacatgttggtggtgtaaatgacattgcatttgctcatccaaataagcagctatgtataattacttgtggagatgataagacaattaaggtatgggaggccactagtggagcaaagcaattttcctttgaaggacatgaagctcctgtttattcagtttgtccgcattacaaggaaaatattcagttcatcttctcaactgctttagatggaaagatcaaggcgtggctatatgataatttgggatctagagttgactatgacgcaccaggtcactggtgcactacaatggcatatagcgcagatggttcaaggctattttcttgtggcactagcaaggagggtgaatcacatctagtagaatggaatgaaagtgaaggagctgtgaagagaacatatcagggattccgtaagcgatccatgggtgtcgtgcaattcgataccacccgaaacaggtttttggctgctggagatgaattcatggttaagatatgggacatggacaacacaggtcttttgaccactattgatgctgatggtggcttacctgcaagtccacggatacgcttcaacaaggaggggactctgttggctgtttctactcttgacaatggtgtcaagatcttagcaaacgctgatggacttcggttattgcgcacgttggaaaatcgttcttttgacgcttcccgtaatgcaactgagactgtaacaaagcctctaataaatccattgactgctgcggcaaatgcagctgcagcaagcagttcaggaactcctgctccagcagctataactgcaatgaatggtgataccagaggtttggttgacgtaaaacctagaattactgatgagtcattggacaagtcaaaggtatggaaacttatggagataactgagtcaactcagtgcagatcaattaaactggcggataacatgagagcaagcaagatttcaagactgatttacacaaattctggtgttgctattttggctctaaccgcaagcgctgttcatctactctggaaatggccacgcagtgatcggaattcatctggcaaggccaccgcgagtgtgtctcctcaactatggcaacctccgagtggcatctttatgaccaatgacatgactgacaataatcctgaagatgctgttcactgctttgctttgtcaaagaatgattcatatgtcatgtctgcttctggaggaaaaatctctctattcaacatgatgactttcaagactatgacgacatttatgcctccaccgccggcggcaacttttcttgcatttcaccctcaagataacaatataattgcaattggaatggatgattcgaccatccaaatctacaatgtccgaattgatgaggtcaaaagcaagcttagaggtcactctaagagaatcacaggtcttgccttttcgaatgtgctaaatgtgttggtctcttctggagctgacgcacagttgtgtgtttggaacacggatggatgggagaagcaaaagaacagatttttgcagataccatcaggtcgcccatccaacatactagacactcgggttcagttccaccaagaccaaatgcactttcttgttgtgcacgaaactcagattgccatttatgaaaccacaaagctagaaccggtgaagcagtggcctgttcgagagaattcacctccaataacacatgccacattctcgtgtgatagtcaactgatctatgcaagctttatggatgctactgttggtatatttaatgcatcgagtttgagactccaatgccgcattcttccagcttcatatcttcctccaagtatcagttcaagtgttcatcctgttgtggttgcggcacacccttcggaagcaagccagtttgctctaggattgacagatggtggtgtttatgtattggaacctttggaatctgagagaaaatggggaaatcctccaccagcggagaatgggtcaacaagcaacttgtccacaccacctcctaatggtgcttcaagttcagatcaaccagaaagataatcaggagaagttgaaggggtagtgtttttgtggcatgagtcactaaccaagatgggcttcaaagggtggtgcaactaaccttggccaagctgcttccaagggtctagttgacggtgcgctcaataaaagcaagctcaacagcagtttatccgttgctcatatatcttttccattgactgtattgagtggagggaattagtcctagtattccattttgctttgtttccgtgctgtgaaaaggagttttatatcattagtagataagcactagtacgagtaccagtttggctgtacttggtacctatatttctgacaattagtggaagtgtcgcattttcttttgctttttttttcggtccccgctctacccccttttgtgactatgaaaatgctatttgtggcattatttttcgacg

SEQ ID NO: 9262 - DNA, 4140 bp, Sorghum bicolor
cccaacctggttcggtggtgatttcatctccctctacccggttccgtgctgatcaactgcatccaggatcgtcgccggcggccgttcccacgccgagatcggatcgatcgaaagcttcctaggtctggacctgcggtagacctcaaagcctcgatcgcaccgcatcttctctctctgctgctcgtccgctccgtcgccgccgaccccgccgccagcttccccttccacctaaaaggacggccgctggcggcctgccccgcccccgacgcgtcggtttccactggataggcgtggggcggcgatccgtccggacctagggttgcgagaccctatagggtactaccctaggagcagccgcctccacgtgggtgaggcggaggagggaggatgtcgtcgctcagccgggagctagttttcctcatcctgcagttccttgatgaggaaaaattcaaagagaccgttcacaagctggagcaggagtccggattctatttcaacatgaagtactttgaggacgaggtcatcaatgggaattgggatgaggtggagcgctacctcggtggattcaccaaggtcgacgacaaccgctactccatgaagatattcttcgagatccgcaagcagaagtatctcgaggcccttgataagcatgatcggtcaaaggctgttgaaatcttggtcaaggaccttaaggtctttgcatccttcaatgaggagttgtttaaggagatcacacagcttctgaccttggaaaactttagggaaaatgaacagctctctaagtatggcgatacaaaatctgcaagagcaataatgcttgttgagctgaagaagctgattgaagctaaccctttgttccgcgacaagctacaatttcccaacctgaagaattctaggctgcggacacttattaaccagagcttaaactggcagcaccagctttgcaaaaaccctaggcctaatcctgacatcaagactctttttgttgatcattcgtgtggacaaccaaatggtgcacgtgctccatcaccagcaaacaatccgttactcggatctatgcccaaacctggaggtttccctccattgggtgcccatggaccttttcaacctgcaccaacgcctgtcccacctctggctgggtggatgtcaaaccctccagcagtaacacatcctgctgtgtctggtggtgccattggatttggcactcctacaaatcctgccgctttgttgaagcatcctagaacacccacaactgctaatcctggtatggattatccatcaggagattctgatcacatctccaagagaactagaccagttggcatgtctgaggaggtgaatcttccggtgaacatgctgcctgtgacttatccgcagagccataattaccaacaagatgatttccacaaaactgttgcacggaccttgactcaaggatcaacaccgatgagcatggatttccatccacttcaacaaactcttcttcttgttggtaccaatgttggcgacattggattgtgggatgttggtaccaaagagagacttgttgtaagaaacttcaaggtctgggaccttagtaaatgtacaatgaccctccaggcatcactggttaaggatccagctgtgtcagttaatcgcataatatggagtcctgatggaaccttgtttggtgttgcttattcaaggcatattgtacagatttattcctataacggcggtgatgatcttaggcaacacttggagattgatgcacatattggtggtgtaaatgacatcgcatttgctcatccaaataagcagctatgtataattacatgtggagatgataagacaattaaggtatgggaggccactagtggaactaagcaatttacctttgaaggacatgaagctcctgtttattctgtttgtccacattacaaggaaaatattcagttcatcttctcgactgctttagatgggaagattaaggcatggctatatgataatttgggatctagagttgactatgatgcaccaggtcattggtgcactacaatggcatatagcgcagatggttcaaggttattttcctgtggcactagcaaggatggtgaatcacatctagtagaatggaatgaaagtgaaggagcagtgaagaggacatatcagggattccgtaagcgatccatgggtgttgtgcaatttgataccacccggaacaggtttttggccgctggggatgaattcatgattaagatatgggacatggacagcacaggtcttctgactaccattgatgctgatggtggcttacctgcaagtccacggatacgcttcaacaaggaaggaactctattggctgtctctactcttgacaatggtatcaagatcttagcaaatgctgatggacttaggttgctgcgcactctggaaaatcgctcttttgatgcttctcgtaatgcaactgagactgtaacaaagcctctaatattgactgcggcaaatgcggctgcagcaagcagttcagtagctgctgctccgtcagctataactgcaatgaatggtgatagcagaagtttggttgatgtaaaacctagaatagctgatgagtccctggacaagtcaaaggtatggaagcttatggagataactgagtcaactcagtgcagatcaatcaaactggcggataacatgagaacaagcaagatctcgagattgatttacacaaattctggtcttgctatcttggctttaacttcaagcgctgttcatctactctggaaatggccacgcagtgatcgcaattctggaaaggcgaccgcgagtgtgtctcccaccctatggcaaccaccaagtggcatcttcatgactaatgacacaactgataataatcctgaagaagctgttcactgctttgctttgtcgaagaatgattcatatgtcatgtctgcttctggagggaaaatctctctgttcaacatgatgaccttcaagacgatgacaacatttatgcctgcaccgccagcagcaacttttcttgcatttcacccccaagataacaacataattgcaattggaatggatgactcgaccatccaaatctataatgtccgaattgatgaggtcaaaagcaagctcagaggtcactctaagagaatcacgggtcttgccttttcaaatgtgctaaatgtgctagtctcttcaggagctgatgcccagttatgtgtttggaacacggatggatgggagaagcaaaagaccagatttttgcagataccatcaggtcgccaatccaatatcttggacactcgtgttcagttccaccaagatcaaatgcattttcttgttgtgcatgaaacccagattgccatctatgaaactacaaaactagaaccagtgaagcagtggcctgttcgagagaattcacctccaatcacacatgccacattctcgtgtgatagtcaactgatctatgcaagctttatggatgctactgttggcatatttaatgcatcaagtttgagacttcaatgtcggattcttcctgcttcatatcttcctccaaatatcagtccgagtgttcatcctgttgtggttgcggcacacccttcggaagcaagccagtttgctctagggctgactgatggtggtgtttttgtgttggaacctttggaatctgagagaaaatggggaaatcctccaccagtagagaatgggtctgctagcaacttgtccacgccgcctcctaatggagcttcaagttctgaccaaccagaaagatgattaagaagttggaactggtagatttttcgtggcatgagtctaaccaagatgggcttcaaagggtggtgcaactaaccttggcagatcggttccaagggagtcagacaatgcgctcaataaaaacaagctcaacagcagtttatccgttgcttatatatatttctaatgactgtatcgagtgaggaggatagtcctagtatttcattttgctttgtttaccgtgctgtgaagagtttttatcagtagataagatgtagtacaactatcagtagataagatgtagtacaactatcagtttgggtgtgcttggtacctatatttattatgacttagtgaaagtatcttgtttcgtttgcctcttggccctgttccgcc

SEQ ID NO: 9263 - DNA, 4001 bp, Triticum aestivum
cccaaatcggaagccgcgcagcccccggatctccgccgccgggcgccccgccgacccgcgccgcctcgagccctccgccggccccgctctgctcgcccggcgcggggcggagcggaggagatccgagccggggaggttccttccgctgtgggggtcctgcgcccccgtaggctaggtctacagccgagttgcatccgccgcctggtgggtgaggagtcggggacgcggggatgtcttctctcagccgggagctcgtcttcctcatcctgcagttcctcgatgaggagaagttcaaggagaccgtccacaagcttgagcaggagtctggcttctacttcaacatgaagtacttcgaggatgaggtgatcaatggcaattgggatgaggtggagcgctacctcgggggcttcaccaaagtcgacgacaaccgctactcgatgaagatattctttgagatccgcaagcagaagtatctcgaggccctcgacaagcatgatcggtccaaggcggttgaaatcttggtcaaggacttgaaggtgtttgcatcctttaatgaggagctgtttaaggagatcacacagctattgactctggagaacttcagggagaatgagcagctctccaagtatggtgatacaaaatctgcaagagcaataatgcttgttgagctgaagaagctgatcgaagctaaccccttattccgtgacaagcttcagtttcccaatctgaagagttctagattacggacacttatcaaccagagcttaaactggcagcaccagctttgcaaaaatcctaggcctaatcctgacatcaagaccctctttgttgatcattcttgtggacaaccaaatggtgcacgtgctccatcaccagcaaacaatccactacttggatctatacctaaacctggtggtttcccccaattgggcgcccatggaccctttcaacctgcaccaacacccgtcgcacctctggccggttggatgtcaaaccctccagcagtaacacatcctgctgtttctggaggtgctattggatttggtactcctacgaatcctgctgctatgttgaagcatcctaggacaccctcggctgctaacccttctatggattacccatctggagattctgatcatgtcagtaagagacctaggccagttgggttgtctgaggaggtgaatcttccggtgaatatgatgccagtaacttatccgcagagccatagctacccgcaagatgatttccataaagctgtcgcacggacattgagtcaaggatcagctccaatgagcatggatttccatccagttcaacaaacacttcttcttgttggtaccaatgttggtgacattggattgtgggatgttggcaccaaggagagacttgttgtaagaaacttcaaggtttgggagcttgggaaatgttctatggccctccaggcagcactggttaaggatcctaccgtgtcagttaatcgcataatatggagtcctgatggaaccttgtttggtgttgcttattcaaggcatatagtacagatttattcttatcatggtggcgatgatattaggcaacacttggagattgatgcacatgttggtggcgtaaatgacattgcattcgctcatccaaataagcagctgtgtataattacctgtggagatgataagaccataaaggtgtgggaggccaccagtggaacaaaacaatttacctttgaaggtcatgaagctcctgtctattccgtttgtccacattataaggaaaatattcagttcatcttttcaactgctttagatggaaagataaaggcatggctgtatgataatcttgggtccagagttgactatgatgcaccaggtcattggtgcactacgatggcatatagtgcagatggttcaagattattttcttgtgggaccagcaaggagggtgaatcacacctggtggaatggaatgagagtgaaggtgcggtgaagagaacataccagggatttcgtaagcgatctatgggtgttgtacaatttgatacgacgcggaataggtttttggctgctggagatgaattcgtgataaagatttgggacatggacaacactagtcttctgactaccattgaagctgatggtggcttacctgcaagcccgcgtatccgctttaacaaggagggtactctgttggctgtctctactgttgataatggtatcaaagtcttagcaaatgctgatggtgttcgtttattgcgcacactggaaaatcgttcttttgatgcttctcgtagtgcatctgagactgtaacaaagcctcttataaacccattgactgctgctgccgcggcagctgccgccgccgccgctgcaaccagttctggaactgctgctccatcatctataactgcaatgaatggggacaacagaagcatggttgatgtaaaacctagaatagctgatgagtcaatggataagtcaaaggtctggaagcttatggagataactgatacagctcagtgcagatcactaaaactaggtgatagtattaggacagctaagatctcgagactgatctacacaaattcaggtgttgctatcttggctttagcttcaaatgccgtccatctactgtggaaatggccacgtaatgaacgaaattcaactggaaaggctactgctagtgtttctcctcaattatggcaacctccaagtggcattctcatgactaatgacacaattgacaatagtcctgatgaggccgttcactgctttgctttgtcaaagaatgattcatatgtcatgtcagcttcaggagggaaaatctctctattcaacatgatgacttttaagacgatgacaacgtttatgcctccaccaccagcagctactttcctagcattccatcctcaagataacaacataattgcaattggaatggatgattcaaccatccaaatttacaacgttcggattgatgaggtcaaaagcaaacttagagggcactctaagaaaattacaggtctcgccttttcaaatgtgttaaatgttttggtatcctctggagctgatgcacagatatgtgtttggaacactgatgggtgggagaggcaaaggagcagatttttgcagataccgtctggccgcccaacgtccaacatcttagacacacgagttcagttccaccaagatcaacagcattgtcttgttgtccatgagacccagattgccatctatgatgcctcaaaactagaacccgtgaagcagtggcctcctcgggagacctctgctcctccaataacgcatgctacattctcatgtgatagtcaactgatttatgcaagctttctggacgccactgtctgcatatttagcgcatcaagtttgagactccaatgccgaattcttccagcttcttatcttcctcaaaatatcagttcaaatgttcatccagttgtggttgcggcacatccttcggaggcaaatcagtttgctctaggccttactgatggcagtgtttatgtcatggaaccgttggaatctgagagaaagtggggaattcctccaccagcggagaatggatcgacgagcaacatgtccacacctcctaatggagcttcgagttctgatcaaccagaaagataataactacaagtttgaagtgttagacctttctatcacttcgactcttcatggcggtatgagtcactaaccaagatgggcttcagttttacaacttggcttcacagagctggttccaagggtggtgtcgacaagagcacaataaaaaaccaaggcttaactgcagttcgtgtgttgcttatattatatgttgctattatattaccattattaagtgagggaggaattgattagtgccagtgtttgattttgttctgtttgtcatggtacgaggaaagattaccgagtagataaggtctagtagcagtttcgctgtacctaatcagtacccttgtttcattccgactagtaagtaaaaacttgtttttt

SEQ ID NO: 9264 - DNA, 3995 bp, Triticum aestivum
ggagatccgagccggggaggttccttccgctgtggggggtcctgcgcccccgtaggctaggtctacagccgagttgcatccgccgcctggtgggtgaggagtcggggaagcgaggatgtcttctctcagccgggagctcgtcttcctcatcctgcagttcctcgatgaggagaagttcaaggagaccgtccacaagctcgagcaggagtctggtttctacttcaacatgaagtactttgaggacgaggtgatcaatgggaattgggatgaggtggagcgctacctcgggggcttcaccaaagtcgacgacaaccgctactcgatgaagatattctttgagatccgcaagcagaagtatctcgaggccctcgataagcatgatcggtccaaggcggttgaaatcttggtcaaggacttgaaggtgtttgcatcctttaacgaggagctgtttaaggagataacacagctattgactctggagaacttcagggagaatgagcagctctccaagtatggtgatacaaaatctgcaagagcaataatgcttgttgagctgaagaagctgatcgaagctaaccccttattccgtgataagctccagtttcccaatctgaagagctctagattacggacacttatcaaccagagcttaaactggcagcaccagctttgcaaaaatcctaggcctaatcctgacatcaagaccctctttgttgatcattcttgtggacaaccaaatggtgcacgtgctccatcaccagcaaacaatccactacttggatctatacctaaacctggtggtttcccccaattgggcgcccatggaccctttcaacctgcaccaacacccgtcgcacctctggccggttggatgtcaaaccctccagcagtaacgcatcctgctgtttctggaggtgctattggatttggtactcctacgaatcctgctgctatgttgaagcatcctaggacaccctcggctgctaacccttctatggattatccatctggagattctgatcatgtcagtaagagacctaggccagttgggttgtctgaggaggtgaatcttccggtgaatatgatgccagtaacttatccgcagagccatagctacccgcaagatgatttccataaagctgtcgcacggacattgagtcaaggatcagctccaatgagcatggatttccatccagttcaacaaactcttcttcttgttggtaccaatgttggtgacattggattgtgggatgttggcaccaaggagagacttgttgtaagaaacttcaaggtttgggagcttgggaaatgttctatggccctccaggctgcactggttaaggatcctaccgtgtcagttaatcgcataatatggagtcctgatggaaccttgtttggtgttgcttattcaaggcatatagtacagatttattcttatcatggtggcgatgatattaggcaacacttggagattgatgcacatgttggtggcgtaaatgacattgcattcgcccatccaaataagcagctctgtataattacctgtggagacgataagacgataaaggtgtgggaggccaccagtggaacaaaacaatttacctttgaaggtcatgaagctcctgtctattctgtttgtccacattacaaggaaaatattcagttcatcttttcaactgctttagatggaaagataaaggcatggctctatgataatcttgggtccagagttgactatgatgcaccaggtcattggtgcactacgatggcatatagtgcggatgggtcaagattattttcttgtgggaccagcaaggatggtgaatcacacctggtggaatggaatgagagtgaaggtgcggtgaagagaacataccagggatttcgtaagcgatcgatgggtgttgtacaatttgatacgacgcgaaataggtttttggctgctggagatgagttcgtgataaagatttgggacatggacaacactagtcttctgactaccattgaagctgatggtggcctacctgcaagcccgcgtatccgctttaacaaggagggtactctgttggcagtctctactgttgataatggtatcaaagtcttagcaaatgctgatggtgttcgtttattgcgcacactggaaaatcgttcttttgatgcttctcgtagtgcatctgagactgtaacaaagcctcttataaacccattgactgctgctgccgcggcagctgccgccgccgccgctgcaaccagttctggaactgctgctccatcacctataactgcaatgaatggtgacaacagaagcttggttgatgtaaaacctagaatagctgatgagtcaatggataagtcaaaggtctggaagcttatggagataactgatacagctcagtgcagatcattaaaattaggtgatagtattaggaccgctaagatctcgagactgatctacacaaattcaggtgttgctatcttggctttagcttcaaatgccgtccatctactatggaaatggccacgcaatgaacgaaattcaactggaaaggctactgctagtgtttctcctcaattatggcaacctccaagtggcattctcatgactaatgacacaattgacaatagtcctgatgaggccgttcactgttttgctttgtcaaagaatgattcatatgtcatgtcagcttcaggagggaaaatctctctattcaacatgatgacttttaagacgatgaccacgtttatgcctccaccaccagcagctactttcctcgcattccatcctcaagataacaacataattgcaattggaatggatgattcaaccatccaaatttacaacgttcggattgatgaggtcaaaagcaaacttagagggcactctaagaaaattacaggtctcgccttttcaaatgtgttaaatgttttggtatcctctggagctgatgcacagatatgtgtttggaacactgatgggtgggagaggcaaaggagcagatttttgcagataccatctggtcgcccaacgtccaacatcttagacacacgagttcagttccaccaagatcaacagcattgtcttgttgtccatgagacccagattgccatctatgatgcctcaaaactagaacccgtgaagcagtggcctcctcgggagacctctgctcctccaataacgcatgctacattctcatgtgatagtcaactgatttatgcaagctttctggacgccactgtctgcatatttagcgcatcaagtttgagactccaatgccgaattcttccagcttcttatcttcctcaaaatatcagttcaaatgttcatccagttgtggttgcggcacatccttcggaggcaaatcagtttgctctaggccttactgatggcagtgtttatgtcatggaaccgttggaatctgagagaaagtggggaattcctccaccagcggagaatggatcgacgagcaacatgtccacacctcctaatggagcttcgagttctgatcaaccagaaagataataactagaagtttgaagtgtttagacctttctatcacttcgactcttgatggtggtatgagtcactaaccaagatgggcttcacttttacaacttggcttcacagagctggttccaagggtggtgtcgacgagagcacaataaaaaccaaggcttaaccgcagttcgtgtgttgcttatattatgtgttgctattatattaccattattaagtgagggaggaattgattagtgccagtgtttgtttttgttctgtttgtcgtggtacgaggaaagattaccaagtagataaggtctagtagcagtttggctgtacctaatcagtacccttatttcattccgactagtaagtaaaaacttgttttttcctcatgcccattgtttcatttgtcatatcatctggtgtgtgctcaaatctctgtatcggcctcttcatcatccagtaagaggctgcgcttctgttgggtcgttaaaat

SEQ ID NO: 9265 - DNA, 927 bp, Glycine max
gggctaaaattagaaccctaagcccctcagcgagacagccgccgccgccttcttcaataaccgtcgcaatcctctttcggcaaaaaaagaaaacccttcttctcactcatattcttacgcacacaaaacaagaaacacaacacagcaccaacctcggcagcacaacgtgctaacaattcaaagaaacaaaaacacagacacaaacaatggctggtcgattccgcgagctgatgaagaaatacggaaaagtcgcactcggggttcacttgagcgtctccaccgtttccatcacgggtctatatgtcgccatcagaaacaacgtcgacgtggaagccatcctcgagaagctccacatgggcaccgtttccgaggaacaaaaccctaaccctaacccctccgacgacgtcgctgcgccgcccaagaaccggacggctcagctcgccgcctcggccggcggcgccttcacgctggcgatcctctgcaacaaggcgctgttccccgtgcgcgttcccatcaccgtcgccctcactcctcccatcgccaggttccttgcgaggaggaagatcatcaagaccggcttatgaattggattcggtgaggagaatcgtgagattatatttatataccttgttgcattgttgggttttgtgagcatggaagtggaattacaagagggtttttgttttgtgaagaactggtttttctgcttaataaaggtcatggtatatgcttggcctcatttcttgttattcggggagaattagaattttaattggttacaatgttgggtttttatgttttgcaacaattagaaggatggggcatgtaactaacttgtgtcttgttcatttttagggtcatgctttactttagacataaaattggaatgaagtttcaattaatggatttgctttttaacttgcttta

SEQ ID NO: 9266 - DNA, 963 bp, Glycine max
attgttgaaaacggcatagtattgtatggcttgcttgggctaaaattagaaccctaagcccctcagcgagacagccgccgccgccttcttcaataaccgtcgcaatcctctttcggcaaaaaaagaaaacccttcttctcactcatattcttacgcacacaaaacaagaaacacaacacagcaccaacctcggcagcacaacgtgctaacaattcaaagaaacaaaaacacagacacaaacaatggctggtcgattccgcgagctgatgaagaaatacggaaaagtcgcactcggggttcacttgagcgtctccaccgtttccatcacgggtctatatgtcgccatcagaaacaacgtcgacgtggaagccatcctcgagaagctccacatgggcaccgtttccgaggaacaaaaccctaaccctaacccctccgacgacgtcgctgcgccgcccaagaaccggacggctcagctcgccgcctcggccggcggcgccttcacgctggcgatcctctgcaacaaggcgctgttccccgtgcgcgttcccatcaccgtcgccctcactcctcccatcgccaggttccttgcgaggaggaagatcatcaagaccggcttatgaattggattcggtgaggagaatcgtgagattatatttatataccttgttgcattgttgggttttgtgagcatggaagtggaattacaagagggtttttgttttgtgaagaactggtttttctgcttaataaaggtcatggtatatgcttggcctcatttcttgttattcggggagaattagaattttaattggttacaatgttgggtttttatgttttgcaacaattagaaggatggggcatgtaactaacttgtgtcttgttcatttttagggtcatgctttactttagacataaaattggaatgaagtttcaattaatggatttgctttttaacttgcttta

SEQ ID NO: 9267 - DNA, 1374 bp, Glycine max
gacaatttatattccaatctctacatcgcagtacgataaaaaaaaaaaagaaaaaaaaaagattgttgaaaacggcatagtattgtatggcttgcttgggctaaaattagaaccctaagcccctcagcgagacagccgccgccgccttcttcaataaccgtcgcaatcctctttcggcaaaaaaagaaaacccttcttctcactcatattcttacgcacacaaaacaagaaacacaacacagcaccaacctcggcagcacaacgtgctaacaattcaaagaaacaaaaacacagacacaaacaatggctggtcgattccgcgagctgatgaagaaatacggaaaagtcgcactcggggttcacttgagcgtctccaccgtttccatcacgggtctatatgtcgccatcagaaacaacgtcgacgtggaagccatcctcgagaagctccacatgggcaccgtttccgaggaacaaaaccctaaccctaacccctccgacgacgtcgctgcgccgcccaagaaccggacggctcagctcgccgcctcggccggcggcgccttcacgctggcgatcctctgcaacaaggcgctgttccccgtgcgcgttcccatcaccgtcgccctcactcctcccatcgccaggttccttgcgaggaggaagatcatcaagaccggcttatgaattggattcgatctatccaaccgttgagtgaatgcagcagagtttcagtatggccctgagatgattggaattggattacattaaattgtgccggtgacaaacgtactttgttaatcccttagatgatccttgcttcttggaaactttctcaaggttatttgaaggttaatatttgtgttgcagttgttccttgttcagcagaagacttaggtatagtggcgttttgttatttgagatgatcagggtcactgggttattggtttcataaaatatgttggcacaggaaaaactacctttggacatctttgaactgttttgaaaggactgaagtatgccattctttccaccttcaagttgaatcagcttcatctcatcactacgtacctattgtttatctgccctgggaagaattttatttttaatgtctacatagtaacatgtgaaattaggagtcatccttttgaggaaaaaatgactttgctactcaggacaaccaccagttaaatcattcgggacaagtttgagttgacctttttatttgattgtgttttcctgatgacttgttgtcaatgttgtgggtaatgtaagatttccttacaaccatctttatctaggacgcctgattaccgtaacaaaccttatttttgtaacaaaccatcgttatgtaacactatattttgtctattatttttt

SEQ ID NO: 9268 - DNA, 766 bp, Vigna unguiculata
tcttcaccgccaccactcctattccagctaaaattctccattgttctcgctctcacgcactctttctctctgtctatctctctcgcagacacacacaaagcacggcactatcctcagtggaacaaagttgtaacaatttcaaagcagtaaaaccacacggaaacaatggctggtggtcgattccgcgaactgatgaagaaatacggcaaagtggccctcggcgttcacctgagcgtttccacagtttccatcacgagtctctacgtcgccataaagaacaacgtcgacgtcgaagccatcctcgagaagttccacatgggcgccgtctctgaccaggaaaaccctaaccctaaccctatcgacgaagacgcctcgcaacctcccaagaaccggacggcgcaggtcgccgcatccgccggcggagccttcacgcttgcgatcctctgcaacaaggcgctgttccccgtgcgcgttcccatcaccgtcgcactcactcccccaatcgcaaggttcttggcacggaggaacatcatcaagagtggtgtgtgacctggattcggtgcgtggtgtattcttcttgcttgtgacgaggatcgtgagattatgtttacatttgtataccttgttgcattggtggggtttttgagacctgagagtggaatagcaaaagggttttacttttcttagaactagtttttctgcttaataaaggtcctggtatatacttagtttaattcattggtatggttggagtaatcgagtggac

SEQ ID NO: 9269 - DNA, 759 bp, Glycyrrhiza uralensis
aagacaaaaccctaagccggaagaagtggcaatcagatccttcacaaagtagaaaataaaaacaaaacaaaaacgaaacctccagctccgccgcccccgccgccgccacattgcaaaacgaaacctcgtcttttcattcccgaaaagccccttagttacgttaaccctcactcactcactcacttcactatcccacaaaacagaacagaaacaaaaaataacaccagtattccctggtagctaggtacgaggttaaacttcaaactcactgacacgacaatggccgctggtggtcgattccgcgagctgatgaacaagtatgggaaggtagcgctgggcgttcacctgagcgtctccgcagcttccatcaccggcctctacgtcgctatcaggaataacgtcgacgtcgaatccatcctcgagaagttccacatgggcacttctgttacccccgaagaaaaccccaaccctagctccgatcctgacccttccgcagctccggtgaagaaccgcacggcgcagatggctgcctccgccggcggcgcattcgcactcgccatactctgcaacaaggctctgtttcccgttagggttcccatcaccgtcgccctcacacccccaatttcgaggtttttggcgaggaggaacatcgtcaaaactggtgtatgacctcacattttggtatttgctgtattgttgttgttgaggtgtgagaaggactacaataacgattgagattttaaaacttttttttttgca

SEQ ID NO: 9270 - DNA, 1001 bp, Phaseolus vulgaris
agacatttaaaaccctaagcccctcaccgagagagaagccgccgccttcttcaccgccaccactcctattcccgccccattgatcactctcactcattctctctctctcagacacacaaacaaatacagcactagcctcagcggcacaacgttgtaacaattgaaagaagtaaaaccacacagaaaaaatggctggtggtcgattccgcgagctgatgaagaaatacggcaaagttgccatcggcgttcacgtgagcgtttccgcagtttccatcgggggtctctatgtcgcaataaagaacaacgtcgacgtcgaagccatcctcgagaagttccacatgggcgccgcctccgaccagcaaaaccctaaccctaccgacgaaggcgcctcgccgcctcccaataacaagacggcgcagctcgccgcctccgccggcggagcctttactcttgcgatcctctgcaacaaggcgttgttccccttgcgcgttcctatcaccgtcgcgctcactcccccagtcgcaaggttcctggcgcggaggaacatcgtcaagagcggtgtgtgacctggattcggtgcgtgctatattcttcttgcctgtgacgaggatcgtgagattatatttatatttgtataccttgttgcattggttggttttttgagacctgaaaggggaataacaaaagggttttcattttctaaggactagtttttctgcttaataaaattcctggtacatacttagtttaatttattggttggagtatggagtggacaaaacttacgtgcaattctagaagctcaatttgattttgttcgatcatcagaattggagttttagtaggaaagaaatgcacacaatactaatacaagtgtgatgatcttgagagattggtttatgtgtatctctcttcaacttaattaccctgtactagagaggatactctctctttatgtaaaacttttattgtacaactcaatgcaaacttttttatgcaaa

SEQ ID NO: 9271 - DNA, 902 bp, Phaseolus vulgaris
agacatttaaaaccctaagcccctcaccgagagagaagccgccgccttcttcaccgccaccactcctattcccgccccattgatcactctcactcattctctctctctcagacacacaaacaaatacagcactagcctcagcggcacaacgttgtaacaattgaaagaagtaaaaccacacagaaaaaatggctggtggtcgattccgcgagctgatgaagaaatacggcaaagttgccatcggcgttcacgtgagcgtttccgcagtttccatcgggggtctctatgtcgcaataaagaacaacgtcgacgtcgaagccatcctcgagaagttccacatgggcgccgcctccgaccagcaaaaccctaaccctaccgacgaaggcgcctcgccgcctcccaataacaagacggcgcagctcgccgcctccgccggcggagcctttactcttgcgatcctctgcaacaaggcgttgttccccttgcgcgttcctatcaccgtcgcgctcactcccccagtcgcaaggttcctggcgcggaggaacatcgtcaagagcggtgtgtgacctggattcggtgcgtgctatattcttcttgcctgtgacgaggatcgtgagattatatttatatttgtataccttgttgcattggttggttttttgagacctgaaaggggaataacaaaagggttttcattttctaaggactagtttttctgcttaataaaattcctggtacatacttagtttaatttattggttggagtatggagtggacaaaacttacgtgcaattctagaagctcaatttgattttgttcgatcatcagaattggagttttagtaggaaagaaatgcacacaatactaatacaagtgtgatgatcttgagagattggtttatg

SEQ ID NO: 9272 - DNA, 2904 bp, Sorghum bicolor
cccaagccacgccaccgacacgtgggaccataccactggtcccactcagcagagactccggcggtccttcgagacagcgagagccagaggcaacggctccggtcaccacgcgcgtctccgtctccttcctcgacacgactcccagtgggcaagtacactctcacgctcgactcgagcgcacgaggcgatgagagctctcgcctcgcccaccgcctccttcctcccggggatcccgagccctagccctcgcgcgcgcggggctctccgttccgcgccggccgcgctctcgcgggccccttccgggcgctccgtcgccgcctcggccgcggccgccacaggggaccactggggcgccgaccaccagcactaccacggaggacgcgcgggcgcgtcggaggccgggtccgccgcgtcggcgcgcggcgtcaagtgcgacgtcgacgtggtgtcgtggcgggagcggcgggtgctcgcgtccgtgcctgtggccgccgacgtcgacaccctctggcaggtcatcaccgactacgagcgcctcgccgacttcatccccaacctcgtccagagtgggacgattccgtgcccgcatgaagggcggatatggctggagcagagaggcctgcagcaagcgttgtactggcacattgaggcgcgtgtcgtgttggatctccaggaaatccatgactccattaatgggcgagaactccatttctcgatggtagatggtgacttcaagaagtttgaaggaaaatggtccataagatctggtccaaggtcctctagtgcagttttgctgtatgaagttaatgtgataccaagatttaacttcccggctatatttcttgaaaagattataaggtcagatcttcctgtaaatcttggtgccttggcttgtagagctgaaaagatttatctggaaaatcaaagttgtggttcgagaaaattctctgttgaggacttgaagccatcatctacttcttctcagcttgataacttccgtagtaggacagttgatacttcttctagtaaatttaaagaagcacctcccacttctggtgttaacagtgtgcttccatcacctgcttctgaattgattagcaaatggggtgtatatggaaatgtatgcagaattgataggccttgcgtggtagatgagatccatcttcgaagatttgatggcatgttggaacatgagggggctcataggtgtgtttttgctagtatcactgtgaaagcaccagttcgggaggtatggaatgttctcacagcatatgagaatttgcccgaattcgtaccaaacctggctatcagtaggattgttcttcgtgataataacaaggtccgcataatgcaggagggttgcaaaggcctgctgtatatggtccttcatgcccgtgttgttatggaccttcgtgaaaaatttgagcaagagatcaggtttgaacaagttgagggtgatttttactcgtttaaagggaaatggcgcttagaacaacttggggatcagcacaccctgttgaagtacatggttgagactaagatgcatagggacacctttctctctgagtctatccttgaagaggtcatatatgaagatcttccatcaaacttgtgtgcaatccgtgattatattgaaaaggctggagccaagggtagcaactccacagctcattctgatgtgtccatagacccagatgcttatcatgctgaaagcaggcaatctgagcaagcatctgtgtcttgctcgtccagtaccatgaagcagagaccaaaagtcccagggttgcaaaaggacattgaggtcctaaaatcagagcttgagaatttcattgcagaatatggtcagtatggtttcatgcctaagagaaagcatctccggtctcatggaagggtggatatcgagaaggcaataacacgaatgggtgggttccggaagattgccagcataatgaacctttctctttcttacaaaaatcgaaaaccaagaggctattgggataatctggagaacttgcaagaagagatcagccggttccagaaaagttgggggatggatccttcttatatgccaagtagaaaatcttttgagagggcaggtcgttacgacattgctcgggcattggaaaaatggggtggggtgcaggaggtttcacgccttctctctcttaaactaagacgtcctagaaggcaaggcgacttggatgacgagagccggtctgaatccccatctgagatgacaaagaagcacggggtgaaacctgataaaggcaatgtttccccagatgcccagaaatggctcctgaagctgaaggatttggatgtcaactgggtggaatactagattagctttgaacaaaagatatggtctctcattattagctcaactctttcccttcttcggaggtgatctggaagcattccgacaaaagaccccgcaaattgtgtacagaaaagtgcgatacaccggccaaccctgaaggcaagccaccaggaggcaacaggttttcttgtgtcagtaatcacgactcttggctactgcgtatctagaactgttgacaatactaacagctttgttgcggtcaaattgatccgtggatttgacaaagtctagccactaaacgcagaacgggtgtgcaatttcgtgtttgagtcagccttgcctttcaaagcaggtggtcatcgctgggttaaactgtggtgttgacacttcacagtttggtcgcctactttgttagtgatgatgtaagttgacctggcccttttgttttgacacggaaaagagaaggttaccatccagtagcagtttcagtcggcacgttttacattacattacattggtcttaatgtgtcaattttttttggtgctaatttggctagtagcatggcgggtctgtatgagaaacc

SEQ ID NO: 9273 - DNA, 3585 bp, Panicum virgatum
acccgcgtctcctccttcctcggcacggctccccactccccccagtacactctcgcccccagtggtcaggtactcaggtcaccgtgcgcatgagcgatgagagctctcgcctcgcccgccgcctccatccttaaccccggcgcgagccccaaccctcgcgcgcctctccgctcggcggcggcgccgctcccgcggggcccgtgccctggccgctccgtcgccgccgcggccgccgccgccaccggggatcactggggcgccgaccaccaccacgtctgcggccgcgcgacctcgccggaggccggggcccgcgcggcgcacggcgtcaagtgcgacgtcgacgtggtgtcgtggcgggagcggcgggtgctcgcgtccgtgcccgtggccgccgacgtcgacaccctgtggcaggtcatcaccgactacgagcgcctcgccgacttcatccccaacctcgtccagagcgtgaggattccgtgcccgcacgaagggcggatatggctggagcagaggggactgcagcgggcactctactggcacatcgaggcgcgcgtcgtgttggatctccaggaagtccctgattccgttaatggacgagaactccatttctcgatggtagatggtgacttcaagaagtttgaaggaaaatggtccatcagatcgggtccaaggtcctctagtgcagttttgctgtatgaagttaacgtgataccaagatttaacttcccggcaatatttcttgagaggattataaggtcggatcttcctgtaaatcttcgagccttggcatctagagctgaaaagatttatttagaaaatcaaagatgtggttcgagaaaattttctgccatggattcaaagccatcatctacttcttctcagcttaagttccatagtacagcaattgagactacttctagtaagttcaaagaagcacctcccactgctggtgttagtagtgtgcttccttcaccttcttctgagttgattagcaaatggggtgtatatggaaacgcttgcagaattgataggccttgtgtggtagatgagatccatcttcgaagatttgatggtctcttggaacatgagggggctcacaggtgtgtttttgctagtatcactgtgaaagcaccagttcgagaggtatggaatgttctcacggcatatgagaatttacctgaattcgtaccaaacctggctatcagtaggattgtccttcgtgataataacaaggtccgcctaatgcaggagggttgcaaaggcctactgtatatggtccttcatgcccgtgttgtcatggatcttcgtgaaaaacttgagcaagagatcagctttgaacaagttgagggtgatttctactcattcaaagggaaatggcgcttcgaacaacttggagaccatcacaccctgttgaagtacatggttgagactaagatgcataaggacacctttctctctgagtccatccttgaagaggtcatatatgaggatcttccatcaaacttgtgtgcaatacgtgattatattgaaaaggctggagctgaaggtagcaactccattactcattctgatgcaccaacacactcagatattgttcctgcgcaaagcaggcaattagagcaagaatctgcatcttgctccttcagttccacgaaacagagaccaaaagttcctggcttgcaaaaggacattcaagtcctcaaatctgagcttgagaatttcattgcaagctacggtcaggatggtttcatgcctaagagaaagcatcttcgttctcatggaagggtggatattgagaaggcaataacacgaatgggtgggttcaggaagattgccagcataatgaacctttccctttcctacaaaaatcgaaaaccaagaggttattgggataatctggagaacttgcaagaagagatcagccggttccagaagagttgggggatggatccttcttatatgccaagtaggaaatcttttgagagagcaggtcgatacgacattgctcgggcattggaaaaatggggtggggtgcaggaggtttcgcgccttctttctcttgaactaagacgccctagaatgcgagctgactcagatgatgagaggcagtctgaatcacaagctggcagtggtatgacaaagaagcacggaatcaaacctgataaagccaacatgtccccagatgcacagaaatggctcctgaagctgaaggatttggatgtgaactgggtggaatactagattaataagcttcgaaaacgaaatgatgtggcactatcaactcaattcttttttggcgttggaggcgctctggaagcagtccgtcaaagacgctgtaaattatgtacagaaaatttgcaatgctcaggccaaccctgaattaacccatgctgaagctaccaacgggcaacggttttcatttgtcatctgttatgactcttggtcctctactactactactactgcgtatctagaagtttgacaaaacagctttgttgcagtcaaattgaagcgtggatttggccactaagcacaaatggggtgttgatttcgtatacctgttcaaagctgttttgagtaagctccgcctttcaaaggtggtcaaccattggattaaatcgtgttcgcaggttggtcgacttcttgttactgatcatgtcagttgacttggcccttttgttttgacactgaaagagaatgttactgcccactagtttcaatcagcgtggttacattagtctttcaggtgtagttgcattcggtgttccctgcttcatggcgagaaaggtaaggagctgatgaggacgttcgtcaacaaggggacatgatggtttgctttaatgtggcaaattatgcttagatgtttggctattcagtgaggctagattatttgaatttaaaagaatttattttttcttatgatcattgacttggatatagcctgaagaaagggaaattggatcaaaaaaattggaagaaaaaaggtcccaccgggattcgaacccaagtcggcagattcaaagtctagagtgctaaccactacacgatggaaccgtttccgtctccgagattgcggattaaatataagtaggtctccccgagaattcctggccttggctatacctatagccgaactgttcagacgaacatggattcatggacttgcgtggtgacgagtccccatcctggctcggaagaaagagtgacgaagctgcgatgaagacccctgttggtttcggcagcatttttcagagctcgtgcgcgaggaacgggcctgcaacacacactgagggcgacgatttcgaaatttattcgctccaatcagaccgcagtcctgaagaacgttcgttgcggcggatgtaaccacaagtccttaacgacgacttcctcttcatccaaacttctgaactgaaagctcgtacaggcagagtccgccctaggcagctgcgatgtgccgtgccctcataaatcttgggggaagaactaaacataaaaaggaccccccacgagccttaatcacatgtctaattgcagggatggcgcaaggacaagatggctggcatcttccttccgagatttgga

SEQ ID NO: 9274 - DNA, 2805 bp, Setaria italica
gcgccgcctccttcctcggtcaccaactcccccagtggccagtgcagtgtcctgcacgcgtgcatgagcgatgagagctctctcatcgcccgccgcctccttcctcccgggaatcctcaatcccagcgcaaatcctaaccctcgcgcgcctctccgttcggcggtggcggcgctctcgcggggcccttgcccttccggccgctccgtcgccgccgcggctgccgccgccaccggggaccactggggcgccgaccactaccacggcggcggccacgcgagctcgcaggaggccgcggcccgtgcggcgcacggcgtgaagtgcgacgtggacgtggtgtcgtggcgggagcggcgggtgctcgggtccgtggccgtggccgccgacgtcgacaccctgtggcaggtcatcaccgactacgagcgcctagccgacttcatccccaacctcgtccagagcgggaggattccgtgcccgcacgaagggcggatatggctggagcagaggggactgcagcaggcgttgtactggcacatcgaggcccgcgtcgtgttggatctccaggaagtccctgattccattaatggacgagaactccatttctcaatggtagatggtgacttcaagaagtttgaaggaaaatggtccatcagatctggtccaaggtcctctagtgcaattttgctgtatgaagttaatgtgataccaagatttaacttcccggcaatatttcttgagaggattataaggtcggatcttcctgtaaatcttcgggccttggcttgtagagctgaaaagatttatttagaaaatcaaagatgtggtttttctgctgtggattcgaagccatcgtccacttcttctcagcttaagttccatagttcaacaattgatactacttctagtaagttcaaagaagcacctcccacttctggtgttggtagtgtgcttccgtcaccttcttctgagttgattggcaaatggggtgtatatggaaacacatgcagaattgataggccttgtgtggtggatgagatccatcttcgaagatttgatggcctcttggaacatgagggggctcacaggtgtgtttttgctagtatcactgtgaaagcaccagttcgagaggtatggaatgttctcacggcatatgagaatttacctgaatttgtgccaaacctggctatcagtaggattgtccttcgtgataataacaaggtccgcataatgcaggagggttgcaaaggcctactgtatatggtccttcatgcccgtgttgttatggatcttcgcgaaaaacttgaggaagagatcagctttgaacaagttgagggtgatttctactcattcaaagggaaatggcgctttgaacaacttggtgatcagcacaccttgttgaagtacatggttgagactaaaatgcataaggacacatttctctctgagtctattcttgaagagatcatatatgaggaccttccgtcaaacttgtgtgcaatccgtgattatattgaaaaggctggagctgaaggcagcaactccacaactcattctgctgcaccaacacacccagatattgatcatgcagaagacaggcaatcagagaaagaatctgcatcttgctccttcagttccatgaaacagagaccaaaagtccctggcttgcaaaaggacattgaggtcctcaaatctgagcttgagaatttcattgctaagtacggtcaggatggtttcatgcctaagagaaagcatcttcggtctcatggaagggtggatatcgagaaggcaataacacgaatgggtggattcaggaagattgccagcacaatgaacctttccctttcttacaaaaatcgaaaaccaagaggttattgggataatctggagaacttgcaagaagagatcagtcggttccagaagagctgggggatggatccttcttatatgccaagtagaaaatcttttgagagagcaggtcgttacgacattgctcgggcattggaaaaatggggtggcgtgcaggaggtttcacgccttctttctcttgaactaaggcggcctagaaggcaagctgactctgatgatgagaggcagtctgaatcaccagctggcagtggcattacaaagcagcatggaatgaaacctgataaagccaacacgtccctggacgcacataaatggctcctgaagctgaaggatttggatgttaactgggtggaatattagattaataagcttcgaaaaagaaatgctgtaaattggaggtgatctggaagcattcttttccatcgttggaggtgatctggaagcattctttcaaagaagctgtaaattgtgtacagaaaaattgcaatgcacaggccaacccatgctgaaaggttacaggcaacaggttttcatttgtcaactgtcatgactcttggtcctcaagtgttacttatctagaagtgtcgactactactcccagctttgttgcagtcaaattgatccgtggatttgaccaaagacaaaccactaaacgcaaatgggggtgttgattgcatgtacctgttcaaaggtgtttagagtcaggtggtcaatcgttggggttaactcgcgttcacaggttactgatgatgtcagttgaccgcttacttgttgatgtgagttgacttgacccttcttttttgacacagaaagagaaggttactgtccagtagtttcaatcagcacggttacattagtctgtcaggcacagttaccttcggtgttccctgcttcatggcaagtaaggtaatgagccggcgaggacgttcgtcaacgaaggg

SEQ ID NO: 9275 - DNA, 1349 bp, Sorghum bicolor
gcctggcggctccgcggctgtcgtggcagtagttgccagagccgtcgcagccacccaaaccccatcaacgaaacggcgccaatccagagaccggcgaccccgaccgcccgacgagctccaccatgaagcacctcgtcctcccctcccctctccctctcctcctccaccgccccaccaagccccatctcctccaccctcgccgccgcctcgtctccatccggaacgccgcatccggcggcagctccggcgaacccacccctgccgcggatacggccaccgggacgtctccgccggccggtgccactgccaagcccgccggcgtcaaggaccgcctgaaggcgaggaaccagtcccgccgggtccagctggactccccaccgccggaggtggtggtggtgccgaagaggaagcccgccgcgtcgtcgtcgtcgtcgtcgtcgtcccctgcgccgaagaggaaggagaggcggaaggagtgggaggagatgagcgtgggcgagaaggccgcggagctctatgtcggggagaagggccttctcttctggctcaacaagttcgcctacgcctccatcttcatcatggtcggcgcctggatcctgttccgcttcgtcggcccctcgatcggcctctaccagctcgacgccccgccgctgccgcccaccgccgtgttcggcggcggctccccgtgacggcaccagagcgtcggcgtcagagtcgtttctgagtggggtacactaggtagagctagcgtagcggactaataataaggcaaagattgaggaagaagaggacgcgaatttcggagccaaaaattggatcttttgctggcaatggcaatgtggagtgtagatgcgcagttcttggagcttcagagcatgacactgctgaattccgggtttatctgtgcaaacatgtttggttttgtataggcaagcaattcatttcggtatgctcttcaattgagtttgagaagctgagattaagaggccatgctgcagccgtttcttgtaatgaagacagaaattttcagaacagaatttgagttcaaaagaccattgggcaggaaatggacaacaagatgtaatttctatttgttgaactaaacaaggcctcactgaacagtttaacatcagcactttcataataatcagtagtgactgctgagtgctgactgctttgtcagaagaagaaagacatactctccatctatgcttagtcagaggaacaaatctatactccatcagttgtagtccaatcacagcatagagtcagaagaacaaattaaagccacacacaccatcagtcgaagtcggatcacattcacagcagagtcggtcagttagaaaagg

SEQ ID NO: 9276 - protein, 325 aa, Oryza sativa
MEVVVARQPKAKKQINLFYCSECEELALKVAASSDAIHLQSINWRSFDDGFPNLFINNAHDIRGQHVAFLASFSSPSVIFEQISVIFALPKLFIASFTLVLPFFPTGSFERVEEEGDVATAFTLARILSMIPKSRGGPTSVVIYDIHALQERFYFGDDVLPCFETGIPLLLQRLRQLPDADNITIAFPDDGAWKRFHKLLLNFPMVVCAKVREGDKRIVRIKEGNPEGRHVVIVDDLVQSGGTLRECQKVLAAHGAAKVSAYVTHAVFPKQSYERFTHTNSAGSADKFAYFWITDSCPQTVKAINQQPPFEVLSLAGSIADALQI

SEQ ID NO: 9277 - protein, 330 aa, Theobroma cacao
MENNNNMGELKAQNQNKKHVRLFYCMECEELAAKVAAQSQLITLQSINWRNFDDGFPNLFINNAHDIRGQHVAFLASFSSPSVIFEQLSVIYNLPRLFVASFTLVLPFFPTGSFERMEEEGDVATAFTMARILSNIPISRGGPTSLVIYDIHALQERFYFGDHVLPLFETGIPLLKQRLHQLPDAEKIVVAFPDDGAWKRFHKLLDHFPMVICTKVREGDKRIVRLKEGNPAGCHVVIVDDLVQSGGTLIECQKVLVAHGAAKVSAYVTHGVFPKRSWERFTPKNDEGSEKGFAFFWITDSCPHTVKAIGNRAPFEVLSLAGSIADALQI

SEQ ID NO: 9278 - protein, 663 aa, Sorghum bicolor
MDLLRHPFKGVVTDIKGRATWYKHDWVAGVHSGFRILAPTMYIFFASALPVIAFGAQLSTATNGILTTVETLASTAICGIIHSILGGQPLLIVGVAEPTIIMYTYLYNFAKNQQALGEKLYLAWAGWVCIWTAIMLFLLAMFNASNVISRFTRVAGELFGMLITVLFLQEAIKGMISEFSVPEDADSSSPIYQFQWLYVNGLLGVIFSIGLLYTALRTRRARSWLYGIRRLRSFIADYGVPLMVIVWTALSYTLPGKLPSGVPRRLFSPLPWESSSQGHWTIARDLFSVPPAYILAAILPALMVAGLYFFDHSVASQLAQQKEYNLKKPSAYHYDILVLGIMVLLCGLLGIPPSNGVLPQSPMHTKSLAVLKRQLLSKKMVDTAKDSIGRSATTLEIYGKMEEIFIEMDSEQNTGSVDKELKNFKDAVLQEGNEEGKLAREFDPRKHIEAHLPVRVNEQRLSNLLQSILVGGCVGAMPVIRMIPTSVLWGYFAYMAIDSLPGNQFWERIQLLFVAESRLYKVLEGPHASFVESVVPKTITIFTIFQLVYLLICFGITWIPIAGILFPVPFFLMILIRQYLLPKFFDPIVLRELDAAEYEELDGIALEHNLEDEVSEVASCPSRPDAEILDELTTNRGEVKHRTSSLREERPIQVATNAVQPSL

SEQ ID NO: 9279 - protein, 663 aa, Setaria italica
MDLLRNPFKGVIADIKGRAAWYRHDWVAGLRSGFRILAPTMYIFFASALPVIAFGEQLSTATNGILTTVETLASTAICGIIHSILGGQPLLIVGVAEPTIIMYTYLYNFAKKQQGLGEQLYLAWAGWVCIWTAIMLFLLAMFNASNVISRFTRVAGELFGMLITVLFLQEAIKGIINEFSVPEDADSSSPIYQFQWLYVNGLLGVIFSIGLLFTALRTRRARSWLYGVGWLRSFIADYGVPLMVIVWTALSYTLPSKVPSGVPRRLFSPLPWESSSLGHWTIVKDLFSVPPAYIFAAILPALMVAGLYFFDHSVASQLAQQNEYNLKKPSAYHYDILVLGIMVLLCGLIGIPPSNGVLPQSPMHTRSLAILKRQLLSKKMVDTAKESIGKSATSLEIYGKMQEVFIEMDSEQNTDSVDKELKNFKDAVLQEGDEEGKLAGEFDPRKHIEAHLPVRVNEQRLSNLLQSILVGGCVGAMPVIRMIPTSVLWGYFAYMAIDSLPGNQFWERMQLLFIAESRHYKVLEGPHASFVESVPPRTITIFTVFQLVYLLICFGITWIPIAGILFPVPFFLMILIRQYLLPKFFDPIVLRELDAAEYEELDGVPHEHTLEDEVSEAGSCISRRDAEILDELTTNRGELKHRTSSLREERSVQVPSNAVQPRL

SEQ ID NO: 9280 - protein, 666 aa, Brachypodium distachyon
MDLLRNPFKGVVADVKGRASWYKDDWVAGLRAGFRILAPTMYIFFASALPVIAFGEQLSRETNGMLSTVETLASTAICGVIHSILGGQPLLIVGVAEPTIIMYTYLYNFAKEEAGLGEQLYLAWAGWVCIWTAIMLFFLAMFNASNVISRFTRVAGELFGMLITVLFLQQAIKGIVSEFSLPKAAEIVDRSSLIYDFQWIYVNGLLGVIFSIGLLYTALKSRRARSWLYGIGCLRSFIADYGVPLMVIVWTALSYTLPSKVPSGVPRRLFSPLPWESSSLGHWTVAKDLFSVPPAFIFAAIVPALMVAGLYFFDHSVASQLAQQKEFNLKKPSAYHYDILVLGFMVLLCGLIGIPPSNGVLPQSPMHTRSLAVLKGQLMRNKMLQTAKEGMTNRASSLEIYGKMQEVFIQMDREKNTDSVDKELKSLKDAVLREGDEEGKLAGEFDPRKHIEAHLPVRVNEQRLSNLLQSLLVGGCVGAMPVIKMIPTSVLWGYFAYMAIDSLPGNQFWERIKLLFIGSTRRYKVLEGPHASFVESVPSKTISVFTIFQLVYLLICFGTTWIPIAGILFPVPFFLMILIRQHLLPKFFDPNHLRELDAAEYEELEGVQNEHTLEEDGSISGSCDSRNDAEILDELTTNRGELKHRSVSHREERHLQVHSNAVQPSV

SEQ ID NO: 9281 - protein, 672 aa, Oryza sativa
MDLLRTPFKGVVADIEGRVAWYKHDWVAGFRSGFRILAPTMYIFFASALPVIAFGAQLSRETNGILTTVETLASTALCGIIHSILGGQPLLIVGVAEPTIIMYTYLYNFAKNQQALGERLYLAWAGWVCIWTALMLFLLAMFNASNVISRFTRVAGELFGMLITVLFLQQAIKGIIEEFKVPRDADHSSPIYQFQWLYVNGLLGVIFSIGLLYTALRSRRARSWVYGQGWLRGFIADYGVPLMVIVWTAFSYTLPKDVPSGVPRRLFSPLPWESSSLQHWTVAKDLFSVPPAYIFAAILPALMVAGLYFFDHSVASQLAQQKEFNLKKPSAYHYDILVLGFMVLLCGLIGIPPSNGVLPQSPMHTRSLAVLKGQLLRKKMVQTANEGLMNRASSLEIYGKIQGVFIEMDCEKNTDSVDKELKSLKDAILQEVDKEGTLAEEFDPIKHIEAHLPVRVNEQRLSNLLQSLLVGACVGAMPVIKMIPTSVLWGYFAYMAIDSLPGNQFWERLRLIFIPSSRRYKVLEGPHASFMESVPSKTIIVFTIFQLVYLLICFGITWIPIAGILFPLPFFLMILIRQHVLPKFFEPNDLRELDAAEYEELEGVHHDHTLEDGESDSGSCGSRDDAEIFDELTTNRGELKHRTSSHREERHLQVHSNAIQPRCGDTENWSEC

SEQ ID NO: 9282 - protein, 672 aa, Oryza sativa
MELLKIPFKGVVADIEGRAAWYKHDWLEGFHSGFRILAPTMYIFFASALPVIAFGTQLSRETNGILTTVETLASTAICGIIHSILGGQPLLIVGVAEPTIIMYTYLYNFAKNQQALGERLYLAWAGWVCIWTAIMLFLLAMFNASNVISRFTRVAGELFGMLITVLFLQQAIKGIIEEFKVPGGVDHSSPIYRFQWLYVNGLLGVIFSIGLLYTALRSRRARSWVYGQGWLRGFISDYGVPLMVIVWTALSYALPKDVPSGVPRRLFSPLPWESSSLHHWTIAKDLFSVPPAYIFAAILPALMIAGLYFFDHSVASQLAQQKEFNLKKPSAYHYDILVLGFMVLLCGLIGIPPSNGVLPQSPMHTRSLAVLKGQLLRKKMVQTANEGLMNRASSLEIYGKMQGVFIEMDCEKNTDSVDKELKSLKDAMLQEGDKEGTLAEEFDPIKHIEAHLPVRVNEQRLSNLLQSLLVGACVGAMPVIKMIPTSVLWGYFAYMAIDSLPGNQFWERIRLIFIPSSRRYKVLEGPHASFMESVPSKTITVFTIFQLVYLLICFGITWIPIAGILFPLPFFLMILIRQHVLPKFFEPNDLRELDAAEYEELEGVHHDHTLEDGASDSESCGSRDDAEILDELTTNRGELKHRTFNHREERHPQAHTKAVQPRCGDTENWSEC

SEQ ID NO: 9283 - protein, 395 aa, Arabidopsis lyrata
MAVSTIYSTQALNSTHFLTSSSSSKQVFLYRRQPQTNRRFNTLITCAQETIVIGLAADSGCGKSTFMRRLTSVFGGAAKPPKGGNPDSNTLISDTTTVICLDDYHSLDRYGRKEQKVTALDPRANDFDLMYEQVKALKSGVAVEKPIYNHVTGLLDPPELIQPPKILVIEGLHPMFDERVRDLLDFSIYLDISNEVKFAWKIQRDMAERGHSLESIKASIEARKPDFDAFIDPQKQYADAVIEVLPTTLIPDDNEGKVLRVRLIMKEGVKYFSPVYLFDEGSTISWIPCGRKLTCSYPGIKFNYEPDSYFDHEVSVLEMDGQFDRLDELIYVESHLSNLSTKFYGEVTQQMLKHADFPGSNNGTGLFQTIVGLKIRDLYEQLIANKATARAEAKA

SEQ ID NO: 9284 - protein, 400 aa, Unknown
  Sequence found in Organisms: Eutrema halophilum, Eutrema parvulum
MAVSTIYSTQALNSTHFLTSSPSSSSSKQVFFYRRQSQTNRRFNTIITCAAQQTIVIGLAADSGCGKSTFMRRLTSVFGGAAEPPKGGNPDSNTLISDTTTVICLDDYHSLDRTGRKEKGVTALDPRANDFDLMYEQVKALKSGVAVEKPIYNHVTGLLDAPELIQPPKILVIEGLHPMFDERVRDLLDFSIYLDISNEVKFAWKIQRDMAERGHSLESIKASIEARKPDFDAFIDPQKQYADAVIEVLPTQLIPDDNEGKVLRVRLIMKEGVKYFSPVYLFDEGSTISWIPCGRKLTCSYPGIKFNYEPDSYFDHEVSVLEMDGQFDRLDELIYVESHLSNLSTKFYGEVTQQMLKHADFPGSNNGTGLFQTIVGLKIRDLYEQLIASKATTRAEAAKA

SEQ ID NO: 9285 - protein, 395 aa, Brassica napus
MAVSTIYSTQALNSTHFFTSSSSSKQVFFYRRQTNRRFNTIITCAAQQTVVIGLAADSGCGKSTFMRRLTSVFGGAAEPPKGGNPDSNTLISDMTTVICLDDYHSLDRTGRKEKGVTALDPRANDFDLMYEQVKALKSGIAVEKPIYNHVTGLLDAPELIQPPKILVIEGLHPMFDERVRDLLDFSIYLDISNEVKFAWKIQRDMAERGHSLESIKASIEARKPDFDAFIDPQKQYADAVIEVLPTQLIPDDNEGKVLRVRLIMKEGVKYFSPVYLFDEGSTISWIPCGRKLTCSYPGIKFNYAPDSYFDHEVSVVEMDGQFDRLDELIYVESHLSNLSTKFYGEVTQQMLKHADFPGSNNGTGLFQTIVGLKIRDLYEQLIANKATAPAEAAKA

SEQ ID NO: 9286 - protein, 398 aa, Brassica juncea
MAVSTIYSTQALNSTHFFTSSSSSKQVFFYRRHQSQTNRRFNTIITCAAQQTVVIGLAADSGCGKSTFMRRLTSVFGGAAEPPKGGNPDSNTLISDMTTVICLDDYHSLDRTGRKEKGVTALDPRANDFDLMYEQVKALKSGIAVEKPIYNHVTGLLNAPELIQPPKILVIEGLHPMFDERVRDLLDFSIYLDISNEVKFAWKIQRDMAERGHSLESIKASIEARKPDFDAFIDPQKQYADAVIEVLPTQLIPDDNEGKVLRVRLIMKEGVKYFSPVYLFDEGSTISWIPCGRKLTCSYPGIKFNYEPDSYFDNEVSVVEMDGQFDRLDELIYVESHLSNLSTKFYGEVTQQMLKHADFPGSNNGTGLFQTIVGLKIRDLYEQLIANKATAPAEAAKA

SEQ ID NO: 9287 - protein, 394 aa, Brassica napus
MAVSTIYSTQALNSTHFFTSSSSKQVFFYRRQTNRRFNTIITCAAQQTVVIGLAADSGCGKSTFMRRLTSVFGGAAEPPKGGNPDSNTLISDMTTVICLDDYHSLDRTGRKEKGVTALDPRANDFDLMYEQVKALKSGIAVEKPIYNHVTGLLDAPELIQPPKILVIEGLHPMFDERVRDLLDFSIYLDISNEVKFAWKIQRDMAERGHSLESIKASIEARKPDFDAFIDPQKQYADAVIEVLPTQLIPDDNEGKVLRVRLIMKEGVKYFSPVYLFDEGSTISWIPCGRKLTCSYPGIKFNYAPDSYFDHEVSVVEMDGQFDRLDELIYVESHLSNLSTKFYGEVTQQMLKHADFPGSNNGTGLFQTIVGLKIRDLYEQLIANKATAPAEAAKA

SEQ ID NO: 9288 - protein, 395 aa, Brassica rapa
MAVSTIYSTQALNSTHFFTSSSSSKQVFFYRRQNNRRFNTIITCAAQQTVVIGLAADSGCGKSTFMRRLTSVFGGAAEPPKGGNPDSNTLISDMTTVICLDDYHSLDRTGRKEKGVTALDPRANDFDLMYEQVKALKSGIAVEKPIYNHVTGLLDAPELIQPPKILVIEGLHPMFDERVRDLLDFSIYLDISNEVKFAWKIQRDMAERGHSLESIKASIEARKPDFEAFIDPQKQYADAVIEVLPTQLIPDDNEGKVLRVRLIMKEGVKYFSPVYLFDEGSTISWIPCGRKLTCSYPGIKFNYAPDSYFDHEVSVVEMDGQFDRLDELIYVESHLSNLSTKFYGEVTQQMLKHADFPGSNNGTGLFQTIVGLKIRDLYEQLIANKATAPAEAAKA

SEQ ID NO: 9289 - protein, 401 aa, Eutrema parvulum
MAVSTIYSTQALNSTHFLTSSPSSSSSKQVFFYRRHQSQTNRRFNTIITCAAQQTVVIGLAADSGCGKSTFMRRLTSVFGGAAEPPKGGNPDSNTLISDMTTVICLDDYHSLDRTGRKEKGVTALDPRANDFDLMYEQVKALKSGIAVEKPIYNHVTGLLDAPELIQPPKILVIEGLHPMFDERVRDLLDFSIYLDISNEVKFAWKIQRDMAERGHSLESIKASIEARKPDFDAFIDPQKQYADAVIEVLPTQLIPDDNEGKVLRVRLIMKEGVKYFSPIYLFDEGSTISWIPCGRKLTCSYPGIKFDYAPDSYFDHEVSVLEMDGQFDRLDELIYVESHLSNLSTKFYGEVTQQMLKHADFPGSNNGTGLFQTIVGLKIRDLYEQLIANKATAPAEAAKA

SEQ ID NO: 9290 - protein, 394 aa, Brassica napus
MAVSTIYSTQALNSTHFFTSSSSKQVFFYRRQTNRRFNTIITCAAQQTVVIGLAADSGCGKSTFMRRLTSVFGGAAEPPKGGNPDSNTLISDMTTVICLDDYHSLDRTGRKEKGVTALDPRANDFDLMYEQVKALKSGIAVEKPIYNHVTGLLDAPELIQPPKILVIEGLHPMFDERVRDLLDFSIYLDISNEVKFAWKIQRDMAERGHSLESIKASIEARKPDFDAFIDPQKQYADAVIEVLPTQLIPDDNEGKVLRVRLIMKEGVKYFSPVYLFDEGSTVSWIPCGRKLTCSYPGIKFNYAPDSYFDHEVSVVEMDGQFDRLDELIYVESHLSNLSTKFYGEVTQQMLKHADFPGSNNGTGLFQTIVGLKIRDLYEQLIANKETAPAEAAKA

SEQ ID NO: 9291 - protein, 399 aa, Raphanus sativus
MAVSTIYSTQALNSTHFLSSSPSSKQVFFYRRHQSQTNRRFNTIITCAAQQQTVVIGLAADSGCGKSTFMRRLTSVFGGAAEPPKGGNPDSNTLISDMTTVICLDDYHSLDRTGRKEKGVTALDPRANDFDLMYEQVKALKSGIAVEKPIYNHVTGLLDAPELIQPPKILVIEGLHPMFDERVRDLLDFSIYLDISNEVKFAWKIQRDMAERGHSLESIKASIEARKPDFDAFIDPQKQYADAVIEVLPTQLIPDDNEGKVLRVRLIMKEGVKYFSPVYLFDEGSTISWIPCGRKLTCSYPGIKFDYAPDSYFDHEVSVVEMDGQFDRLDELIYVESHLSNLSTKFYGEVTQQMLKHADFPGSNNGTGLFQTIVGLKIRDLYEQLIANKATAPAEAAKA

SEQ ID NO: 9292 - protein, 397 aa, Brassica juncea
MAVSTIYSTQALNSTHFLTSSPSSSSKQVFFYRRQTNRRFNTIITCAAQQTVVIGLAADSGCGKSTFMRRLTSVFGGAAEPPKGGNPDSNTLISDMTTVICLDDYHSLDRTGRKEKGVTALDPRANDFDLMYEQVKALKSGIAVEKPIYNHVTGLLDAPELIQPPKILVIEGLHPMFDERVRELLDFSIYLDISNEVKFAWKIQRDMAERGHSLESIKASIEARKPDFDAFIDPQKQYADAVIEVLPTQLIPDDNEGKVLRVRLIMKEGVKYFSPVYLFDEGSTISWIPCGRKLTCSYPGIKFNYQPDSYFDNEVSVVEMDGQFDRLDELIYVESHLSNLSTKFYGEVTQQMLKHADFPGSNNGTGLFQTIVGLKIRDLYEQLIANKATAPSEAAKA

SEQ ID NO: 9293 - protein, 401 aa, Unknown
  Sequence found in Organisms: Brassica napus, Brassica rapa
MAVSTIYSTQALNSTHFLTSSPSSSTSKQVFFYRRHQSQTNRRFNTIITCAAQQTVVIGLAADSGCGKSTFMRRLTSVFGGAAEPPKGGNPDSNTLISDMTTVICLDDYHSLDRTGRKEKGVTALDPRANDFDLMYEQVKALKSGIAVEKPIYNHVTGLLDAPELIQPPKILVIEGLHPMFDERVRELLDFSIYLDISNEVKFAWKIQRDMAERGHSLESIKASIEARKPDFDAFIDPQKQYADAVIEVLPTQLIPDDNEGKVLRVRLIMKEGVKYFSPVYLFDEGSTISWIPCGRKLTCSYPGIKFNYEPDTYFDHEVSVLEMDGQFDRLDELIYVESHLSNLSSKFYGEVTQQMLKHADFPGSNNGTGLFQTIVGLKIRDLYEQLIANKATAPAEAAKA

SEQ ID NO: 9294 - protein, 397 aa, Brassica napus
MAVSTIYSTQALNSTHFLTSSPSSSSKQVFFYRRQTNRRFNTIITCAAQQTVVIGLAADSGCGKSTFMRRLTSVFGGAAEPPKGGNPDSNTLISDMTTVICLDDYHSLDRTGRKEKGVTALDPRANDFDLMYEQVKALKSGIAVEKPIYNHVTGLLDAPELIQPPKILVIEGLHPMFDERVRDLLDFSIYLDISNEVKFAWKIQRDMAERGHSLESIKASIEARKPDFDAFIDPQKQYADAVIEVLPTQLIPDDNEGKVLRVRLIMKEGVKYFSPVYLFDEGSTISWIPCGRKLTCSYPGIKFNYQPDSYFDNEVSVVEMDGQFDRLDELIYVESHLSNLSTKFYGEVTQQMLKHADFPGSNNGTGLFQTIVGLKIRDLYEQLIANKANAPTEASKA

SEQ ID NO: 9295 - protein, 401 aa, Raphanus sativus
MAVSTIYSTQALNSTHFLTSSPSSSTSKQVFFYRRHQSQTNRRFNTIITCAAQQTVVIGLAADSGCGKSTFMRRLTSVFGGAAEPPKGGNPDSNTLISDMTTVICLDDYHSLDRTGRKEKGVTALDPRANDFDLMYEQVKALKSGIAVEKPIYNHVTGLLDAPELIQPPKILVIEGLHPMFDERVRELLDFSIYLDISNEVKFAWKIQRDMAERGHSLESIKASIEARKPDFDAFIDPQKQYADAVIEVLPTQLIPDDNEGKVLRVRLIMKEGVKYFSPVYLFDEGSTISWIPCGRKLTCSYPGIKFNYEPDTYFDHEVSVLEMDGQFDRLDELIYVESHLSNLSTKFYGEVTQQMLKHADFPGSNNGTGLFQTIVGLKIRDLYEQLIANRATVPAEAAKA

SEQ ID NO: 9296 - protein, 333 aa, Brassica juncea
MAVSTIYSTQALNSTHFLTSSPSSSTSKQVFFYRRHQSQTNRRFNTIITCAAQQTVVIGLAADSGCGKSTFMRRLTSVFGGAAEPPKGGNPDSNTLISDMTTVICLDDYHSLDRTGRKEKGVTALDPRANDFDLMYEQVKALKSGIAVEKPIYNHVTGLLDAPELIQPPKILVIEGLHPMFDERVRDLLDFSIYLDISNEVKFAWKIQRDMAERGHSLESIKASIEARKPDFDAFIDPQKQYADAVIEVLPTQLIPDDNEGKVLRVRLIMKEGVKYFSPATYSMKVQPSRGYLAAANSPARTLVSSSTMHLIPTSTMRFRLLRWTGNSIDWTS

SEQ ID NO: 9297 - protein, 396 aa, Brassica juncea
MAVSTIYSTQALNSTHFLTSSPSSSSKQVIFYRRQTNRRFNTIITCAAQQTVVIGLAADSGCGKSTFMRRLTSVFGGAAEPPKGGNPDSNTLISDMTTVICLDDYHSLDRTGRKEKGVTALDPRANDFDLMYEQVKALKSGIAVEKPIYNHVTGLLDAPELIQPPKILVIEGLHPMFDERVRDLLDFSIYLDISNEVKFAWKIQRDMAERGHSLESIKASIEARKPDFDAFIDPQKQYADAVIEVLPTQLIPDDNEGKVLRVRLIMKEGVKYFSPVYLFDEGSTISWIPCGRKLTCSYPGIKFNYQPDSYFDNEVSVVEMDGQFDRLDELIYVESHLSNLSTKFYGEVTQQMLKHADFPGSNNGTGLFQTIVGLKIRDLYEQLIANKATAPSEAAK

SEQ ID NO: 9298 - protein, 397 aa, Brassica oleracea
MAVSTIYSTQALNSTHFLTSSPSSSSKQVIFYRRQTNRRFNTIITCAAQQTVVIGLAADSGCGKSTFMRRLTSVFGGAAEPPKGGNPDSNTLISDMTTVICLDDYHSLDRTGRKEKGVTALDPRANDFDLMYEQVKALKSGIAVEKPIYNHVTGLLDAPELIQPPKILVIEGLHPMFDERVRDLLDFSIYLDISNEVKFAWKIQRDMAERGHSLESIKASIEARKPDFDAFIDPQKQYADAVIEVLPTQLIPDDNEGKVLRVRLIMKEGVKYFSPVYLFDEGSTISWIPCGRKLTCSYPGIKFNYQPDSYFDNEVSVVEMDGQFDRLDELIYVESHLSNLSTKFYGEVTQQMLKHADFPGSNNGTGLFQTIVGLKIRDLYEQLIANKANAPTEASKA

SEQ ID NO: 9299 - protein, 397 aa, Unknown
  Sequence found in Organisms: Brassica napus, Brassica rapa
MAVSTIYSTQALNSTHFLTSSPSSSSKQVFFYRRQTNRRFNTIITCAAQQTVVIGLAADSGCGKSTFMRRLTSVFGGAAEPPKGGNPDSNTLISDMTTVICLDDYHSLDRTGRKEKGVTALDPRANDFDLMYEQVKALKSGIAVEKPIYNHVTGLLDAPELIQPPKILVIEGLHPMFDERVRELLDFSIYLDISNEVKFAWKIQRDMAERGHSLESIKASIEARKPDFDAFIDPQKQYADAVIEVLPTQLIPDDNEGKVLRVRLIMKEGVKYFSPVYLFDEGSTISWIPCGRKLTCSYPGIKFNYQPDSYFDNEVSVVEMDGQFDRLDELIYVESHLSNLSTKFYGEVTQQMLKHADFPGSNNGTGLFQTIVGLKIRDLYEQLIANKANAPTEAAKA

SEQ ID NO: 9300 - protein, 397 aa, Triticum aestivum
MAVSTIYSTQALNSTHFLTSSPSSSSKQVFFYRRQTNRRFNTIITCAAQQTVVIGLAADSGCGKSTFMRRLTSVFGGAAEPPKGGNPDSNTLISDMTTVICLDDYHSLDRTGRKEKGVTALDPRANDFDLMYEQVKALKSGIAVEKPIYNHVTGLLDAPELIQPPKILVIEGLHPMFDERVRDLLDFSIYLDISNEVKFAWKIQRDMAERGHSLESIKASIEARKPDFDAFIDPQKQYADAVIEVLPTQLIPDDNEGKVLRVRLIMKEGVKYFSPVYLFDEGSTISWIPCGRKLTCSYPGIKFNYEPDTYFDNEVSVVEMDGQFDRLDELIYVESHLSNLSSKFYGEVTQQMLKHADFPGSNNGTGLFQTIVGLKIRDLYEQLIANKANAPTEAAKA

SEQ ID NO: 9301 - protein, 399 aa, Brassica juncea
MAVSTIYSTQALNSTHFLTSSPSSSSSSKQVFFYRRQTNRRFNTIITCAAQQTVVIGLAADSGCGKSTFMRRLTSVFGGAAEPPKGGNPDSNTLISDMTTVICLDDYHSLDRTGRKEKGVTALDPRANDFDLMYEQVKALKSGIAVEKPIYNHVTGLLDAPELIQPPKILVIEGLHPMFDERVRDLLDFSIYLDISNEVKFAWKIQRDMAERGHSLESIKASIEARKPDFDAFIDPQKQYADAVIEVLPTQLIPDDNEGKVLRVRLIMKEGVKYFSPVYLFDEGSTISWIPCGRKLTCSYPGIKFNYQPDSYFDNEVSVVEMDGQFDRLDELIYVESHLSNLSTKFYGEVTQQMLKHADFPGSNNGTGLFQTIVGLKIRDLYEQLIANKANAPTEAAKA

SEQ ID NO: 9302 - protein, 399 aa, Brassica juncea
MAVSTIYSTQALNSTHFLTSSTSSSSSSKQVFFYRRQTNRRFNTIITCAAQQTVVIGLAADSGCGKSTFMRRLTSVFGGAAEPPKGGNPDSNTLISDMTTVICLDDYHSLDRTGRKEKGVTALDPRANDFDLMYEQVKALKSGIAVEKPIYNHVTGLLDAPELIQPPKILVIEGLHPMFDERVRELLDFSIYLDISNEVKFAWKIQRDMAERGHSLESIKASIEARKPDFDAFIDPQKQYADAVIEVLPTQLIPDDNEGKVLRVRLIMKEGVKYFSPVYLFDEGSTISWIPCGRKLTCSYPGIKFNYQPDSYFDNEVSVVEMDGQFDRLDELIYVESHLSNLSTKFYGEVTQQMLKHADFPGSNNGTGLFQTIVGLKIRDLYEQLIANKATAPAEIAKV

SEQ ID NO: 9303 - protein, 400 aa, Raphanus sativus
MAVSTIYSTQALNSTHFLTSSPSSSSSSSKQVFFYRRQTNRRFNTIITCAAQQTVVIGLAADSGCGKSTFMRRLTSVFGGAAEPPKGGNPDSNTLISDMTTVICLDDYHSLDRTGRKEKGVTALDPRANDFDLMYEQVKALKSGIAVEKPIYNHVTGLLDAPELIQPPKILVIEGLHPMFDERVRDLLDFSIYLDISNEVKFAWKIQRDMAERGHSLESIKASIEARKPDFDAFIDPQKQYADAVIEVLPTQLIPDDNEGKVLRVRLIMKEGVKYFSPVYLFDEGSTISWIPCGRKLTCSYPGIKFNYQPDSYFDNEVSVVEMDGQFDRLDELIYVESHLSNLSTKFYGEVTQQMLKHADFPGSNNGTGLFQTIVGLKIRDLYEQLIANKATAPSEAAKA

SEQ ID NO: 9304 - protein, 401 aa, Brassica napus
MAVSTIYSTRALNSTHFLTSSPSSSTSKQVFFYRRHQSQTNRRFNTIITCAAQQTVVIGLAADSGCGKSTFMRRLTSVFGGAAEPPKGGNPDSNTLISDMTTVICLDDYHSLDRTGRKEKGVTALDPRANDFDLMYEQVKALKSSIAVEKPIYNHVTGLLDAPELIQPPKILVIEGLHPMFDERVRELLDFSIYLDISNEVKFAWKIQRDMAERGHSLESIKASIEARKPDFDAFIDPQKQYADAVIEVLPTQLIPDDNEGKVLRVRLIMKEGVKYFSPVYLFDEGSTISWIPCGRKLTCSYPGIKLNYEPDTYFDHEVSVLEMDGQFDRLDELIYVESHLSNLSSKFYGEVTQQMLKHADFPGSNNGTGLFQTIVGLKIRDLYEQLIANKATAPAEIAKA

SEQ ID NO: 9305 - protein, 130 aa, Brassica juncea
MAVSTIYSTQALNSTHFLTSSPSSSTSKQVFFYRRHQSQTNRRFNTIITCAAQQTVVIGLAADSGCGKSTFMRRLTSVFGGAAEPPKGGNPDSNTLISDMTTVICLDELPFLRQDWSQRERSHCFGPTRQ

SEQ ID NO: 9306 - protein, 212 aa, Brassica juncea
MAVSTIYSTQALNSTHFLTSSPSSSTSKQVFFYRRHQSQTNRRFNTIITCAAQQTVVIGLAADSGCGKSTFMRRLTSVFGGAAEPPKGGNPDSNTLISDMTTVICLDDYHSLDRTGRKEKGVTALDPRANDFDLMYEQVKALKSGIAVEKPIYNHVTGLLDAPELIQPPKILVIEGLHPMFDERVRDLLDFSIYLDISNEVKFAWKIPEGHG

SEQ ID NO: 9307 - protein, 272 aa, Brassica napus
MTLTSCMSKSKTLKSGIAVEKPIYNHVTGLLDAPELIQPPKILVIEGLHPMFDERVRDLLDFSIYLDISNEVKFAWKIQRDMAERGHSLESIKASIEARKPDFDAFIDPQKQYADAVIEVLPTQLIPDDNEGKVLRVRLIMKEGVKYFSPVYLFDEGSTISWIPCGRKLTCSYPGIKFNYQPDSYFDNEVSVVEMDGQFDRLDELIYVESHLSNLSTKFYGEVTQQMLKHADFPGSNNGTGLFQTIVGLKIRDLYEQLIANKANAPTEASKA

SEQ ID NO: 9308 - protein, 371 aa, Brassica napus
KQVFFYRRQTNRRFNTIITCAAQQTVVIGLAADSGCGKSTFMRRLTSVFGGAAEPPKGGNPDSNTLISDMTTVICLDDYHSLDRTGRKEKGVTALDPRANDFDLMYEQVKALKSGIAVEKPIYNHVTGLLDAPELIQPPKILVIEGLHPMFDERVRELLDFSIYLDISNEVKFAWKIQRDMAERGHSLESIKASIEARKPDFDAFIDPQKQYADAVIEVLPTQLIPDDNEGKVLRVRLIMKEGVKYFSPVYLFDEGSTISWIPCGRKLTCSYPGIKFNYQPDSYFDNEVSVVEMDGQFDRLDELIYVESHLSNLSTKFYGEVTQQMLKHADFPGSNNGTGLFQTIVGLKIRDLYEQLIANKANAPTEAAKA

SEQ ID NO: 9309 - protein, 366 aa, Brassica juncea
YRRQTNRRFNTIITCAAQQTVVIGLAADSGCGKSTFMRRLTSVFGGAAEPPKGGNPDSNTLISDMTTVICLDDYHSLDRTGRKEKGVTALDPRANDFDLMYEQVKALKSGIAVEKPIYNHVTGLLDAPELIQPPKILVIEGLHPMFDERVRELLDFSIYLDISNEVKFAWKIQRDMAERGHSLESIKASIEARKPDFDAFIDPQKQYADAVIEVLPTQLIPDDNEGKVLRVRLIMKEGVKYFSPVYLFDEGSTISWIPCGRKLTCSYPGIKFNYEPDTYFNHEVSVLEMDGQFDRLDELIYVESHLSNLSSKFYGEVTQQMLKHADFPGSNNGTGLFQTIVGLKIRDLYEQLIANKATAPAEAAKA

SEQ ID NO: 9310 - protein, 405 aa, Cleome spinosa
MAVSTVYTSQSLNSTRFLSSSTSPSSSLVSKHVFFYRRRSPTCRRSTTVITCSAGDSQTVVIGLAADSGCGKSTFMRRLTSVFGGAAEPPKGGNPDSNTLISDMTTVICLDDYHSLDRTGRKEKGVTALDPRANDFDLMYEQVKALKSGVAVDKPIYNHVTGLLDPPELTKPPKILVIEGLHPMFDERVRDLLDFSIYLDISNEVKFAWKIQRDMAERGHSLESIKASIEARKPDFDAYIDPQKQYADAVIEVLPTQLIPDDNEGKVLRVRLIMKEGVKNFSPVYLFDEGSTINWIPCGRKLTCSYPGIKFSYGPDTYFDHEVSVLEMDGQFDRLDELIYVESHLSNLSSKFYGEVTQQMLKHADFPGSNNGTGLFQTIVGLKIRDLYEQIVAAKASAPVEAAKA

SEQ ID NO: 9311 - protein, 186 aa, Brassica napus
MRRLTSVFGGAAEPPKGGNPDSNTLISDMTTVICLDDYHSLDRTGRKEKGVTALDPRANDFDLMYEQVKALKSGIAVEKPIYNHVTGLLDAPELIQPPKILVIEGLHPMFDERVRELLDFSIYLDISNEVKFAWKIQRDMAERGHSLESIKASIEATKARLRCIHRPTKAVRGCGDRSASNAVDSR

SEQ ID NO: 9312 - protein, 405 aa, Panax ginseng
MAVSTIYTVQSLNSSCSISKHTKTHLGFHQKQVFFYSTNPKKSNNRRWNSEITCSASETIVIGLAADSGCGKSTFMRRLTSVFGGAAEPPKGGNPDSNTLISDTTTVICLDDYHSLDRTGRKKEGVTALDPRANNFDLMYEQVKAIKEGIAVQKPIYNHVSGLLDPPELIKPPKILVIEGLHPMYDERVRDLLDFSIYLDISNEVKFAWKIQRDMAERGHSLESIKASIEARKPDFDAFIDPQKQYADAVIEVLPTQLIPDDNEGKVLRVKLIMKEGVQYFSPVYLFDEGSTISWIPCGRKLTCSYPGIKFAYGPDSYYGHEVSVLEMDGQFDRLDELIYVESHLSNISTKFYGEVTQQMLKHADFPGSNNGTGLFQTIVGLKIRDLFEQLSASKAAAPLEATKA

SEQ ID NO: 9313 - protein, 405 aa, Cleome gynandra
MAVSTVYTTQSLNSSHFLSSSSSSSSSSSSSPFISRHVFFYRKKSPSTRITCSAGDSQTVVIGLAADSGCGKSTFMRRLTSVFGGAAEPPKGGNPDSNTLISDMTTVICLDDYHSLDRTGRKENGVTALDPRANDFDLMYEQVKALKSGVAVDKPIYNHVTGLLDPPELIKPPKILVIEGLHPMFDERVRDLLDFSIYLDISNEVKFAWKIQRDMAERGHSLESIKASIEARKPDFDAYIDPQKQYADAVIEVLPTQLIPDDNEGKVLRVRLIMKEGVKNFSPVYLFDEGSTINWIPCGRKLTCSYPGIKFSYGPDTYFGHEVSVLEMDGQFDRLDELIYVESHLSNLSTKFYGEVTQQMLKHADFPGSNNGTGLFQTIVGLKIRDLYEQIIANKAVAPIEAAKA

SEQ ID NO: 9314 - protein, 403 aa, Papaver somniferum
MAICTVYTTQSLNTISTPTTTKTNLGFNQKQVFFFTKKSSLSTRRNSYFSCSAGDSKTIVIGLAADSGCGKSTFMRRLTSVFGGAAEPPRGGNPDSNTLISDTTTVICLDDYHSLDRTGRKEKGVTALDPRANDFDLMYEQVKALKNGIAVEKPIYNHVSGLLDPPELIQPPKILVIEGLHPMYDSRVRDLLDFSIYLDISNEVKFAWKIQRDMAERGHSLESIKASIEARKPDFDAYIDPQKQYADAVIEVLPTTLIPDDNEGKVLRVRLIMKEGVKYFSPVYLFDEGSTISWIPCGRKLTCSYPGIKFNYGPDSYFDNEVSVLEMDGQFDRLDELIYVESHLSNISTKFYGEVTQQMLKHADFPGSNNGTGLFQTMVGLKIRDLYEQILASKVGALEASKA

SEQ ID NO: 9315 - protein, 401 aa, Papaver somniferum
MAICTVYTTQSLNTISTTTKTNLGFHQKQVFFFTKKSSLSTRRNSYFSCSAGDSKTIVIGLAADSGCGKSTFMRRLTSVFGGAAEPPRGGNPDSNTLISDTTTVICLDDYHSLDRTGRKEKGVTALDPRANDFDLMYEQVKALKNGIAVEKPIYNHVSGLLDPPELIQPPKILVIEGLHPMYDSRVRDLLDFSIYLDISNEVKFAWKIQRDMAERGHSLESIKASIEARKPDFDAYIDPQKQYADAVIEVLPTTLIPDDNEGKVLRVRLIMKEGVKYFSPVYLFDEGSTISWIPCGRKLTCSYPGIKFNYGPDSYFDNEVSVLEMDGQFDRLDELIYVESHLSNISTKFYGEVTQQMLKHADFPGSNNGTGLFQTMVGLKIRDLYEQILASKVGALEASKA

SEQ ID NO: 9316 - protein, 405 aa, Manihot esculenta
MAICTVYTTQSLNSTCSIYTPAKTHLGFNQKHVVFYSSSKKTSRRAANGVITCSAGDSQTVVIGLAADSGCGKSTFMRRLTSVFGGAAEPPKGGNPDSNTLISDTTTVICLDDYHSLDRTGRKEKGVTALDPRANDFDLMYEQVKALKDGIAVEKPIYNHVTGLLDPPELIKPPKILVIEGLHPMFDERVRDLLDFSIYLDISNEVKFAWKIQRDMAERGHSLESIKASIEARKPDFDAYIDPQKQHADAVIEVLPTQLIPDDNEGKVLRVKLIMKEGVKYFSPVYLFDEGSTISWIPCGRKLTCSYPGIKFFYGPDTYFGHEVSVLEMDGQFDRLDELIYVESHLSNISTKFYGEITQQMLKHADFPGSNNGTGLFQTIIGLKIRDLYEQIITSKAGAPVEAKA

SEQ ID NO: 9317 - protein, 328 aa, Panax ginseng
MRRLTSVFGGAAEPPKGGNPDSNTLISDTTTVICLDDYHSLDRTGRKKEGVTALDPRANNFDLMYEQVKAIKEGIAVQKPIYNHVSGLLDPPELIKPPKILVIEGLHPMYDERVRDLLDFSIYLDISNEVKFAWKIQRDMAERGHSLESIKASIEARKPDFDAFIDPQKQYADAVIEVLPTQLIPDDNEGKVLRVKLINERGSAVLQPSFDEGSTISWIPCGRKLTCSYPGIKFAYGPDSYYGHEVSVLEMDGQFDRLDELIYVESHLSNISTKFYGEVTQQMLKHADFPGSNNGTGLFQTIVGLKIRDLFEQLSASKAAAPLEATKA

SEQ ID NO: 9318 - protein, 406 aa, Aristolochia fimbriata
MAVSTVYTTHSLNSSCSISSPTRTQLGSHQRQVVFYRSSSCRGRSSRGRSVSVITCSTDTVVIGLAADSGCGKSTFMRRLTSVFGGAAEPPKGGNPDSNTLISDMTTVICLDDYHSLDRYGRKEKGVTALDPRANNFDLMYEQVKALKEGKAVDKPIYNHVTGLLDPPELIQPPKILVIEGLHPMFDARVRELLDFSIYLDISNEVKFAWKIQRDMAERGHSLESIKASIEARKPDFDAFIDPQKQYADAVIEVLPTQLIPDDNEGKVLRVKLVMKEGVKHFSPVYLFDEGSTISWIPCGRKLTCSYPGIKFAYGPDSYFSHEVSVLEMDGQFDRLDELIYVESHLSNLSTKFYGEVTQQMLKHADFPGSNNGTGLFQTIVGLKIRDLYEQIVASKAAVPVEATKA

SEQ ID NO: 9319 - protein, 401 aa, Scabiosa columbaria
MAACTVYTVQFLNSTHSISSTQLKFQQKQLLFCKKTTQPKSNRRVITCSAGDSQTIVIGLAADSGCGKSTFMRRLTSVFGGAAEPPKGGNPDSNTLISDTTTVICLDDYHSLDRTGRKEKGVTALDPKANDFDLMYEQVKALKDGVAVQKPIYNHVSGLLDPPELIKPPKILVIEGLHPMYDERVRDLLDFSIYLDISNEVKFAWKIQRDMAERGHSLESIKASIEARKPDFDAYIDPQKQYADAVIEVLPTQLIPDDNEGKVLRVKLIMKEGVKHFNPVYLFDEGSTISWIPCGRKLTCSYPGIKFAYGPDSYFGNEVSVLEMDGQFDRLDELIYVESHLSNISTKFYGEVTQQMLKHADFPGSSNGTGLFQTIVGLKIRDLYEQLTSTKASAPLEASKA

SEQ ID NO: 9320 - protein, 408 aa, Aquilegia formosa
MAICTVYSSHSLNSTCSIPTPTKTYLGFNQKQVIFFTTNKRSNRRGSNSYSTEISCAAEKTVVIGLAADSGCGKSTFMRRLTSVFGGAAEPPKGGNPDSNTLISDTTTVICLDDYHSLDRTGRKVHKVTALDPKANDFDLMYEQVKALKEGIAVEKPIYNHVSGLLDPPELIKPPKILVIEGLHPMYDARVRELLDFSIYLDISNEVKFAWKIQRDMAERGHSLESIKASIEARKPDFDAYIDPQKQYADAVIEVLPTTLIPDDNEGKVLRVRLIMKEGVKYFNPVYLFDEGSTISWIPCGRKLTCSYPGIKFNYGPDAYYDNEVSVLEMDGQFDRLDELIYVESHLSNISTKFYGEVTQQMLKHADFPGSNNGTGLFQTIVGLKIRDLYEQLIASKTGAPLEATKAK

SEQ ID NO: 9321 - protein, 406 aa, Nicotiana benthamiana
MAVSTVYTAQSLNSTCSISTPSKSHLGFHKKQVIFYTKLRTNRRSSSTSVITCSSVDEKTVVIGLAADSGCGKSTFMRRLTSVFGGAAEPPKGGNPDSNTLISDMTTVICLDDYHSLDRTGRKEKGVTALDPRANDFDLMYEQVKAIKEGIAVEKPIYNHVSGLLDPPELIKPPKILVIEGLHPMYDERVRELLDFSIYLDISNEVKFAWKIQRDMAERGHSLESIKASIEARKPDFDAYIDPQKQYADAVIEVLPTQLIPDDNEGKVLRVRLIMKEGVKNFNPVYLFDEGSTISWIPCGRKLTCSYPGIKFTYGPDSYFGNEVSVLEMDGQFDRLDELIYVESHLSNLSTKFYGEVTQQMLKHADFPGSNNGTGFFQTIVGLKIRDLYEQIVASRAAAPVQAAKA

SEQ ID NO: 9322 - protein, 401 aa, Tragopogon dubius
MAVCTVYTVQALNTTCSISTPTKTHLGFNQKQVFFYSKKSSSGRIRGGEITCSGDTIVIGLAADSGCGKSTFMRRLTSVFGGAASPPKGGNPDSNTLISDTTTVICLDDYHSLDRTGRKEKGVTALDPRANDFDLMYEQVKALKDGVAVEKPIYNHVSGLLDPPELIKPPKILVIEGLHPMYDERVRDLLDFSIYLDISNEVKFAWKIQRDMAERGHSLESIKASIEARKPDFDAFIDPQKQYADAVIEVLPTQLIPDDEGKVLRVKLIMKEGVKYFNPVYLFDEGSTISWIPCGRKLTCSYPGIKFAYGPDSYFGHEVSVLEMDGQFDRLDELIYVESHLSNISTKFYGEITQQMLKHADFPGSNNGTGLFQTIVGLKIRDLFEQLADNKASTPLQATQA

SEQ ID NO: 9323 - protein, 405 aa, Arnica chamissonis
MAVCTVYTVQALNSSCSISSPTKTHMGFSPKQVFFYTSGCKKTKSGRFRGGEITCSGDTIVIGLAADSGCGKSTFMRRLTSVFGGAASPPKGGNPDSNTLISDTTTVICLDDYHSLDRTGRKEKGVTALDPRANDFDLMYEQVKALKDGVAVEKPIYNHVSGLLDPPELIKPPKILVIEGLHPMYDQRVRDLLDFSIYLDISNEVKFAWKIQRDMAERGHSLESIKASIEARKPDFDAYIDPQKQYADAVIEVLPTQLIPDDNEGKVLRVKLIMKEGVKYFNPVYLFDEGSTVSWIPCGRKLTCSYPGIKFAYGPDAYFSHEVSVLEMDGQFDRLDELIYIESHLSNISTKFYGEITQQMLKHADFPGSNNGTGLFQTIVGLKIRDLFEQIAANKASAPLEATKA

SEQ ID NO: 9324 - protein, 61 aa, Euonymus alatus
RLPREHNSAASTSSLNSRERERERERMAVCTVYTTQSLNSTCSISTLTKTNLGFTETGCVL

SEQ ID NO: 9325 - protein, 408 aa, Gossypium raimondii
MAVCPVYTTQSLNSTCSISTPSKTHFSSHHNHLVFYRTSKRTSKRGGSSSCVITCSAGDSQTVVIGLAADSGCGKSTFMRRLTSVFGGAAEPPKGGNPDSNTLISDMTTVICLDDYHSLDRTGRKEKGVTALDPRANDFDLMYEQVKALKSGIAVDKPIYNHVTGLLDPPELIKPPKILVIEGLHPMFDERVRDLLDFSIYLDISNEVKFAWKIQRDMAERGHSLESIKASIEARKPDFDAFIDPQKQYADAVIEVLPTQLIPDDNEGKVLRVRLIMKEGVEHFSPVYLFDEGSTISWIPCGRKLTCSYPGIKFSYGPDTYFGHEVSVLEMDGQFDRLDELIYVESHLSNLSTKFYGEVTQQMLKHADFPGSNNGTGLFQTIVGLKIRDLYEQITASKTAAPLQATKA

SEQ ID NO: 9326 - protein, 394 aa, Ambrosia trifida
MAVCTVYTVQALSSSCSISSPTRTHMGLKTKSGRFRSGGYKITCSGDTIAIGLAADSGCGKSTFMRRLTSVFGGAASPPKGGNPDSNTLISDTTTVICLDDYHSLDRTGRKEKGVTALDPRANDFDLMYEQVKALKDGVAVDKPIYNHVSGLLDPPELIKPPKILVIEGLHPMYDQRVRDLLDFSIYLDISNEVKFAWKIQRDMAERGHSLESIKASIEARKPDFDAYIDPQKQYADAVIEVLPTQLIPDDNEGKVLRVKLIMKEGVKYFNPVYLFDEGSTVSWIPCGRKLTCSYPGIKFAYGPDTYFGHEVSVLEMDGQFDRLDELIYVESHLSNISTKFYGEITQQMLKHADFPGSNNGTGLFQTIVGLKIRDLFEQIAANKGSAALQASKA

SEQ ID NO: 9327 - protein, 408 aa, Gossypium raimondii
MAVCPVYTTQSLNSTCSISTPSKTHFSSHHNHLVFYRTSKRTSKRGGSSSCVITCSAGDSQTVVIGLAADSGCGKSTFMRRLTSVFGGAAEPPKGGNPDSNTLISDMTTVICLDDYHSLDRTGRKEKGVTALDPRANDFDLMYEQVKALKSGIAVDKPIYNHVTGLLDPPELIKPPKILVIEGLHPMFDERVRDLLDFSIYLDISNEVKFAWKIQRDMAERGHSLESIKASIEARKPDFDAFIDPQKQYADAVIEVLPTQLIPDDNEGKVLRVRLIMKEGVEHFSPVYLFDEGSTISWIPCGRKLTCSYPGIKFSYGPDTYFGHEVSVLEMDGQFDRLDELIYVESHLSNLSTKFYGEVTQQMLKHADFPGSNNGTGLFQTIVGLKIRDLYEQITAIKTAAPLQATKA

SEQ ID NO: 9328 - protein, 405 aa, Centaurea maculosa
MAVSTVYTVQSLNSSCSISTPTKTHLGIQQRQVLFYSNAGKKTNRGRVRGGEIRCAGDTIVIGLAADSGCGKSTFMRRLTSVFGGAASPPKGGNPDSNTLISDTTTVICLDDYHSLDRTGRKVEGVTALDPRANNFDLMYEQVKALKDGIAVDKPIYNHVSGLLDPPELIQPPKILVIEGLHPMYDERVRDLLDFSIYLDISNDVKFAWKIQRDMAERGHSLESIKASIEARKPDFDAYIDPQKQYADAVIEVLPTQLIPGDNEGKVLRVKLIMKEGVKYFSPVYLFDEGSTISWIPCGRKLTCSYPGIKFNYGPDSYFGQEVSVLEMDGQFDRLDELIYVESHLSNISTKFYGEITQQMLKHADFPGSNNGTGLFQTIVGLKIRDLFEQVTASRASAPLEATKA

SEQ ID NO: 9329 - protein, 405 aa, Cichorium intybus
MAVSTVYTVQSLNSTCSSISTPSSKSQLGIQQRQVLFYGRKTNRGRLVRGGEIRCSGDTIVIGLAADSGCGKSTFMRRLTSVFGGAAEPPRGGNPDSNTLISDTTTVICLDDYHSLDRTGRKVEGVTALDPRANNFDLMYEQVKALKDGIAVDKPIYNHVSGLLDPPELIKPPKILVIEGLHPMYDERVRDLLDFSIYLDISDDVKFAWKIQRDMAERGHSLESIKASIEARKPDFDAYIDPQKQYADAVIEVLPTQLIPDDNEGKVLRVKLIMKEGVKYFNPVYLFDEGSTISWIPCGRKLTCSYPGIKFAYGPDSYYGHEVSVLEMDGQFDRLDELIYVESHLSNISTKFYGEITQQMLKHSDFPGSNNGTGLFQTIVGLKIRDLFEQIIAARASAPLEATKA

SEQ ID NO: 9330 - protein, 406 aa, Solanum melongena
MAVCTVYTAQSLNSTCSISTPSKSHLGFHQKQVIFYTKRTNRTRSQTNHVITCSADAEKTVVIGLAADSGCGKSTFMRRLTSVFGGAAEPPKGGNPDSNTLISDMTTVICLDDYHSLDRTGRKEKGVTALDPRANDFDLMYEQVKAIKDGIAVQKPIYNHVSGLLDPPELIKPPKILVIEGLHPMFDERVRELLDFSIYLDISNEVKFAWKIQRDMAERGHSLESIKASIEARKPDFDAYIDPQKQYADAVIEVLPTQLIPDDNEGKVLRVRLIMKEGVKNFNPVYLFDEGSTISWIPCGRKLTCSYPGIKFTYGPDSYFGNEVSVLEMDGQFDRLDELIYVESHLSNLSSKFYGEVTQQMLKHADFPGSNNGTGFFQTIVGLKIRDLYEQIVASRAGAPVQAAKA

SEQ ID NO: 9331 - protein, 406 aa, Flaveria ramosissima
MAVCTVYTLQPLNSSCSISSRTKTHMGFTQKQVFFYSNGSKKTKSKRYRTGGEITCSGDTIVIGLAADSGCGKSTFMRRLTSVFGGAASPPKGGNPDSNTLISDTTTVICLDDYHSLDRTGRKEKGVTALDPRANDFDLMYEQVKALKDGVAVEKPIYNHVSGLLDPPELIKPPKILVIEGLHPMYDQRVRDLLDFSIYLDISNEVKFAWKIQRDMAERGHSLESIKASIEARKPDFDAYIDPQKQYADAVIEVLPTQLIPDDNEGKVLRVKLIMKEGVKYFNPVYLFDEGSTISWIPCGRKLTCSYPGIKFAYGPDTYFGHEVSVLEMDGQFDRLDELIYVESHLSNISTKFYGEITQQMLKHADFPGSNNGTGLFQTIVGLKIRDLFEQIAANKGSVPLEATKA

SEQ ID NO: 9332 - protein, 406 aa, Flaveria ramosissima
MAVCTVYTLQPLNSSCSISSPTKTHMGFTQKQVFFYSNGGKKTKSNRYRTGGEITCSGETIVIGLAADSGCGKSTFMRRLTSVFGGAASPPKGGNPDSNTLISDTTTVICLDDYHSLDRTGRKEKGVTALDPRANDFDLMYEQVKALKDGVAVEKPIYNHVSGLLDPPELIKPPKILVIEGLHPMYDQRVRDLLDFSIYLDISNEVKFAWKIQRDMAERGHSLESIKASIEARKPDFDAYIDPQKQYADAVIEVLPTQLIPDDNEGKVLRVKLIMKEGVKYFNPVYLFDEGSTVSWIPCGRKLTCSYPGIKFAYGPDTYFGHEVSVLEMDGQFDRLDELIYVETHLSNISTKFYGEITQQMLKHADFPGSNNGTGLFQTIVGLKIRDLFEQIAANKGSAPLEATKA

SEQ ID NO: 9333 - protein, 406 aa, Flaveria ramosissima
MAVCTLYTLQPLNSSCSISSPTKTHMGFTQKQVFFYSNGSKKTKSKRYRTGGEITCSGDTIVIGLAADSGCGKSTFMRRLTSVFGGAASPPKGGNPDSNTLISDTTTVICLDDYHSLDRTGRKEKGVTALDPRANDFDLMYEQVKALKDGVAVEKPIYNHVSGLLDPPELIKPPKILVIEGLHPMYDQRVRDLLDFSIYLDISNEVKFAWKIQRDMAERGHSLESIKASIEARKPDFDAYIDPQKQYADAVIEVLPTQLIPDDNEGKVLRVKLIMKEGVKYFNPVYLFDEGSTVSWIPCGRKLTCSYPGIKFAYGPDTYFGHEVSVLEMDGQFDRLDELIYVESHLSNISTKFYGEITQQMLKHADFPGSNNGTGLFQTIVGLKIRDLFEQIAANKGSAPLEATKA

SEQ ID NO: 9334 - protein, 247 aa, Flaveria ramosissima
MLLVFLDPPELIKPPKILVIEGLHPMFDQRVRDLLDFSIYLDISNDVKFAWKIQRDMAERGHSLESIKASIEARKPDFDAYIDPQKQYADAVIEVLPTQLIPDDNEGKVLRVKLIMKEGVKYFSPVYLFDEGSTISWIPCGRKLTCSYPGIKFAYGPDTYYGHEVSVLEMDGQFDKLDELIYVESHLSNISTKFYGEITQQMLKHADFPGSNNGTGLFQTIVGLKIRDLFEQITASKASAQLEAAKA

SEQ ID NO: 9335 - protein, 393 aa, Ambrosia trifida
MAVCTVYTVQALSSSCSISSPTKTHMGLKTKSGRFRGGYKITCSGDTIVIGLAADSGCGKSTFMRRLTSVFGGAASPPKGGNPDSNTLISDTTTVICLDDYHSLDRTGRKEKGVTALDPRANDFDLMYEQVKALKDGVAVDKPIYNHVSGLLDPPELIKPPKILVIEGLHPMYDQRVRDLLDFSIYLDISNEVKFAWKIQRDMAERGHSLESIKASIEARKPDFDAYIDPQKQYADAVIEVLPTQLIPDDNEGKVLRVKLIMKEGVKYFNPVYLFDEGSTVSWIPCGRKLTCSYPGIKFAYGPDTYFGHEVSVLEMDGQFDRLDELIYVESHLSNISTKFYGEITQQMLKHADFPGSNNGTGLFQTIVGLKIRDLFEQIAVSKGSAALQASKA

SEQ ID NO: 9336 - protein, 406 aa, Manihot esculenta
MAICTVYTTQSLNSTCSIYTPGKTHFGFNQKHLVLYSSSSKRINRRASTSVITCSAEDSQTVVIGLAADSGCGKSTFMRRLTSVFGGAAEPPRGGNPDSNTLISDTTTVICLDDYHSLDRTGRKEKGVTALDPKANDFDLMCEQVKALKDGIAVEKPIYNHVTGLLDPPELIKPPKILVIEGLHPMFDERVRKLLDFSIYLDISNEVKFAWKIQRDMAERGHSLESIKASIEARKPDFDAYIDPQKQYADAVIEVLPTQLIPGDNEGKILRVRMIMKEGVEYFIPVYLFDEGSTISWIPCGRKLTCSYPGIKFSYGPETYFGHEVSVVEMDGQFDRLDELIYVESHLSNISTKFYGEVTQQMLKHADFPGSNNGTGLFQTIIGLKIRDLYEQIIASKAKARVEAKA

SEQ ID NO: 9337 - protein, 403 aa, Ricinus communis
MAICTVYTTQSLNSTCSISTPGKTHLGFNQKQVVFYSKRTNKRATSTSVITCSADDSQTVVIGLAADSGCGKSTFMRRLTSVFGGAAEPPKGGNPDSNTLISDTTTVICLDDYHSLDRTGRKEKGVTALDPRANDFDLMYEQVKAIKDGVAVEKPIYNHVTGLLDPPELIKPPKILVIEGLHPMYDQRVRDLLDFSIYLDISNEVKFAWKIQRDMAERGHSLESIKASIEARKPDFDAYIDPQKQYADAVIEVLPTQLIPDDEGKVLRVRLIMKEGVKNFNPVYLFDEGSTISWIPCGRKLTCSYPGIKFFYGPETYFGHEVSVLEMDGQFDRLDELIYVESHLSNISTKFYGEVTQQMLKHADFPGSNNGTGLFQTIVGLKIRDLYEQIIASKAKTPVEAKA

SEQ ID NO: 9338 - protein, 408 aa, Gossypium hirsutum
MAVCPVYTTQSLNSTCSISTPSKTHFSSHHNHLVFYRTSKRTSKRGGSSSCVITCSAGDSQTVVIGLAADSGCGKSTFMRRLTSVFGGAAEPPKGGNPDSNTLISDMTTVICLDDYHSLDRTGRKEKGVTALDPRANDFDLMYEQVKALKSGIAVDKPIYNHVSGLLDPPELIKPPKILVIEGLHPMFDERVRDLLDFSIYLDISNEVKFAWKIQRDMAERGHSLESIKASIEARKPDFDAFIDPQKQYADAVIEVLPTQLIPDDNEGKVLRVRLIMKEGVEHFSPVYLFDEGSTISWIPCGRKLTCSYPGIKFSYGPDTYFGHEVSVLEMDGQFDRLDELIYVESHLSNLSTKFYGEVTQQMLKHADFPGSNNGTGLFQTIVGLKIRDLYEQITAIKTAAPLQATKA

SEQ ID NO: 9339 - protein, 406 aa, Flaveria ramosissima
MAVCTVYTLQPLNSSCSISSRTKTHMGFTQKQVFFYSNGSKKTKSKRYRTGGEITCSGDTIVIGLAADSGCGKSTFMRRLTSVVGGAASPPKGGNPDSNTLISDTTTVICLDDYHSLDRTGRKEKGVTALDPRANDFDLMYEQVKALKDGVAVEKPIYNHVSGLLDPPELIKPPKILVIEGLHPMYDQRVRDLLDFSIYLDISNEVKFAWKIQRDMAERGHSLESIKASIEARKPDFDAYIDPQKQYADAVIEVLPTQLIPDDNEGKVLRVKLIMKEGVKYFNPVYLFDEGSTVSWIPCGRKLTCSYPGIKFAYGPDTYFGHEVSVLEMDGQFDRLDELIYVESHLSNISTKFYGEITQQMLKHADFPGSNNGTGLFQTIVGLKIRDLFEQIAANKGSAPLEATKA

SEQ ID NO: 9340 - protein, 391 aa, Flaveria ramosissima
MLNLITHKTHMGFTQKQVFFYSNGSKKTKSKRYRTGGEITCSGDTIVIGLAADSGCGKSTFMRRLTSVFGGAASPPKGGNPDSNTLISDTTTVICLDDYHSLDRTGRKEKGVTALDPRANDFDLMYEQVKALKDGVAVEKPIYNHVSGLLDPPELIKPPKILVIEGLHPMYDQRVRDLLDFSIYLDISNEVKFAWKIQRDMAERGHSLESIKASIEARKPDFDAFIDPQKQYADAVIEVLPTQLIPDDNEGKVLRVKLIMKEGVKYFNPVYLFDEGSTISWIPCGRKLTCSYPGIKFAYGPDTYFGHEVSVLEMDGQFDRLDELIYVETHLSNISTKFYGEITQQMLKHADFPGSNNGTGLFQTIVGLKIRDLFEQIAANKGSALLEATKA

SEQ ID NO: 9341 - protein, 407 aa, Tabernaemontana elegans
MAVSTVYTVQSLNSTCSISTPSKSHLGFTQKHQVFFYSTSKKSINTTRRSSEISCSAQEKTVVIGLAADSGCGKSTFMRRLTSVFGGAAEPPKGGNPDSNTLISDMTTVICLDDYHSLDRTGRKEKGVTALDPRANNFDLMYEQVKALKSGVAVDKPIYNHVTGLLDPPELIKPPKILVIEGLHPMFDERVRDLLDFSIYLDISNEVKFAWKIQRDMAERGHSLESIKASIEARKPDFEAYIDPQKQYADAVIEVLPTQLIPDDNGGKILRVKLIMKEGVKHFSPVYLFDEGSTISWIPCGRKLTCSYPGIKFSYGPDTYFGNEVSVLEMDGQFDRLDELIYVESHLSSLSTKFYGEVTQQMLKHADFPGSNNGTGLFQTIVGLKIRDLYEQIAATKVATPLEAAKA

SEQ ID NO: 9342 - protein, 405 aa, Centaurea maculosa
MAVSTVYTVQSLNSSCSISTPTKTHLGIQQRQVLFYSNAGKKTNRGRVRGGEIRCAGDTIVIGLAADSGCGKSTFMRRLTSVFGGAASPPKGGNPDSNTLISDTTTVICLDDYHSLDRTGRKVEGVTALDPRANNFDLMYEQVKALKDGIAVDKPIYNHVSGLLDPPELIKPPKILVIEGLHPMYDERVRDLLDFSIYLDISNDVKFAWKIQRDMAERGHSLESIKASIEARKPDFDAYIDPQKQYADAVIEVLPTQLIPGDNEGKVLRVKLIMKEGVKYFSPVYLFDEGSTISWIPCGRKLTCSYPGIKFNYGPDSYFGQEVSVLEMDGQFDRLDELIYVESHLSNISTKFYGEITQQMLKHADFPGSNNGTGLFQTIVGLKIRDLFEQITASRASAPLEATKA

SEQ ID NO: 9343 - protein, 403 aa, Flaveria ramosissima
MAVCTVYTLQPLNSSCSISSPTKTHMGFTQKQVFFYSNGSKKTKSKRYRTGGEITCSGDTIVIGLAADSGCGKSTFMRRLTSVFGGAASPPKGGNPDSNTLISDTTTVICLDDYHSLDRTGRKEKGVTALDPRANDFDLMYEQVKALKDGVAVEKPIYNHVSGLLDPPELIKPPKILVIEGLHPMYDQRVRDLLDFSIYLDISNEVKFAWKIQRDMAERGHSLESIKASIEARKPDFDAYIDPQKQYADAVIEVLPTQLIPDDNEGKVLRVKLIMKEGVKYFNPVYLFDEGSTVSWIPCGRKLTCSYPGIKFAYGPDTYFGHEVSVLEMDGQFDRLDELIYVESHLSNISTKFYGEITQQMLKHADFPGSNNGTGLFQTIVGLKIRDLFEQIAANKGSAPLEA

SEQ ID NO: 9344 - protein, 405 aa, Helianthus annuus
MAVCTVYTVQALSSSCSISSPTKTHMGLSPKQVLFYNNSGKKTKSGRFRSGEITCSGDTIVIGLAADSGCGKSTFMRRLTSVFGGAASPPKGGNPDSNTLISDTTTVICLDDYHSLDRTGRKEKGVTALDPRANDFDLMYEQVKALKDGVAVEKPIYNHVSGLLDPPELIKPPKILVIEGLHPMYDERVRDLLDFSIYLDISNEVKFAWKIQRDMAERGHSLESIKASIEARKPDFDAYIDPQKQYADAVIEVLPTQLIPDDNEGKVLRVKLIMKEGVKYFNPVYLFDEGSTVSWIPCGRKLTCSYPGIKFAYGPDSYFGHEVSVLEMDGQFDRLDELIYVESHLSNISTKFYGEITQQMLKHSDFPGSNNGTGLFQTIVGLKIRDLFEQIAAGKGAVSLEASKA

SEQ ID NO: 9345 - protein, 405 aa, Centaurea maculosa
MAVSTVYTVQSLNSSCSISTPTKTHLGIQQRQVLFYSNAGKKTNRGRVRGGEIRCAGDTIVIGLAADSGCGKSTFMRRLTSVFGGAASPPKGGNPDSNTLISDTTTVICLDDYHSLDRTGRKVEGVTALDPRANNFDLMYEQVKALKDGIAVDKPIYNHVSGLLDPPELIKPPKILVIEGLHPMYDERVRDLLDFSIYLDISNDVKFAWKIQRDMAERGHSLESIKASIEARKPDFDAYIDPQKQYADAVIEVLPTQLIPGDNEGKVLRVKLIMKEGVKYFSPVYLFDEGSTISWIPCGRKLTCSYPGIKFNYGPDSYFGQEVSVLEMDGQFDRLDELIYVESHLSNISTKFYGEITQQMLKHADFPGSNNGTGLFQTIVGLKIRDLFEQITATRASAPLEATKA

SEQ ID NO: 9346 - protein, 377 aa, Chelidonium majus
QVVFFTTTRKSNRRNNSYSSEISCSAEEAKTIVIGLAADSGCGKSTFMRRLTSVFGGAAEPPKGGNPDSNTLISDTTTVICLDDYHSLDRTGRKEKGVTALDPRANDFDLMYEQVKALKQGIPVQKPIYNHVSGLLDPPELIQPPKILVIEGLHPMYDSRVRDLLDFSIYLDISNEVKFAWKIQRDMAERGHSLESIKASIEARKPDFDAYIDPQKQYADAVIEVLPTELIPDDNEGKVLRVRLIMKEGVKYFSPVYLFDEGSTISWIPCGRKLTCSYPGIKFNYGPDAYFDNEVSVLEMDGQFDRLDELIYVESHLSNISTKFYGEVTQQMLKHADFPGSNNGTGLFQTMVGLKIRDLYEQLVANKAAAPLQATKA

SEQ ID NO: 9347 - protein, 402 aa, Flaveria ramosissima
MAVCTVYTVQSLNSTCSISTPTKTHLGIQKRQVLFYSKKTNKGRVRSGEIRCSGDTIVIGLAADSGCGKSTFMRRLTSVFGGAAEPPKGGNPDSNTLISDTTTVICLDDYHSLDRTGRKVEGVTALDPRANNFDLMYEQVKALKEGVAVEKPIYNHVTGLLDPPELIKPPKILVIEGLHPMFDQRVRDLLDFSIYLDISNDVKFAWKIQRDMAERGHSLESIKASIEARKPDFDAYIDPQKQYADAVIEVLPTQLIPDDNEGKVLRVKLIMKEGVKYFSPVYLFDEGSTISWIPCGRKLTCSYPGIKFAYGPDTYYDHEVSVLEMDGQFDKLDELIYVESHLSNISTKFYGEITQQMLKHADFPGSNNGTGLFQTIVGLKIRDLFEQITASKASAQLEATKA

SEQ ID NO: 9348 - protein, 330 aa, Nicotiana tabacum
  misc_feature (16)..(16): Xaa can be any naturally occurring amino acid
MRRLTSVFGGAAEPPXGGNPDSNTLISDMTTVICLDDYHSLDRTGRKEKGVTALDPRANDFDLMYEQVKAIKEGIAVEKPIYNHVSGLLDPPELIKPPKILVIEGLHPMYDERVRELLDFSIYLDISNEVKFAWKIQRDMAERGHSLESIKASIEARKPDFDAYIDPQKQYADAVIEVLPTQLIPDDNEGKVLRVRMIMKEGVKNFNPVYLFDEGSTISWIPCGRKLTCSYPGIKFTYGPDTYFGNEVSVLEMDGQFDRLDELIYVESHLSNLSTKFYGEVTQQMLKHADFPGSNNGTGFFQTIVGLKIRDLYEQIVASRAAAPVQAAKA

SEQ ID NO: 9349 - protein, 406 aa, Flaveria ramosissima
MAVCTVYTLQPLNSSCSISSPTKTHMGFTQKQVFFYSNGGKKTKSNKYRTGGEITCSGDTIVIGLAADSGCGKSTFMRRLTSVFGGAASPPKGGNPDSNTLISDTTTVICLDDYHSLDRTGRKEKGVTALDPRANDFDLMYDQVKALKDGVAVEKPIYNHVSGLLDPPELIKPPKILVIEGLHPMYDQRVRDLLDFSIYLDISNEVKFAWKIQRDMAERGHSLESIKASIEARKPDFDAYIDPQKQYADAVIEVLPTQLIPDDNEGKVLRVKLIMKEGVKYFNPVYLFDEGSTVSWIPCGRKLTCSYPGIKFAYGPDTYFGHEVSVLEMDGQFDRLDELIYVESHLSNISTKFYGEITQQMLKHADFPGSNNGTGLFQTIVGLKIRDLFEQIAANKGSAPLEATKA

SEQ ID NO: 9350 - protein, 407 aa, Platanus occidentalis
MAICTVYTTPSLNSTCSISTPTQTHLGFHQRQVFFYSTSKKSSRRGCSNVSEITCSAEEKTIVIGLAADSGCGKSTFMRRLTSVFGGAAEPPKGGNPDSNTLISDTTTVICLDDYHSLDRTGRKQKGVTALDPRANNFDLMYEQVKAIKDGIPVEKPIYNHVSGLLDPPELIKPPKILVIEGLHPMFDSRVRDLLDFSIYLDISNEVKFAWKIQRDMAERGHSLESIKASIEARKPDFDAYIDPQKQYADAVIEVLPTQLIPGDNEGKVLRVRLIMKEGVKYFSPVYLFDEGSTISWIPCGRKLTCSYPGIKFFYGPDTYFGHEVSVLEMDGQFDRLDELIYVESHLSNISTKFYGEVTQQMLKHSDFPGSNNGTGFFQTIVGLKIRDLFEQIVASRATAPLEATKA

SEQ ID NO: 9351 - protein, 405 aa, Populus trichocarpa
MAVCTVYTPQSLNSTCSISTPTKTHLGFNQKHVVFYSSNKKTSKRASSAVITCSADTQTVVIGLAADSGCGKSTFMRRLTSVFGGAAEPPKGGNPDSNTLISDTTTVICLDDYHSLDRTGRKEKGVTALDPRANDFDLMYDQVKAIKDGIAVEKPIYNHVTGLLDPPELIKPPKILVIEGLHPMYDQRVRDLLDFSIYLDISNEVKFAWKIQRDMAERGHSLESIKASIEARKPDFDAYIDPQKQYADAVIEVLPTQLIPDDNEGKVLRVRLIMKEGVKFFSPVYLFDEGSSISWIPCGRKLTCSYPGIKFSYGPDTYYGHEVSVLEMDGQFDRLDELIYVESHLSNLSTKFYGEVTQQMLKHADFPGSNNGTGLFQTIVGLKIRDLFEQIIASRAKTPVEATKA

SEQ ID NO: 9352 - protein, 406 aa, Helianthus annuus
MAVCTVYTVQPLNTSCSISTPTKTHMGFNQKQVFFFNNYSSKNTNNSRFRGNKITCSGDTIVIGLAADSGCGKSTFMRRLTSVFGGAASPPKGGNPDSNTLISDTTTVICLDDYHSLDRTGRKEKGVTALDPRANDFDLMYEQVKALKDGVAVEKPIYNHVSGLLDPPELIKPPKILVIEGLHPMYDQRVRDLLDFSIYLDISNEVKFAWKIQRDMAERGHSLESIKASIEARKPDFDAYIDPQKQYADAVIEVLPTRLIPDDNEGKVLRVKLIMKEGVKYFNPVYLFDEGSTVSWIPCGRKLTCSYPGIKFAYGPDTYFGHEVSVLEMDGQFDRLDELIYVESHLSNISTKFYGEITQQMLKHADFPGSNNGTGLFQTIVGLKIRDLFEQIAASKASAPLEATKA

SEQ ID NO: 9353 - protein, 400 aa, Tragopogon dubius
MAVSTVYTVQCMNSSLSTPTKTHLGNKQRQVLFYGKKTSRGRLRGCEIRCSGDTIVIGLAADSGCGKSTFMRRLTSVFGGAAEPPKGGNPDSNTLISDTTTVICLDDYHSLDRTGRKVEGVTALDPRANNFDLMYEQVKALKDGIAVDKPIYNHVSGLLDPPELIKPPKILVIEGLHPMYDERVRDLLDFSIYLDISNDVKFAWKIQRDMAERGHSLESIKASIEARKPDFDAYIDPQKQYADAVIEVLPTQLIPGDNEGKVLRVKLIMKEGVKYFSPVYLFDEGSTISWIPCGRKLTCSYPGIKFAYGPDSYFGNEVSVLEMDGQFDRLDELIYVESHLSNISTKFYGEITQQMLKHSDFPGSNNGTGLFQTLVGLKIRDLFEQITAAKASAPLEATKA

SEQ ID NO: 9354 - protein, 330 aa, Flaveria ramosissima
MRRLTSVFGGAASAPKGGNPDSNTLISDTTTVICLDDYHSLDRTGRKEKGVTALDPRANDFDLMYEQVKALKDGVAVEKPIYNHVSGLLDPPELIKPPKILVIEGLHPMYDQRVRDLLDFSIYLDISNEVKFAWKIQRDMAERGHSLESIKASIEARKPDFDAYIDPQKQYADAVIEVLPTQLIPDDNEGKVLRVKLIMKEGVKYFNPVYLFDEGSTISWIPCGRKLTCSYPGIKFAYGPDTYFGHEVSVLEMDGQFDRLDELIYVESHLSNISTKFYGEITQQMLKHADFPGSNNGTGLFQTIVGLKIRDLFEQIAANKGSVPLEATKA

SEQ ID NO: 9355 - protein, 398 aa, Ipomoea nil
MAVCTVYTVQSLHSTCSISTPTKTHFQRQVFVYKKSARKVGISCAAAGGDGKTVVIGLAADSGCGKSTFMRRLTSVFGGAAEPPKGGNPDSNTLISDMTTVICLDDYHSLDRTGRKEKGVTALDPRANDFDLMYEQVKALKEGKAVDKPIYNHVTGLLDPPELTKPPKILVIEGLHPMYDARVRELLDFSIYLDISNEVKFAWKIQRDMAERGHSLESIKASIEARKPDFDAYIDPQKQYADAVIEVLPTQLIPDDNEGKVLRVRLIMKEGVKHFSPVYLFDEGSTISWIPCGRKLTCSYPGIKFTYGPDTYFGHEVSVLEMDGQFDRLDELIYVESHLSSLSTKFYGEVTQQMLKHADFPGSNNGTGFFQTIVGLKIRDLYEQIVATRAAAPVEAKA

SEQ ID NO: 9356 - protein, 404 aa, Olea europaea
MAVSTVYTVQSLNSTCSISKPTKTHLGFNQKQLVFFKKTTTTTTRRPTTVITCSAGDTVVIGLAADSGCGKSTFMRRLTSVFGGAAEPPKGGNPDSNTLISDTTTVICLDDYHSLDRTGRKEKGVTALDPRANNFDLMYEQVKAIKSGVPVEKPIYNHVTGLIDPPELIKPPKIFVIEGLHPMYDARVRELLDFSIYLDISNEVKFAWKIQRDMAERGHSLESIKASIEARKPDFDAYIDPQKQYADAVIEVLPTQLIPDDNEGKVLRVRLIMKEGVKYFNPVYLFDEGSTISWIPCGRKLTCSYPGIKFSYGPETYFGHEVSVLEMDGQFDRLDELIYVESHLSNLSSKFYGEVTQQMLKHADFPGSNNGTGFFQTIVGLKIRDLFEQIVASKTGAPLEATKA

SEQ ID NO: 9357 - protein, 406 aa, Ambrosia trifida
MAVCTVYTVQPLNTSCSISTPTKPHMGFNQKQVFFLTKSNNKTTKNSSFRGNKITCSGDTIVIGLAADSGCGKSTFMRRLTSVFGGAASPPKGGNPDSNTLISDTTTVICLDDYHSLDRTGRKEKGVTALDPRANDFDLMYEQVKAIKDGVAVEKPIYNHVSGLLDPPELIKPPKILVIEGLHPMYDQRVRDLLDFSIYLDISNEVKFAWKIQRDMAERGHSLESIKASIEARKPDFDAYIDPQKQYADAVIEVLPTQLIPDDNEGKVLRVKLIMKEGVKYFNPVYLFDEGSTVSWIPCGRKLTCSYPGIKFAYGPDAYFSHEVSVLEMDGQFDRLDELIYVESHLSNISTKFYGEITQQMLKHADFPGSNNGTGLFQTIVGLKIRDLFEQIAASKASAPLEATKA

SEQ ID NO: 9358 - protein, 402 aa, Flaveria ramosissima
MAVCTVYTVQSLNSTCSISTPTKTHLGIQKRQVLFYSKKTNKDRVRSGEIRCSGDTIVIGLAADSGCGKSTFMRRLTSVFGGAAEPPKGGNPDSNTLISDTTTVICLDDYHSLDRTGRKVEGVTALDPRANNFDLMYEQVKALKDGVAVQKPIYNHVTGLLDPPELIKPPKILVIEGLHPMFDQRVRDLLDFSIYLDISNDVKFAWKIQRDMAERGHSLESIKASIEARKPDFDAYIDPQKQYADAVIEVLPTQLIPDDNEGKVLRVKLIMKEGVKYFSPVYLFDEGSTISWIPCGRKLTCSYPGIKFAYGPDTYYDHEVSVLEMDGQFDKLDELIYVESHLSNISTKFYGEITQQMLKHADFPGSNNGTGLFQTIVGLKIRDLFEQITASKASAQLEATKA

SEQ ID NO: 9359 - protein, 318 aa, Guizotia abyssinica
MAVCTLQALNSSFSISSTKTHMGFNSKQVFFCKKTKSGRFRSGEITCSGDTIVIGLAADSGCGKSTFMRRLTSVFGGAASPPKGGNPDSNTLISDTTTVICLDDYHSLDRTGRKEKGVTALDPRANDFDLMYEQVKALKDGVAVEKPIYNHVSGLLDPPELIKPPKILVIEGLHPMYDERVRDLLDFSIYLDISNEVKFAWEIQRDMAERGHSLESIKASIEARKPDFDAYIDPQKQYADAVIEVLPTQLIPDDNEGKVLRVKLIMKEGVKYFNPVYLFDEDSTISWIPCGRKLTCSYPGIKFAYGPDAYFGTEVSLL

SEQ ID NO: 9360 - protein, 330 aa, Flaveria ramosissima
MRRLTSVFGGAASPPKGGNPDSNTLISDTTTVICLDDYHSLDRTGRKEKGVTALDPRANDFDLMYEQVKALKDGVAVEKPIYNHVSGLLDPPELIKPPKILVIEGLHPMYDQRVRDLLDFSIYLDISNEVKFAWKIQRDMAERGHSLESIKASIEARKPDFDAYIDSQKQYADAVIEVLPTQLIPDDNEGKVLRVKLIMKEGVKYFNPVYLFDEGSTVSWIPCGRKLTCSYPGIKFAYGPDTYFGHEVSVLEMDGQFDRLDELIYVESHLSNISTKFYGEITQQMLKHADFPGSNNGTGLFQTIIGLKIRDLFEQIAANKGSAPLEATKA

SEQ ID NO: 9361 - protein, 404 aa, Malus domestica
MAICAVHTSGQLNPTCSFSSSLGLSGQKQQQVAVFYKQRSSSSRRSVGVSVIRCEQETIVIGLAADSGCGKSTFMRRLTSVFGGGAEPPKGGNPDSNTLISDTTTVICLDDYHSLDRTGRKEKGVTALDPRANDFDLMYEQVKAIKEGKAVQKPIYNHVSGLLDPPELIKPPKILVIEGLHPMYDQRVRDLLDFSIYLDISNEVKFAWKIQRDMAERGHSLESIKASIEARKPDFDAYIDPQKQYADAVIEVLPTQLIPGDNEGKVLRVRLIMKEGVKYFNPVYLFDEGSTISWIPCGRKLTCSYPGIKFNYGPDTYFGNEVSLLEMDGQFDRLDELIYVESHLSNISTKFYGEVTQQMLKHSDFPGSNNGTGLFQTIVGLKIRDLYEQLIAARAKTPVEATKA

SEQ ID NO: 9362 - protein, 411 aa, Fagus grandifolia
MSICTVYTTPSLNSTCSISTSKTHLGFHQKQVVFYTSGKKTSKRGSSSNTTSPYVITCSTGDSQTIVIGLAADSGCGKSTFMRRLTSVFGGAAEPPKGGNPDSNTLISDTTTVICLDDYHSLDRTGRKQKGVTALDPRANDFDLMYEQVKAIKDGIPVEKPIYNHVTGLLDPPELIKPPKILVIEGLHPMFDQRVRDLLDFSIYLDISNEVKFAWKIQRDMAERGHSLESIKASIEARKPDFDAYIDPQKQYADAVIEVLPTQLIPDDNEGKVLRVRLIMKEGVEFFSPVYLFDEGSTISWIPCGRKLTCSYPGIKFFYGPDAYFGHEVSVLEMDGQFDRLDELIYVESHLSNISTKFYGEVTQQMLKHSDFPGSNNGTGLFQTIVGLKIRDLFEQLIASKAKTPVEATKA

SEQ ID NO: 9363 - protein, 405 aa, Euonymus alatus
MAVCTVYTTQSLNSTCSISTPTKTNLGFHRKQVVFYSTSGKRSRGSNTTVITCSAGDSQTVVIGLAADSGCGKSTFMRRLTSVFGGAAEPPKGGNPDSNTLISDTTTVICLDDYHSLDRTGRKEKGVTALDPRANNFDLMYEQVKAIKDGIAVQKPIYNHVSGLLDPPELIKPPKILVIEGLHPMYDHRVRDLLDFSIYLDISNEVKFAWKIQRDMAERGHSLESIKASIEARKPDFDAYIDPQKQYADAVIEVLPTQLIPDDNEGKTLRVKLIMKEGVKYFNPVYLFDEGSTISWIPCGRKLTCSYPGIQFAYGPDAYFDHEVSVLEMDGQFDRLDELIYVESHLSNISTKFYGEVTQQLLKHADFPGSNNGTGLFQTIVGLKIRDLYEQLVASKAGAPVKART

SEQ ID NO: 9364 - protein, 405 aa, Flaveria ramosissima
MAVCTVYTLQPLNSSCSISSPTKTHMGFTQKQVFFYSNGGKKTKSGRLRGGEITCSGDTIVIGLAADSGCGKSTFMRRLTSVFGGAASAPKGGNPDSNTLISDTTTVICLDDYHSLDRTGRKEKGVTALDPRANDFDLMYEQVKALKDGVAVEKPIYNHVSGLLDPPELIKPPKILVIEGLHPMYDQRVRDLLDFSIYLDISNEVKFAWKIQRDMAERGHSLESIKASIEARKPDFDAYIDPQKQYADAVIEVLPTQLIPDDNEGKVLRVKLIMKEGVKYFNPVYLFDEGSTVSWIPCGRKLTCSYPGIKFAYGPDTYFGHEVSVLEMDGQFDRLDELIYVETHLSNISTKFYGEITQQMLKHADFPGSNNGTGLFQTIVGLKIRDLFEQIAANKGSALLEATKA

SEQ ID NO: 9365 - protein, 405 aa, Lactuca sativa
MAVSTVVYTVQSLNSTCSSISTPTTKTHLGIQQRQVLFYGKKTHRGRMRSGEIRCSGDTIVIGLAADSGCGKSTFMRRLTSVFGGAAEPPKGGNPDSNTLISDTTTVICLDDYHSLDRTGRKVEGVTALDPRANNFDLMYEQVKALKDGIAVDKPIYNHVSGLLDPPELIKPPKILVIEGLHPMYDQRVRDLLDFSIYLDISDDVKFAWKIQRDMAERGHSLESIKASIEARKPDFDAYIDPQKQYADAVIEVLPTQLIPDDNEGKVLRVKLIMKEGVKYFNPVYLFDEGSTISWIPCGRKLTCSYPGIKFAYGPDSYFDNEVSVLEMDGQFDRLDELIYVESHLSNISTKFYGEITQQMLKHSDFPGSNNGTGLFQTIVGLKIRDLFEQLTAAKASAPLEATKA

SEQ ID NO: 9366 - protein, 395 aa, Utricularia gibba
MAVASVYTLQSVSSICGSSFGFTHKHQHVLLYANKHRISCSAAPGDKTVVIGLAADSGCGKSTFMRRLTSVFGGAAEPPKGGNPDSNTLISDTTTVICLDDYHSLDRTGRKEKGVTALDPRANNFDLMYEQVKALKDGIAVEKPIYNHVTGLLDPPELIKPPKILVIEGLHPMFDSRVRDLLDFSIYLDISNEVKFAWKIQRDMAERGHSLESIKASIEARKPDFDAYIDPQKQYADAVIEVLPTQLIPDDNEGKVLRVRLIMKEGVQYFNPVYLFDEGSTISWIPCGRKLTCSYPGIKFGYGPDTYFDHEVSVVEMDGQFDRLDELIYVESHLSNLSTKFYGEVTQQMLKHADFPGSNNGTGLFQTIIGLKIRDLFEQISAARNSASTLEAAKA

SEQ ID NO: 9367 - protein, 402 aa, Echinacea purpurea
MAVSTVYTAQSLNSTCSISTPTKTHLEIQQRQVLFYSKKTNRGRVRGDEIRCAGDTIVIGLAADSGCGKSTFMRRLTSVFGGAAEPPKGGNPDSNTLISDTTTVICLDDYHSLDRTGRKVAGVTALDPKANDFDLMYQQVKALKDGIAVEKPIYNHVSGLLDPPELIKPPKILVIEGLHPMYDQRVRDLLDFSIYLDISNDVKFAWKIQRDMAERGHSLESIKASIEARKPDFDAYIDPQKQYADAVIEVLPTQLIPDDNEGKVLRVKLIMKEGVKYFSPVYLFDEGSTISWIPCGRKLTCSYPGIKFAYGPDTYYGHEVSVLEMDGQFDRLDELIYVESHLSNISTKFYGEITQQMLKHSDFPGSNNGTGLFQTIVGLKIRDLFEQIAATKASTPQEASKA

SEQ ID NO: 9368 - protein, 407 aa, Glycine max
MAACTVYSTQSLSTNCSISTPSKTQLSFFHQKQVVFWRNSKKGSCSSRRSYVITCAAGDSQTVVIGLAADSGCGKSTFMRRLTSVFGGAAEPPKGGNPDSNTLISDTTTVICLDDYHSLDRTGRKEKGVTALDPRANDFDLMYEQVKALKDGIAVEKPIYNHVTGLLDPPELIKPPKILVIEGLHPMFDSRVRDLLDFSIYLDISNEVKFAWKIQRDMAERGHSLESIKASIEARKPDFEAYIDPQKQYADAVIEVLPTQLIPDDNEGKILRVRLIQKEGVKYFSPVYLFDDGSTISWIPCGRKLTCSYPGIKFFYGPETYYGNEVSVVEMDGQFDRLDELIYVESHLSNLSTKFYGEVTQQMLKHADFPGSNNGTGLFQTIVGLKIRDLYEQLIASKAETPVAAKA

SEQ ID NO: 9369 - protein, 402 aa, Ambrosia trifida
MAVSTVYTVQSLNSTCSISTPTKAHLGSHQRQVLFYTKKTNKGRVRGGEIRCAGDTIVIGLAADSGCGKSTFMRRLTSVFGGAAEPPKGGNPDSNTLISDTTTVICLDDYHSLDRTGRKVEGVTALDPRANNFDLMYEQVKALKDGIAVDKPIYNHVSGLLDPPELIKPPKILVIEGLHPMYDERVRDLLDFSIYLDISNDVKFAWKIQRDMAERGHSLESIKASIEARKPDFDAYIDPQKQYADAVIEVLPTQLIPDDNEGKVLRVKLIMKEGVKYFSPVYLFDEGSTISWIPCGRKLTCSFPGIKFSYGPDTYYGQEVSVLEMDGQFDKLDELIYVESHLSNISTKFYGEITQQMLKHNDFPGSNNGTGLFQTIVGLKIRDLFEQITASKASATLEATKA

SEQ ID NO: 9370 - protein, 390 aa, Ambrosia trifida
TVYTVQALSSSCSISSPTRTHMGLKTKSGRFRSGGYKITCSGDTIVIGLAADSGCGKSTFMRRLTSVFGGAASPPKGGNPDSNTLISDTTTVICLDDYHSLDRTGRKEKGVTALDPRANDFDLMYEQVKALKDGVAVDKPIYNHVSGLLDPPELIKPPKILVIEGLHPMYDQRVRDLLDFSIYLDISNEVKFAWKIQRDMAERGHSLESIKASIEARKPDFDAYIDPQKQYADAVIEVLPTQLIPDDNEGKVLRVKLIMKEGVKYFNPVYLFDEGSTVSWIPCGRKLTCSYPGIKFAYGPDTYFGHEVSVLEMDGQFDRLDELIYVESHLSNISTKFYGEITQQMLKHADFPGSNNGTGLFQTIVGLKIRDLFEQIAVSKGSASLQASKA

SEQ ID NO: 9371 - protein, 409 aa, Cicer arietinum
MAACTVYSTQSLRTNISIPTSSSSKTHLGFNQKQVVFYTTSKKSRTNNNKRYLITCKAGDSQTIVIGLAADSGCGKSTFMRRLTSVFGGAAEPPKGGNPDSNTLISDTTTVICLDDYHSLDRTGRKEKGVTALDPRANDFDLMYQQVKAIKDGISVEKPIYNHVTGLLDPPELIKPPKILVIEGLHPMYDSRVRDLLDFSIYLDISNEVKFAWKIQRDMAERGHSLESIKASIEARKPDFDAFIDPQKQYADAVIEVLPTQLIPDDNEGKILRVRLIQKEGVKYFSPVYLFDEGSTISWIPCGRKLTCSYPGIKFFYGPDTYFGNEVSVVEMDGQFDRLDELIYVESHLSNLSSKFYGEVTQQMLKHADFPGSNNGTGLFQTIVGLKIRDLFEQIVASRAETPVGAAKA

SEQ ID NO: 9372 - protein, 399 aa, Euphorbia peplus
MSICSIYTPQSLNSTCSISKPKNTQLSFLHHKHVAVFYTTKRTSITCAANEQTIVIGLAADSGCGKSTFMRRLTSVFGGAAEPPKGGNPDSNTLISDTTTVICLDDYHSLDRTGRKEKGVTALDPRANDFDLMYEQVKAIKDGVAVQKPIYNHVTGLLDAPELIKPPKILVIEGLHPMYDERVRDLLDFSIYLDISNEVKFAWKIQRDMAERGHSLESIKASIEARKPDFDAFIDPQKQYADAVIEVLPTQLIPDDNEGKVLRVKLIMKEGVQYFSPVYLFDEGSTISWIPCGRKLTCSYPGIKFAYGPDAYFGNEVSVLEMDGQFDRLDELIYVESHLSNISTKFYGEVTQQMLKHSDFPGSNNGTGLFQTIVGLKIRDLFEQVVASRSAKTPAKANA

SEQ ID NO: 9373 - protein, 403 aa, Actinidia deliciosa
  misc_feature (194)..(194): Xaa can be any naturally occurring amino acid
MAICTFYTIQSLNSISTPTKTHLGFHQKQLLFYSTSKKNSRRESTTGTIKCSAENKTVVIGLAADSGCGKSTFMRRLTSVFGGAAEPPKGGNPDSNTLISDMTTVICLDDYHSLDRTGRKEKGVTALDPRANNFDLMYEQVKALKSGIAVEKPIYNHVSGLLDPPELTKPPKILVIEGLHPMYDERVRDLLDFXIYLDISNEVKFAWKIQRDMAERGHSLESIKASIEARKPDFDAYIDPQKQYADAVIEVLPTQLIPDDNEGKVLRVRLIMKEGVKYFNPVYLFDEGSTIGWIPCGRKLTCSYPGIKFSYSPDTYYGNEVSVLEMDGQFDRLDELIYVESHLSNISTKFYGEVTQQMLKHADFPGSNNGTGLFQTIVGLKIRDLYEQLIASKVGAPLEATRS

SEQ ID NO: 9374 - protein, 407 aa, Nicotiana benthamiana
MAVSTVYTAQSLNSTCSISTPSKSHLGFHQKQVIFYTKLRSNTRSSSTRVITCSSADDEKTVVIGLAADSGCGKSTFMRRLTSVFGGAAEPPKGGNPDSNTLISDMTTVICLDDYHSLDRTGRKEKGVTALDPRANDFDLMYEQVKAIKEGIAVEKPIYNHVSGLLDPPELIKPPKILVIEGLHPMYDERVRELLDFSIYLDISNEVKFAWKIQRDMAERGHSLESIKASIEARKPDFDAYIDPQKQYADAVIEVLPTQLIPDDNEGKVLRVRLIMKEGVKNFNPVYLFDEGSTISWIPCGRKLTCSYPGIKFTYGPDTYFGNEVTVLEMDGQFDRLDELIYVESHLSNLSSKFYGEVTQQMLKHADFPGSNNGTGFFQTIVGLKIRDLYEQIVASRAAAPVQAAKA

SEQ ID NO: 9375 - protein, 405 aa, Unknown
  Sequence found in Organisms: Solanum tuberosum, Solanum phureja
MAVCTVYTAQSLNSSCSISTPSKSHLGFHQKQVIFFTKRSTNKSRNTVITCSASDAEKTVVIGLAADSGCGKSTFMRRLTSVFGGAAEPPKGGNPDSNTLISDMTTVICLDDYHSLDRTGRKEKGVTALDPRANDFDLMYEQVKAIKDGVAVDKPIYNHVSGLLDPPEVIKPPKILVIEGLHPMYDERVRDLLDFSIYLDISNEVKFAWKIQRDMAERGHSLESIKASIEARKPDFDAYIDPQKQYADAVIEVLPTQLIPDDNEGKVLRVRLIMKEGVKNFNPVYLFDEGSTISWIPCGRKLTCSYPGIKFTYGPDTYFGNEVSVLEMDGQFDRLDELIYVESHLSNLSSKFYGEVTQQMLKHADFPGSNNGTGFFQTIVGLKIRDLYEQIVASRAGAPVTAAKA

SEQ ID NO: 9376 - protein, 268 aa, Flaveria ramosissima
MAACTVYTLQPLNSSCSISSPTKTHMGFTQKQVFFYSNGSKKTKSNRFRTGGEITCSGDTIVIGLAADSGCGKSTFMRRLTSVFGGAASPPKGGNPDSNTLISDTTTVICLDDYHSLDRTGRKEKGVTALDPRANDFDLMYEQVKALKDGVAVEKPIYNHVSGLLDPPELIKPPKILVIEGLHPMYDQRVRDLLDFSIYLDISNEVKFAWKIQRDMAERGHSLESIKASIEARKPDFDAYIDPQKQYADAVIEVLPTQLIPGDNEGRC

SEQ ID NO: 9377 - protein, 404 aa, Artemisia annua
MAVSTVYTVQSLNSTCSISTPTKTNLGIQQRQVLFFNVGRKTTRGRVRGGVIRCAGDTIVIGLAADSGCGKSTFMRRLTSVFGGAAEPPKGGNPDSNTLISDTTTVICLDDYHSLDRTGRKVEGVTALDPRANNFDLMYEQVKALKDGTAVQKPIYNHVSGLLDPPELIKPPKILVIEGLHPMYDERVRDLLDFSIYLDISDDVKFAWKIQRDMAERGHSLESIKASIEARKPDFDAYIDPQKQYADAVIEVLPTQLIPDDNEGKVLRVKLIMKEGVKYFSPVYLFDEGSTISWIPCGRKLTCSYPGIKFAYGPDSYYDNEVSVLEMDGQFDRLDELIYVESHLSNISTKFYGEITQQMLKHADFPGSNNGTGLFQTIVGLKIRDLFEQITASRASAPLEATKA

SEQ ID NO: 9378 - protein, 407 aa, Glycine max
MAACTVYSTQSLSTNCSISTPSKTQLSFFHQKQVVFWRNSNRGNSSSRRSYVITCAAGDSQTVVIGLAADSGCGKSTFMRRLTSVFGGAAEPPKGGNPDSNTLISDTTTVICLDDYHSLDRTGRKEKGVTALDPRANDFDLMYEQVKALKDGIAVEKPIYNHVTGLLDPPELIKPPKILVIEGLHPMYDSRVRDLLDFSIYLDISNEVKFAWKIQRDMAERGHSLESIKASIEARKPDFEAYIDPQKQYADAVIEVLPTQLIPDDNEGKILRVRLIQKEGVKYFSPVYLFDDGSTISWIPCGRKLTCSYPGIKFFYGPETYYGNEVSVVEMDGQFDRLDELIYVESHLSNLSTKFYGEVTQQMLKHADFPGSNNGTGLFQTIVGLKIRDLYEQLIATKAETPVAAKA

SEQ ID NO: 9379 - protein, 407 aa, Eucalyptus grandis
MAVSTVYTTQSFHSTCSISTPSKTHLGFNQKKQILFYNSGKKVTNRGIAAVPYVIRCSGDTLVIGLAADSGCGKSTFMRRLTSVFGGAAEPPKGGNPDSNTLISDTTTVICLDDYHSLDRTGRKEKGVTALDPRANDFDLMYEQVKAMKEGKAVDKPIYNHVTGLLDPPELIKPPKILVIEGLHPMFDQRVRDLLDFSIYLDISNEVKFAWKIQRDMAERGHSLESIKASIEARKPDFEAYIDPQKQYADAVIEVLPTQLIPGDNEGKILRVRLIMKEGVKYFNPVYLFDEGSTISWIPCGRKLTCSYPGIKFTYGPESYFGHEVSVLEMDGQFDRLDELIYVESHLSNLSTKFYGEVTQQMLKHSEFPGSNNGTGLFQTIVGLKIRDLYEQITASKAAAPLQATKA

SEQ ID NO: 9380 - protein, 391 aa, Flaveria ramosissima
MLNLITHKNPHGIHPKASLFYSNGGKKTKSNRYRTGGEITCSGDTIVIGLAADSGCGKSTFMRRLTSVFGGAASPPKGGNPDSNTLISDTTTVICLDDYHSLDRTGRKEKGVTALDPRANDFDLMYEQVKALKDGVAVEKPIYNHVSGLLDPPELIKPPKILVIEGLHPMYDQRVRDLLDFSIYLDISNEVKFAWKIQRDMAERGHSLESIKASIEARKPDFDAYIDPQKQYADAVIEVLPTQLIPDDNEGKVLRVKLIMKEGVKYFNPVYLFDEGSTVSWIPCGRKLTCSYPGIKFAYGPDTYFGHEVSVLEMDGQFDRLDELIYVESHLSNISTKFYGEITQQMLKHADFPGSNNGTGLFQTIVGLKIRDLFEQIAANKGSAPLEATKA

SEQ ID NO: 9381 - protein, 406 aa, Senecio madagascariensis
MAMSTVYTVQSLNSTCSISKNTKTKLGIQQKQVLFFNVGKKTNTYKGRISRVRCAAGGDTIVIGLAADSGCGKSTFMRRLTSVFGGAAEPPKGGNPDSNTLISDTTTVICLDDYHSLDRTGRKVEGVTALDPRANNFDLMYEQVKALKSGIAVEKPIYNHVSGLLDPPELIKPPKILVIEGLHPMYDERVRDLLDFSIYLDISNDVKFAWKIQRDMAERGHSLESIKASIEARKPDFDAYIDPQKQYADAVIEVLPTQLIPDDNEGKVLRVKLIMKEGVKYFSPVYLFDEGSTISWIPCGRKLTCSYPGIKFAYGPDSYYDHEVSVLEMDGMFDRLDELIYVESHLSNISTKFYGEITQQMLKHSDFPGSNNGTGLFQTIVGLKIRDLFEQITANRVSAPLEATKA

SEQ ID NO: 9382 - protein, 407 aa, Glycine max
MAACTVYSTQSLSTNCSISTPSKTQLSFFHQKQVVFWRNSNRGSSSSRRSYVITCAAGDSQTVVIGLAADSGCGKSTFMRRLTSVFGGAAEPPKGGNPDSNTLISDTTTVICLDDYHSLDRTGRKEKGVTALDPRANDFDLMYEQVKALKDGIAVEKPIYNHVTGLLDPPELIKPPKILVIEGLHPMYDSRVRDLLDFSIYLDISNEVKFAWKIQRDMAERGHSLESIKASIEARKPDFEAYIDPQKQYADAVIEVLPTQLIPDDNEGKILRVRLIQKEGVKYFSPVYLFDDGSTISWIPCGRKLTCSYPGIKFFYGPETYYGNEVSVVEMDGQFDRLDELIYVESHLSNLSTKFYGEVTQQMLKHADFPGSNNGTGLFQTIVGLKIRDLYEQLIATKAETPVAAKA

SEQ ID NO: 9383 - protein, 129 aa, Euonymus alatus
MAVCTVYTTQSLNSTCSISTLTKTNLGFHRKQVVFYSTSGKRSRGNNTTVITCSAGDSQTVVIGLAADSGCGKSTFMRRLTSVFGGAAEPPKGGNPDSNTLISDTTTVICLDDFHSLDRTGGKEGSDCT

SEQ ID NO: 9384 - protein, 402 aa, Epimedium sagittatum
MAICTLYTPNSLNSTFFTPSNQKHFLFSTTTTTTRRLNNSNTTTFSTISCSAEEKTIVIGLAADSGCGKSTFMRRLTSVFGGAAEPPKGGNPDSNTLISDTTTVICLDDYHSLDRYGRKKEGVTALDPKANNFDLMYDQVKALKDGVAVEKPIYNHVSGLLDPPELIKPPKILVIEGLHPMFDSRVRDLLDFSIYLDISNEVKFAWKIQRDMAERGHSLESIKASIEARKPDFDAYIDPQKQYADAVIEVLPTELIPDDNEGKVLRVRMIMKEGVKFFNPTYLFDEGSTISWIPCGRKLTCSYPGIKFSYGPDAYYSHEVSVLEMDGQFDRLDELIYVESHLSNISTKFYGEVTQQMLKHSDFPGSNNGTGLFQTIIGLKIRDLYEQLIASRAEVPLQATKA

SEQ ID NO: 9385 - protein, 411 aa, Arachis hypogaea
MATCTLYSTQCFNTISSTPSSKTHLGFHQRQVVFYTTTNNKRSSNKRSGNNNTGRYVITCAAGDTVVIGLAADSGCGKSTFMRRLTSVFGGAAEPPKGGNPDSNTLISDTTTVICLDDYHSLDRTGRKEKGVTALDPRANDFDLMYEQVKALKEGIAVEKPIYNHVTGLLDPPEVIKPPKILVIEGLHPMFDARVRDLLDFSIYLDISNEVKFAWKIQRDMAERGHSLESIKASIEARKPDFDAYIDPQKQYADAVIEVLPTQLIPDDNEGKILRVRLIQKEGIKHFSPVYLFDDGSTISWIPCGRKLTCSYPGIKFFYGPDTYFGNEVSVVEMDGQFDRLDELIYVESHLSNLSTKFYGEVTQQMLKHADFPGSNNGTGLFQTIVGLKIRDLYEQIITSKAETPVGAAKA

SEQ ID NO: 9386 - protein, 409 aa, Capsicum annuum
MAVCTVYTAQSLNSTCSISTPSKSHLRFHQKQVIFYTKRTNNKTRISTSNNIITCSAGGDEKTVVIGLAADSGCGKSTFMRRLTSVFGGAAEPPKGGNPDSNTLISDMTTVICLDDYHSLDRTGRKEKGVTALDPRANDFDLMYEQVKAIKEGVAVDKPIYNHVTGLLDPPELIKPPKILVIEGLHPMFDERVRELLDFSIYLDISNEVKFAWKIQRDMAERGHSLESIKASIEARKPDFDAYIDPQKQYADAVIEVLPTQLIPDDNEGKVLRVKLIMKEGVKNFNPVYLFDEGSTISWIPCGRKLTCSYPGIKFTYGPDTYFGNEVSVLEMDGQFDRLDELIYVESHLSNLSTKFYGEVTQQMLKHADFPGSNNGTGFFQTIVGLKIRDLYEQIVASRAGAPVTAAKA

SEQ ID NO: 9387 - protein, 405 aa, Zostera marina
MAVCTVYSPHSLKSTCPIPNTSRIQLGSHQKQVIFFTRRKGGNYRSNKLSGTITCEANTIVIGLAADSGCGKSTFMRRLTSVFGGAASPPKGGNPDSNTLISDTTTVICLDDYHSLDRYGRKEQGVTALDPKANNFDLMYEQVKALKQGIAVEKPIYNHVTGILDPPELIQPPKILVIEGLHPMYDSRVRDLLDFSIYLDISNEVKFAWKIQRDMAERGHSLESIKASIESRKPDFDAFIDPQKQYADAVIEVLPTQLIPDDNEGKVLRVKLVMKEGVKYFSPSYLFDEGSTIDWIPCGRKLTCSYPGIKFSYGPDSYYSNEVSVLEMDGQFDKLDELIYVESHLSNLSTKFYGEVTQQMLSLSNFPGSTNGTGLFQTIVGMKIRDLYEQIIAEKKGSSLQAAKM

SEQ ID NO: 9388 - protein, 407 aa, Antirrhinum majus
  misc_feature (218)..(218): Xaa can be any naturally occurring amino acid
MAVCTTFATVQSLNSTYSISTSPSKTHLVGFNTKNVLFYNTSKKTFTTTTRKISCSADEKPIVIGLAADSGCGKSTFMRRLTSVFGGAAEPPKGGNPDSNTLISDTTTVICLDDYHSLDRTGRKEKGVTALDPRANDFDLMYEQVKAIKDGVAVEKPIYNHVTGLLDPPELIKPPKIFVIEGLHPMYDARVRDLLDFSIYLDISNEVKFAWKIQRDMXERGHSLESIKASIEARKPDFDAYIDPQKQYADAVIEVLPTQLIPDDNEGKVLRVRLIMKEGVKYFNPVYLFDEGSTISWIPCGRKLTCSYPGIKFTYGPETYFGNEVSVLEMDGQFDRLDELIYVESHLSNISTKFYGEVTQQMLKHADFPGSNNGTGLFQTIVGLKIRDLFEQLTAGRAAAPLEATKA

SEQ ID NO: 9389 - protein, 402 aa, Arnica chamissonis
MAVSTVYTAQSLNSTCSISTPTKTHLGIQQRQVLFYSKKTNRGRVRGGEIRCSGGTIVIGLAADSGCGKSTFMRRLTSVFGGAGEPPKGGNPDSNTLISDTTTVICLDDYHSLDRTGRKVEGVTALDPRANNFDLMYEQVKALKDGVAVEKPIYNHVSGLLDPPELIKPPKILVIEGLHPMYDQRVRDLLDFSIYLDISNDVKFAWKIQRDMAERGHSLESIKASIEARKPDFDAYIDPQKQYADAVIEVLPTQLIPGDNEGKVLRVKLIMKEGVKYFSPVYLFDEGSTISWIPCGRKLTCSYPGIKFAYGPDSYYGHEVSVLEMDGQFDRLDELIYVESHLSNISTKFYGEITQQMLKHSDFPGSNNGTGLFQTIVGLKIRDLFEQITSTKASATLEATKA

SEQ ID NO: 9390 - protein, 397 aa, Fagopyrum esculentum
GSMHTIRSSTHNPFGFTNKHSAVVFYTNTKLRSIRRTNTTVITCSVGDSQTIVIGLAADSGCGKSTFMRRLTSVFGGAAEPPKGGNPDSNTLISDTTTVICLDDYHSLDRTGRKEKGVTALDPRANDFDLMYEQVKALKEGKAVDKPIYNHVTGLLDPPEVIQPPKILVIEGLHPMFDQRVRDLLDFSIYLDISNEVKFAWKIQRDMAERGHSLESIKASIEARKPDFDAFIDPQKQYADAVIEVLPTQLIPDDTEKKVLRVRLIMKEGAKYFSPVYLFDEGSTISWVPCGRKLTCSYPGIKFAYGPDTYFGNEVTILEMDGQFDRLDELIYVESHLSNLSTKFYGEVTQQMLKHADFPGSNNGTGFFQTIVGLKIRDLFEQIVASRQPTAAAAAKA

SEQ ID NO: 9391 - protein, 402 aa, Flaveria ramosissima
MAVCTVYTVQSLNSTCSISTPTKTHLGIQKRQVLFYSKKTNKGRVRSGEIRCSGDTIVIGLAADSGCGKSTFMRRLTSVFGGAAEPPKGGNPDSNTLISDTTTVICLDDYHSLDRTGRKVEGVTALDPRANNFDLMYEQVKALKDGVAVQKPIYNHVSGLLDPPELIKPPKILVIEGLHPMFDQRVRDLLDFSIYLDISNDVKFAWKIQRDMAERGHSLESIKASIEARKPDFDAYIDPQKQYADAVIEVLPTQLLPDDNEGKVLRVKLIMKEGVKYFSPVYLFDEGSTISWIPCGRKLTCSYPGIKFAYGPDTYYGHEVSVLEMDGQFDKLDELIYVESHLSNISTKFYGEITQQMLKHADFPGSNNGTGLFQTIVGLKIRDLFEQITASKASAQLEATKA

SEQ ID NO: 9392 - protein, 402 aa, Flaveria ramosissima
MAVSTVYTAQSLNSTCSISTPTKTHLGIQQRQVLFYTKKTNRGRVRGGEIRCSGDTIVIGLAADSGCGKSTFMRRLTSVFGGAAEPPKGGNPDSNTLISDTTTVICLDDYHSLDRTGRKVEGVTALDPRANNFDLMYEQVKALKDGIAVEKPIYNHVSGLLDPPETIKPPKILVIEGLHPMYDQRVRDLLDFSIYLDISNDVKFAWKIQRDMAERGHSLESIKASIEARKPDFDAYIDPQKQYADAVIEVLPTQLIPGDNEGKVLRVKLIMKEGVKYFSPVYLFDEGSTISWVPCGRKLTCSYPGIKFAYGPDTYYGHEVSVLEMDGQFDRLDELIYVESHLSNISTKFYGEITQQMLKHSDFPGSNNGTGLFQTIVGLKIRDLFEQITASKASATLEATKA

SEQ ID NO: 9393 - protein, 402 aa, Flaveria ramosissima
MAVCTVYTVQSLNSTCSISTPTKTYLGIQKRQVLFYSKKTNKGRVRSGEIRCSGDTIVIGLAADSGCGKSTFMRRLTSVFGGAAEPPKGGNPDSNTLISDTTTVICLDDYHSLDRTGRKVEGVTALDPRANNFDLMYEQVKALKDGVAVQKPIYNHVSGLLDPPELIKPPKILVIEGLHPMFDQRVRDLLDFSIYLDISNDVKFAWKIQRDMAERGHSLESIKASIEARKPDFDAYIDPQKQYADAVIEVLPTQLLPDDNEGKVLRVKLIMKEGVKYFSPVYLFDEGSTISWIPCGRKLTCSYPGIKFAYGPDTYYGHEVSVLEMDGQFDKLDELIYVESHLSNISTKFYGEITQQMLKHADFPGSNNGTGLFQTIVGLKIRDLFEQITASKASAQLEATKA

SEQ ID NO: 9394 - protein, 402 aa, Flaveria ramosissima
MAVSTVYTAKSLNSTCSISTPTKTHLGIQQRQVLFYTKKTNRGRVRGGEIRCAGDTIVIGLAADSGCGKSTFMRRLTSVFGGAAEPPKGGNPDSNTLISDTTTVICLDDYHSLDRTGRKVEGVTALDPRANNFDLMYEQVKALKDGIAVEKPIYNHVSGLLDPPETIKPPKILVIEGLHPMYDQRVRDLLDFSIYLDISNDVKFAWKIQRDMAERGHSLESIKASIEARKPDFDAYIDPQKQYADAVIEVLPTQLIPGDNEGKVLRVKLIMKEGVKYFSPVYLFDEGSTISWVPCGRKLTCSYPGIKFAYGPDTYYGHEVSVLEMDGQFDRLDELIYVESHLSNISTKFYGEITQQMLKHSDFPGSNNGTGLFQTIVGLKIRDLFEQITASKASATLEATKA

SEQ ID NO: 9395 - protein, 402 aa, Flaveria ramosissima
MAVSTVYTAQSLNSTCSISTPTKTHLGIQQRQVLFYSKKTNRGRVRGGEIRCSGDTIVIGLAADSGCGKSTFMRRLTSVFGGAAEPPKGGNPDSNTLISDTTTVICLDDYHSLDRTGRKVEGVTALDPRANNFDLMYEQVKALKDGIAVEKPIYNHVSGLLDPPETIKPPKILVIEGLHPMYDQRVRDLLDFSIYLDISNDVKFAWKIQRDMAERGHSLESIKASIEARKPDFDAYIDPQKQYADAVIEVLPTQLIPDDNEGKVLRVKLIMKEGVKYFSPVYLFDEGSTISWVPCGRKLTCSYPGIKFAYGPDTYYGHEVSVLEMDGQFDRLDELIYVESHLSNISTKFYGEITQQMLKHSDFPGSNNGTGLFQTIVGLKIRDLFEQITASKASSKLEATKA

SEQ ID NO: 9396 - protein, 393 aa, Ambrosia trifida
MAVSTVYTVQSLNSTCSISTPTKAHLGSHQRQVLFYSKRTNKGRVRGGEIRCAGDTIVIGLAADSGCGKSTFMRRLTSVFGGAAEPPKGGNPDSNTLISDTTTVICLDDYHSLDRTGRKVEGVTALDPRANNFDLMYEQVKALKDGIAVDKPIYNHVSGLLDPPELIKPPKILVIEGLHPMYDERVRDLLDFSIYLDISNDVKFAWKIQRDMAERGHSLESIKASIEARKPDFDAYIDPQKQYADAVIEVLPTQLIPDDNEGKVLRVKLIMKEGVKYFSPVYLFDEGSTISWIPCGRKLTCSFPGIKFAYGPDSYYGQEVSVLEMDGQFDKLDELIYVESHLSNISTKFYGEITQQMLKHADFPGSNNGTGLFQTIVGLKIRDLFEQITASKA

SEQ ID NO: 9397 - protein, 398 aa, Sesamum indicum
MAVSTVYTVQIQSLNSISTPSKSHLGFNQLLYSSGKKTRRATHISCSADNDKTVVIGLAADSGCGKSTFMRRLTSVFGGAAEPPKGGNPDSNTLISDMTTVICLDDYHSLDRNGRKEKGVTALDPKANDFDLMYEQVKAVKEGIAVDKPIYNHVTGLIDPPELIKPPKIFVIEGLHPMYDARVRELLDFSIYLDISPEVKFAWKIQRDMAERGHSLESIKASIEARKPDFDAYIDPQKQYADAVIEVLPTQLIPDDEGKVLRVRLIMKEGVKYFNPVYLFDEGSTISWVPCGRKLTCSYPGIKFAYGPETYFGHEVSVLEMDGQFDRLDELIYVESHLSNISTKFYGEVTQQMLKHADFPGSNNGTGLFQTIVGLKIRDLYEQIVASKVAAPLEATKA

SEQ ID NO: 9398 - protein, 405 aa, Zostera marina
MAVCTVYSPHSLKSTCPIPNTSRIQLGSHQKQVIFFTRRKGGNYRSNKLSGTITCEANTIVIGLAADSGCGKSTFMRRLTSVFGGAASPPKGGNPDSNTLISDTTTVICLDDYHSLDRYGRKEQGVTALDPKANNFDLMYEQVKALKQGIAVEKPIYNHVTGILDSPELIQPPKILVIEGLHPMYDSRVRDLLDFSIYLDISNEVKFAWKIQRDMAERGHSLESIKASIESRKPDFDAFIDPQKQYADAVIEVLPTQLIPDDNEGKVLRVKLVMKEGVKYFSPSYLFDEGSTIDWIPCGRKLTCSYPGIKFSYGPDSYYSNEVSVLEMDGQFDKLDELIYVESHLSNLSTKFYGEVTQQMLSLSNFPGSTNGTGLFQTIVGMKIRDLYEQIIAEKKGSSLQAAKM

SEQ ID NO: 9399 - protein, 405 aa, Zostera marina
MAVCTVYSPHSLKSTCPIPNTSRIQLGSHQKQVIFFTRRKGGNYRSNKLSGTITCEANTIVIGLAADSGCGKSTFMRRLTSVFGGAASPPKGGNPDSNTLISDTTTVICLDDYHSLDRYGRKEQGVTALDPKANNFDLMYEQVKALKQGIAVEKPIYNHVTGILDPPELIQPPKILVIEGLHPMYDSRVRNLLDFSIYLDISNEVKFAWKIQRDMAERGHSLESIKASIESRKPDFDAFIDPQKQYADAVIEVLPTQLIPDDNEGKVLRVKLVMKEGVKYFSPSYLFDEGSTIDWIPCGRKLTCSYPGIKFSYGPDSYYSNEVSVLEMDGQFDKLDELIYVESHLSNLSTKFYGEVTQQMLSLSNFPGSTNGTGLFQTIVGMKIRDLYEQIIAEKKGSSLQAAKM

SEQ ID NO: 9400 - protein, 436 aa, Ambrosia trifida
MAVCTVYTVQPLNTSCSISTHTKPHMGFNQKQVFFLTKSNNKNSKNNRFRGNKITCSGDTIVIGLAADSGCGKSTFMRRLTSVFGGAASPPKGGNPDSNTLISDTTTVICLDDYHSLDRTGRKEKGVTALDPRANDFDLMYEQVKAIKDGVAVEKPIYNHVSGLLDPPELIKPPKILVIEGLHPMYDQRVRDLLDFSIYLDISNEVKFAWKIQRDMAERGHSLESIKASIEARKPDFDAYIDPQKQYADAVIEVLPTQLIPDDNEGKVLRVKLIMKEGVKYFNPVYLFDEGSTVSWIPCGRKLTCSYPGIKFAYGPDAYFGHEVSVLEMDGQFDRLDELIYVESHLSNISTKFYGEITQQMLKHADFPGSNNGTGLFQTIVGLKIRDLFEQIAASKASAPLEANKSLIFNQEVTMSVVIPYACIQFPLCIPWTYVT

SEQ ID NO: 9401 - protein, 330 aa, Primula obconica
MRRLTSVFGGAAEPPKGGNPDSNTLISDTTTVICLDDYHSLDRTGRKVEKVTALHPKANDFDLMYEQVKAIKDGVAVDKPIYNHVSGLLDPPELIKPPKILVIEGLHPMYDERVRDLLDFSIYLDISNEVKFAWKIQRDMAERGHSLESIKASIEARKPDFDAYIDPQKQYADAVIEVLPTQLIPDDNEGKVLRVRLIMKEGVKFFNPVYLFDEGSTINWIPCGRKLTCSYPGIKFSYGPESYYGHEVSVVEMDGQFDRLDELIYVESHLSNISTKFYGEITQQMLKHSDFPGSSNGTGLFQTIVGLKIRDLYEQIIASRAAAPLEATKA

SEQ ID NO: 9402 - protein, 409 aa, Gossypium raimondii
MAVCSAYTTQSLNSTCSISTPAKTHLGFHQKQVVFYRRSSKRGGSGSSSGPCVITCSAGDSQTVVIGLAADSGCGKSTFMRRLTSVFGGAAEPPKGGNPDSNTLISDMTTVICLDDYHSLDRTGRKEKGVTALDPRANDFDLMYEQVKAIKSGVAVDKPIYNHVTGLLDPPELIKPPKILVIEGLHPMFDERVRDLLDFSIYLDISNEVKFAWKIQRDMAERGHSLESIKASIEARKPDFDAYIDPQKKYADAVIEVLPTQLIPDDNEGKVLRVRLIMKEGVKHFSPVYLFDEGSTISWIPCGRKLTCSYPGIKFHYGPDTYFGNEVSILEMDGQFDRLDELIYVESHLSNISTKFYGEVTQQMLKHADFPGSNNGTGLFQTIVGLKIRDLYEQITSSKTAAPLEATKA

SEQ ID NO: 9403 - protein, 378 aa, Flaveria ramosissima
MAVSTVYTAQSLNSTCSISTPTKTHLGIQQRQVLFYSKKTNRGRVRGGEIRCSGDTIVIGLAADSGCGKSTFMRRLTSVFGGAAEPPKGGNPDSNTLISDTTTVICLDDYHSLDRTGRKVEGVTALDPRANNFDLMYEQVKALKDGIAVEKPIYNHVSGLLDPPETIKPPKILVIEGLHPMYDQRVRDLLDFSIYLDISNDVKFAWKIQRDMAERGHSLESIKASIEARKPDFDAYIDPQKQYADAVIEVLPTQLIPDDNEGKVLRVKLIMKEGVKYFSPVYLFDEGSTISWVPCGRKLTCSYPGIKFAYGPDTYYGHEVSVLEMDGQFDRLDELIYVESHLSNISTKFYGEITQQMLKHSDFPGSNNGTGLFQPLLV

SEQ ID NO: 9404 - protein, 412 aa, Castanea mollissima
MAICTVYTTPSLNSTCSISTTSKTQLGFHQKQVVFYSSGKKTSKRGSNTTSPYVITCSTTVGDSKTVVIGLAADSGCGKSTFMRRLTSVFGGAAEPPKGGNPDSNTLISDTTTVICLDDYHSLDRTGRKQKGVTALDPRANDFDLMYEQVKAIKDGIPVEKPIYNHVTGLLDPPELIKPPKILVIEGLHPMFDSRVRDLLDFSIYLDISNEVKFAWKIQRDMAERGHSLESIKASIEARKPDFDAYIDPQKQYADAVIEVLPTQLIPDDNEGKILRVRLIMKEGVEFFNPVYLFDEGSTVSWIPCGRKLTCSYPGIKFYYGPDTYFGHEVSVLEMDGQFDRLDELIYVESHLSNISTKFYGEVTQQMLKHADFPGSSNGTGLFQTIVGLKIRDLYEQLISTKAKTPVEATKA

SEQ ID NO: 9405 - protein, 376 aa, Flaveria ramosissima
SKSFLTPMVVKELKAKRYRTGGEITCSGDTIVIGLAADSGCGKSTFMRRLTSVFGGAASPPKGGNPDSNTLISDTTTVICLDDYHSLDRTGRKEKGVTALDPRANDFDLMYEQVKALKDGVAVEKPIYNHVSGLLDPPELIKPPKILVIEGLHPMYDQRVRDLLDFSIYLDISNEVKFAWKIQRDMAERGHSLESIKASIEARKPDFDAYIDPQKQYADAVIEVLPTQLIPDDNEGKVLRVKLIMKEGVKYFNPVYLFDEGSTVSWIPCGRKLTCSYPGIKFAYGPDTYFGHEVSVLEMDGQFDRLDELIYVESHLSNISTKFYGEITQQMLKHADFPGSNNGTGLFQTIVGLKIRDLFEQIAANKGSAPLEATKA

SEQ ID NO: 9406 - protein, 380 aa, Flaveria ramosissima
MFNLNTNKTHLGIQQRQVLFYSKKTNRGRVRGGEIRCSGDTIVIGLAADSGCGKSTFMRRLTSVFGGAAEPPKGGNPDSNTLISDTTTVICLDDYHSLDRTGRKVEGVTALDPRANNFDLMYEQVKALKDGIAVEKPIYNHVTGLLDPPELIKPPKILVIEGLHPMFDQRVRDLLDFSIYLDISNDVKFAWKIQRDMAERGHSLESIKASIEARKPDFDAYIDPQKQYADAVIEVLPTQLIPDDNEGKVLRVKLIMKEGVKYFSPVYLFDEGSTISWIPCGRKLTCSYPGIKFAYGPDTYYGHEVSVLEMDGQFDKLDELIYVESHLSNISTKFYGEITQQMLKHADFPGSNNGTGLFQTIVGLKIRDLFEQITASKASA

SEQ ID NO: 9407 - protein, 397 aa, Mesembryanthemum crystallinum
MAVSAYTVPTTSHLGFNQKKQLFFCNKSAYKRVSFSSRPCVITCLAGDSQTIVIGLAADSGCGKSTFMRRLTSVFGGAAEPPRGGNPDSNTLISDTTTVICLDDYHSLDRTGRKEKGVTALDPRANDFDLMYEQVKALKEGKAVEKPIYNHVTGLLDAPELIKPPKILVIEGLHPMFDSRVRDLLDFSIYLDISNEVKFAWKIQRDMAERGHSLESIKASIEARKPDFDAYIDPQKQYADAVIEVLPTQLIPGDNEGKVLRVRLIQKEGVQYFSPVYLFDEGSSITWIPCGRKLTCSYPGIKFFYGPDTYFGNEVTVLEMDGQFDRLDELIYVESHLSNLSTKFYGEVTQQMLKHQDFPGSNNGTGLFQTIVGLKIRDLFEQLIASKTAAPAAATKA

SEQ ID NO: 9408 - protein, 412 aa, Tripterygium wilfordii
RERERENGSLHSLHNPISQLNMLNLHTNKTTWFHQTVVFYSTSGKRSSKRGGSTTTVITCSVGDSQTVVIGLAADSGCGKSTFMRRLTSVFGGAVEPPRGGNPGSNTLISDTTTVICLDDYHSLDRTGRKEKGVTALDPRANNFDLMYEQVKAIKDGIAVEKPIYNHVTGLLDPPELIKPPKIFVIEGLHPLYDERVRDLLDFSIYLDISNEVKFAWKIQRDMAERGHSLESIKASIEARKPDFDAYIDPQKQYADAVIEVLPTLLIPDDNEGKVLRVRLIMKEGVKYFNPVYLFDEGSTISWIPCGRKLTCSYPGIKFSYGPDTYFGHEVSVMEMDGQFDRLDELIYVESHLSSISTKFYGEVTQQMLKHADFPGSNNGTGLFQTIIGLKIRELYEQLVTSKVRAPVEAKA

SEQ ID NO: 9409 - protein, 404 aa, Hordeum vulgare
MAFCSPHTTTSLRSPCTTIPNSGFRQNQVILFTTRSSRRSTTRHGARTFQVSCAVEKPIVIGLAADSGCGKSTFMRRLTSVFGGAAEPPKGGNPDSNTLISDTTTVICLDDYHSLDRTGRKEKGVTALDPKANDFDLMYEQVKAIKEGKAIEKPIYNHVTGLLDPAELIQPPKIFVIEGLHPMYDERVRDLLDFSIYLDISNEVKFAWKIQRDMAERGHSLESIKASIEARKPDFDAFIDPQKQYADAVIEVLPTQLIPDDNEGKVLRVKLIMKEGVKFFNPVYLFDEGSTINWIPCGRKLTCSYPGIKFSYGPDTYFGQEVSVLEMDGQFDRLDELIYVESHLSNLSTKFYGEVTQQMLKHADFPGSNNGTGLFQTIVGLKIRDLYEQIIAERAGVPAEAAKV

SEQ ID NO: 9410 - protein, 409 aa, Phaseolus vulgaris
MAACTVYSTQSLSTNCSISTPSKTQFSFHQKQVVFYTTGRRNSKRGSNSGRSYVITCAASDQQTVVIGLAADSGCGKSTFMRRLTSVFGGAAEPPKGGNPDSNTLISDTTTVICLDDYHSLDRTGRKEKGVTALDPRANDFDLMYEQVKAIKDGISVEKPIYNHVTGLLDPPELIKPPKILVIEGLHPMFDSRVRDLLDFSIYLDISNEVKFAWKIQRDMAERGHSLESIKASIEARKPDFEAYIDPQKQYADAVIEVLPTQLIPDDNEGKILRVRLIQKEGVKNFSPVYLFDDGSTISWIPCGRKLTCSYPGIKFSYGPDTYYGNEVSIVEMDGQFDRLDELIYVESHLSNLSTKFYGEVTQQMLKHADFPGSNNGTGLFQTIVGLKIRDLYEQIIASRAETPVAAKA

SEQ ID NO: 9411 - protein, 409 aa, Vigna unguiculata
MAACTVYSTQSLSTNCSISTPSKTQLSFHQKQVVFYTTSRRNSKRGSNSGRSYVITCAASDQQTVVIGLAADSGCGKSTFMRRLTSVFGGAAEPPKGGNPDSNTLISDTTTVICLDDYHSLDRTGRKEKGVTALDPRANDFDLMYEQVKAIKDGIAVQKPIYNHVTGLLDPPELIKPPKILVIEGLHPMFDSRVRDLLDFSIYLDISNEVKFAWKIQRDMAERGHSLESIKASIEARKPDFEAYIDPQKQYADAVIEVLPTQLIPDDNEGKILRVRLIQKEGVNFFSPVYLFDEGSTISWIPCGRKLTCSYPGIKFSYGPDTYYGNEVSVVEMDGQFDRLDELIYVESHLSNLSTKFYGEVTQQMLKHADFPGSNNGTGLFQTIVGLKIRDLYEQIVATRAETAVAAKA

SEQ ID NO: 9412 - protein, 409 aa, Gossypium raimondii
MAVCSAYTTQSLNSTCSISTPAKTHLGFHQKQVVFYRRSSKRGGSGSSSGPCVITCSAGDSQTVVIGLAADSGCGKSTFMRRLTSVFGGAAEPPKGGNPDSNTLISDMTTVICLDDYHSLDRTGRKEKGVTALDPRANDFDLMYEQVKAIKSGVAVDKPIYNHVTGLLDPPELIKPPKILVIEGLHPMFDERVRDLLDFSIYLDISNEVKFAWKIQRDMAERGHSLESIRASIEARKPDFDAYIDPQKKYADAVIEVLPTQLIPDDNEGKVLRVRLIMKEGVKHFSPVYLFDEGSTISWIPCGRKLTCSYPGIKFHYGPDTYFGNEVSILEMDGQFDRLDELIYVESHLSNISTKFYGEVTQQMLKHADFPGSNNGTGLFQTIVGLKIRDLYEQITSSKTAAPLEATKA

SEQ ID NO: 9413 - protein, 407 aa, Lotus japonicus
MAAFTVYSTQSLRSNCSIATPSKSHVGFHQKQQLVFYKRGSDSTSTSRRYVITCAGGDQQTIVIGLAADSGCGKSTFMRRLTSVFGGAAEPPKGGNPDSNTLISDTTTVICLDDYHSLDRTGRKEKGVTALDPKANDFDLMYEQVKAIKEGISVQKPIYNHVTGLLDPPELIKPPKILVIEGLHPMYDPRVRELLDFSIYLDISNEVKFAWKIQRDMAERGHSLESIKASIEARKPDFDAYIDPQKQYADAVIEVLPTQLIPDDNEGKILRVRLIQKEGVKYFSPVYLFDDGSTISWIPCGRKLTCSYPGIKFFYGPDTYYGSEVSVVEMDGQFDRLDELIYVESHLSNLSSKFYGEVTQQMLKHADFPGSNNGTGLFQTIVGLKIRDLYEQILASRAETPVGAAKA

SEQ ID NO: 9414 - protein, 405 aa, Populus trichocarpa
MAVCTVYTTQSLNSTCSISTPTKTHLGFNQKHVVFYSTNKKTTKRASSAVITCSADTQTVVIGLAADSGCGKSTFMRRLTSVFGGAAEPPRGGNPDSNTLISDTTTVICLDDYHSLDRTGRKEKGVTALDPRANNFDLMYEQVKAIKDGTAVEKPIYNHVTGLLDPPELIKPPKILVIEGLHPMYDQRVRDLLDFSIYLDISNEVKFAWKIQRDMAERGHSLESIKASIEARKPDFDAYIDPQKQYADAVIEVLPTQLIPDDNEGKVLRVKLIMKEGVEFFSPVYLFDEGSSISWIPCGRKLTCSYPGIKFSYGPDAYYGHEVSVLEMDGQFDRLDELIYVESHLSNISTKFYGEVTQQMLKHADFPGSNNGTGLFQTIVGLKIRDLFEQIVASRAKTPVEATKA

SEQ ID NO: 9415 - protein, 357 aa, Papaver somniferum
SYFSCSAGDSKTIVIGLAADSGCGKSTFMRRLTSVFGGAAEPPRGGNPDSNTLISDTTTVICLDDYHSLDRTGRKEKGVTALDPRANDFDLMYEQVKALKNGIAVEKPIYNHVSGLLDPPELIQPPKILVIEGLHPMYDSRVRDLLDFSIYLDISNEVKFAWKIQRDMAERGHSLESIKASIEARKPDFDAYIDPQKQYADAVIEVLPTTLIPDDNEGKVLRVRLIMKEGVKYFSPVYLFDEGSTISWIPCGRKLTCSYPGIKFNYGPDSYFDNEVSVLEMDGQFDRLDELIYVESHLSNISTKFYGEVTQQMLKHADFPGSNNGTGLFQTMVGLKIRDLYEQILASKVGALEASKA

SEQ ID NO: 9416 - protein, 404 aa, Triticum aestivum
MAFCSPHSTTSLRSPCTTIPNSGFRQNQVILFTTRSSRRSNTRHGARTFQVSCAVEQPIVIGLAADSGCGKSTFMRRLTSVFGGAAEPPKGGNPDSNTLISDTTTVICLDDYHSLDRTGRKEKGVTALDPKANDFDLMYEQVKAIKEGKAIEKPIYNHVTGLLDPAELIQPPKIFVIEGLHPMYDERVRELLDFSIYLDISNEVKFAWKIQRDMAERGHSLESIKASIEARKPDFDAFIDPQKQYADAVIEVLPTQLIPDDNEGKVLRVKLIMKEGIKFFNPVYLFDEGSTINWIPCGRKLTCSYPGIKFSYGPDTYFGQEVSVLEMDGQFDRLDELIYVESHLSNLSTKFYGEVTQQMLKHADFPGSNNGTGLFQTIVGLKIRDLYEQIIAERAGVPAEAAKV

SEQ ID NO: 9417 - protein, 408 aa, Amsonia hubrichtii
MAVCTVYTVQSLNSTCSISTPTKSHLGFTQKHQVFFYSTSKKSINTSRRSCSEISCSAEDKTVVIGLAADSGCGKSTFMRRLTSVFGGAAEPPKGGNPDSNTLISDMTTVICLDDYHSLDRTGRKEKGVTALDPRANDFDLMYEQVKALKSGVPVEKPIYNHVTGLLDPPELTKPPKILVIEGLHPMFDERVRDLLDFSIYLDISNEVKFAWKIQRDMAERGHSLESIKASIEARKPDFEAFIDPQKQFADAVIEVLPTQLIPDDNGGKILRVRLIMKEGVKYFDPVYLFDEGSTISWIPCGRKLTCSYPGIKFSYGPDTYYGHEVSVLEMDGQFDRLDELIYVESHLSNLSSKFYGEVTQQMLKHAEFPGSNNGTGLFQTIVGLKIRDLYEQIVSTQVSTPLQAAKA

SEQ ID NO: 9418 - protein, 400 aa, Fagopyrum esculentum
AACTLYAALPTTHLGFTNKHSTVVFYTNTNNNKLRSIRRTNTTVITCSVGDSQTIVIGLAADSGCGKSTFMRRLTSVFGGAAEPPKGGNPDSNTLISDTTTVICLDDYHSLDRTGRKEKGVTALDPRANDFDLMYEQVKALKEGKAVDKPIYNHVSGLLDPPEVIKPSKILVIEGLHPMFDQRVRDLLDFSIYLDISNEVKFAWKIQRDMAERGHSLESIKASIEARKPDFDAFIDPQKQYADAVIEVLPTQLIPDDTEKKVLRVRLIMKEGAKYFSPVYLFDEGSTISWVPCGRKLTCSYPGIKFAYGPDTYFGNEVTILEMDGQFDRLDELIYVESHLSNLSTKFYGEVTQQMLKHADFPGSNNGTGFFQTIVGLKIRDLFEQIVASREPTPAAAAKA

SEQ ID NO: 9419 - protein, 412 aa, Quercus alba
MAICTVYTTPSLNSTCSISTTSKTQLGFHQKQVVFYSSGKKTSKRGSNTTSPYVITCTTSAGDSKTVVIGLAADSGCGKSTFMRRLTSVFGGAAEPPKGGNPDSNTLISDTTTVICLDDYHSLDRTGRKQKGVTALDPRANDFDLMYEQVKALKDGIPVDKPIYNHVSGLLDPPELIKPPKILVIEGLHPMFDSRVRDLLDFSIYLDISNEVKFAWKIQRDMAERGHSLESIKASIEARKPDFDAYIDPQKQYADAVIEVLPTQLIPDDNEGKILRVRLIMKEGVEFFNPVYLFDEGSTISWIPCGRKLTCSYPGIKFFYGPDTYFGHEVSVLEMDGQFDRLDELIYVESHLSNISTKFYGEVTQQMLKHADFPGSSNGTGLFQTIVGLKIRDLYEQLISTTAKTPVEATKA

SEQ ID NO: 9420 - protein, 408 aa, Fragaria vesca
MAICAVHTSTQFNPTCSSISTPSKSHLGFCQRQQVVFYTKRTSKRSSTPYVGLIACAAGGQETVVIGLAADSGCGKSTFMRRLTSVFGGAAEPPKGGNPDSNTLISDTTTVICLDDYHSLDRTGRKEKGVTALDPRANDFDLMYEQVKAIKDGKAVEKPIYNHVSGLLDPPELIKPPKILVIEGLHPMYDQRVRDLLDFSIYLDISNEVKFAWKIQRDMAERGHSLESIKASIEARKPDFDAYIDPQKQYADAVIEVLPTQLIPGDNEGKVLRVRLIMKEGVKFFNPVYLFDEGSTISWIPCGRKLTCSYPGIKFTYGPDTYYGQEVSVLEMDGQFDRLDELIYVESHLSNISTKFYGEVTQQMLKHSDFPGSSNGTGLFQTIVGLKIRDLYEQLIASKAKSPVEAKA

SEQ ID NO: 9421 - protein, 300 aa, Flaveria ramosissima
MAVCTVYTLQPLNSSCSISSPTKTHMGFTQKQVFFYSNGGKKTKSNKYRTGGEITCSGDTIVIGLAADSGCGKSTFMRRLTSVFGGAASPPKGGNPDSNTLISDTTTVICLDDYHSLDRTGRKEKGVTALDPRANDFDLMYEQVKALKDGVAVDKPIYNHVSGLLDPPELIKPPKILVIEGLHPMYDQRVRDLLDFSIYLDISNEVKFAWKIQRDMAERGHSLESIKASIEARKPDFDAYIDPQKQYADAVIEVLPTQLIPDDNEGKVLRVKLIMKEGVKYFNPVYLFDEGSTVSWIPCG

SEQ ID NO: 9422 - protein, 194 aa, Zostera marina
MRRLTSDLVEQHHSQGGNPDSNTLISDTTTVICLDDYHSLDRYGRKEQGVTALDPKANNFDLMYEQVKALKQGIAVEKPIYNHVTGILDPPELIQPPKILVIEGLHPMYDSRVRDLLDFSIYLDISNEVKFAWKIQRDMAERGHSLESIKASIESRKPDFDAFIDPQKQYADAVIEVLPTQLIPDDNEGEGVES

SEQ ID NO: 9423 - protein, 399 aa, Ambrosia trifida
TVQPLNTSCSISSHTKPHMGFNQKQVFFLTKSNNKTTKNSSFRGSKITCSGDTIVIGLAADSGCGKSTFMRRLTSVFGGAASPPKGGNPDSNTLISDTTTVICLDDYHSLDRTGRKEKGVTALDPRANDFDLMYEQVKAIKDGVAVEKPIYNHVSGLLDPPELIKPPKILVIEGLHPMYDQRVRDLLDFSIYLDISNEVKFAWKIQRDMAERGHSLESIKASIEARKPDFDAYIDPQKQYADAVIEVLPTQLIPDDNEGKVLRVKLIMKEGVKYFNPVYLFDEGSTVSWIPCGRKLTCSFPGIKFAYGPDTYFGHEVSVLEMDGQFDRLDELIYVESHLSNISTKFYGEITQQMLKHADFPGSNNGTGLFQTIVGLKIRDLFEQMVASKASAPLEATKA

SEQ ID NO: 9424 - protein, 405 aa, Euonymus alatus
QSAQFTQPNLSTQHAQYPHQQKPTWVSPKQVVFYTTSGRRSSKRSRTTTLITCSAGDSQTVVIGLAADSGCGKSTFMRRLTSVFGGAAEPPKGGNPDSNTLISDTTTVICLDDYHSLDRTGRKEKGVTALDPRANDFDLMYEQVKAIKDGFAVEKPIYNHVSGLLDPPELIKPPKILVIEGLHPMYDQRVRDLLDFSIYLDISNEVKFAWKIQRDMAERGHSLESIKASIEARKPDFDAYIDPQKQYADAVIEVLPTQLIPDDNEGKTLRVKLIMKEGVKYFNPVYLFDEGSTISWIPCGRKLTCSYPGIQFAYGPDAYFDHEVSVLEMDGQFDRLDELIYVESHLSNISTKFYGEVTQQLLKHADFPGSNNGTGLFQTIVGLKIRDLYEQLVASRAGAPVKART

SEQ ID NO: 9425 - protein, 398 aa, Flaveria ramosissima
MAVSTVYTAQSLNSTCSISTPTKTHLGIQQRQVLFYTKKTNRGRVRGGEIRCSGDTIVIGLAADSGCGKSTFMRRLTSVFGGAAEPPKGGNPDSNTLISDTTTVICLDDYHSLDRTGRKVEGVTALDPRANNFDLMYEQVKALKDGIAVEKPIYNHVSGLLDPPETIKPPKILVIEGLHPMYDQRVRDLLDFSIYLDISNDVKFAWKIQRDMAERGHSLESIKASIEARKPDFDAYIDPQKQYADAVIEVLPTQLIPGDNEGKVLRVKLIMKEGVKYFSPVYLFDEGSTISWVPCGRKLTCSYPGIKFAYGPDTYYGHEVSVLEMDGQFDRLDELIYVESHLSNISTKFYGEITQQMLKHSDFPGSNNGTGLFQTIVGLKIRDLFEQITASKASATLE

SEQ ID NO: 9426 - protein, 409 aa, Elaeis guineensis
MALCTVSTTPSLHSPFCVSNPTKTCFGFSQRQQVIFYTSGRRSSRRGGKNNSEVFYCCAEAKTVVIGLAADSGCGKSTFMRRLTSVFGGAAEPPKGGNPDSNTLISDTTTVICLDDYHSLDRTGRKEKGVTALDPRANNFDLMYEQVKAIKEGVAVEKPIYNHVTGLLDPPELIQPPKILVIEGLHPMYDPRVRDLLDFSIYLDISNEVKFAWKIQRDMAERGHSLESIKASIEARKPDFDAYIDPQKQYADAVIEVLPTQLIPDDNEGKVLRVRLIMKEGLKHFSPVYLFDEGSTISWIPCGRKLTCSYPGIKFFYGPDTYFSHEVSVLEMDGQFDKLDELIYVESHLSNISTKFYGEVTQQMLKHADFPGSNNGTGLFQTIIGLKIRDLYEQIIAERAAAPAEAAKV

SEQ ID NO: 9427 - protein, 382 aa, Flaveria ramosissima
MAVCTVYTLQPLNSSCSISSPTKTHMGFTQKQVFFYSNGSKKTKSKRYRTGGEITCSGDTIVIGLAADSGCGKSTFMRRLTSVFGGAASPPKGGNPDSNTLISDTTTVICLDDYHSLDRTGRKEKGVTALDPRANDFDLMYEQVKALKDGVAVEKPIYNHVSGLLDPPELIKPPKILVIEGLHPMYDQRVRDLLDFSIYLDISNEVKFAWKIQRDMAERGHSLESIKASIEARKPDFDAYIDSQKQYADAVIEVLPTQLIPDDNEGKVLRVKLIMKEGVKYFNPVYLFDEGSTVSWIPCGRKLTCSYPGIKFAYGPDTYFGHEVSVLEMDGQFDRLDELIYVESHLSNISTKFYGEITQQMLKHADFPGSNNGTGLFQTIFG

SEQ ID NO: 9428 - protein, 404 aa, Festuca arundinacea
MAFCSPHTTTSLHSPRTTIPNSGFRQNQVILFTTRSSRRSNTRNGARTFQVSCAVDKPIVIGLAADSGCGKSTFMRRLTSVFGGAAEPPTGGNPDSNTLISDTTTVICLDDYHSLDRTGRKEKGVTALDPKANDFDLMYEQVKAIKEGQAIEKPIYNHVTGLLDPPELIQPPKIFVIEGLHPMYDERVRDLLDFSIYLDISNEVKFAWKIQRDMAERGHSLESIKASIEARKPDFDAFIDPQKQYADAVIEVLPTQLIPDDNEGKVLRVKLIMKEGVKFFNPVYLFDEGSTINWIPCGRKLTCSYPGIKFSYGPDTYFGQEVSVLEMDGQFDRLDELIYVESHLSNLSSKFYGEVTQQMLKHADFPGSNNGTGLFQTIVGLKIRDLYEQIIAERVGAPAQAAKV

SEQ ID NO: 9429 - protein, 408 aa, Cirsium arvense
MAVSTVYTVQALNSSCSISTPTKTHLGIQQKRQVLFYSNATGKKTNKGRVRGGGVIRCAGDTIVIGLAADSGCGKSTFMRRLTSVFGGAAEPPKGGNPDSNTLISDTTTVICLDDYHSLDRTGRKVEGVTALDPRANNFDLMYEQVKALKDGIAVDKPIYNHVSGLLDPPELIKPPKILVIEGLHPMYDQRVRDLLDFSIYLDISNDVKFAWKIQRDMAERGHSLESIKASIEARKPDFDAYIDPQKQYADAVIEVLPTQLIPGDNEGKVLRVKLIMKEGVKYFSPVYLFDEGSSISWIPCGRKLTCSYPGIKFAYGPDSYFGNEVSVLEMDGQFDRLDELIYVESHLSNISTKFYGEITQQMLKLSDFPGSNNGTGLFQTIVGLKIRDLFEQITATKASATVEATRA

SEQ ID NO: 9430 - protein, 407 aa, Unknown
  Sequence found in Organisms: Citrus clementina, Citrus sinensis
MAISLNSPCSLYSPTKTHLGFFNNQRQLAVFYNKRSSSSSSSSSSKQRGCLVITCSAGDSQTIVIGLAADSGCGKSTFMRRLTSVFGGAAEPPKGGNPDSNTLISETTTVICLDDYHSLDRTGRKEKGVTALDPRANNFDLMYEQVKAMKDGVSVEKPIYNHVTGLLDPPELIKPPKILVIEGLHPMYDARVRELLDFSIYLDISNEVKFAWKIQRDMTERGHSLESIKASIEARKPDFDAYIDPQKQYADAVIEVLPTQLIPDDNEGKVLRVRLIMKEGVKYFSPVYLFDEGSTIEWIPCGRKLTCSYPGIKFSYGPDAYFGHEVSILEMDGKFDRLDELIYVESHLSNLSTKFYGEVTQQMLKHADFPGSNNGTGLFQTIVGLKIRDLYEQIITSKAAAPVEAKA

SEQ ID NO: 9431 - protein, 409 aa, Gossypium hirsutum
MAVCSAYTTQSLHSTCSISTPAKTHLGFHQKQVVFYRRSSKRGGSGSSSGPCVITCSAGDSQTVVIGLAADSGCGKSTFMRRLTSVFGGAAEPPKGGNPDSNTLISDMTTVICLDDYHSLDRTGRKEKGVTALDPRANDFDLMYEQVKAIKSGVAVDKPIYNHVTGLLDPPELIKPPKILVIEGLHPMFDERVRDLLDFSIYLDISNEVKFAWKIQRDMAERGHSLESIRASIEARKPDFDAYIDPQKKYADAVIEVLPTQLIPDDNEGKVLRVRLIMKEGVKHFSPVYLFDEGSTISWIPCGRKLTCSYPGIKFHYGPDTYFGNEVSILEMDGQFDRLDELIYVESHLSNISTKFYGEVTQQMLKHADFPGSNNGTGLFQTIVGLKIRDLYEQITSSKTAAPLEATKA

SEQ ID NO: 9432 - protein, 404 aa, Primula obconica
MAISTACSTHYSLNSTYSISTPTKTHLGSTQTSTFYTTTKKNTTKHTNTTTISCSQKTVVIGLAADSGCGKSTFMRRLTSVFGGAAEPPKGGNPDSNTLISDTTTVICLDDYHSLDRTGRKVEKVTALHPKANDFDLMYEQVKAIKDGVAVDKPIYNHVSGLLDPPELIKPPKILVIEGLHPMYDERVRDLLDFSIYLDISNEVKFAWKIQRDMAERGHSLESIKASIEARKPDFDAYIDPQKQYADAVIEVLPTQLIPDDNEGKVLRVRLIMKEGVKFFNPVYLFDEGSTINWIPCGRKLTCSYPGIKFSYGPESYYGHEVSVVEMDGQFDRLDELIYVESHLSNISTKFYGEITQQMLKHSDFPGSSNGTGLFQTIVGLKIRDLYEQIIASRAAAPLEATKA

SEQ ID NO: 9433 - protein, 404 aa, Triticum aestivum
MAFCSPHTTTSLRSPCTTIPNSGFRQNQVIFFTTRSSRRSNTRHGARTFQVSCAVEQPIVIGLAADSGCGKSTFMRRLTSVFGGAAEPPKGGNPDSNTLISDTTTVICLDDYHSLDRTGRKEKGVTALDPKANDFDLMYEQVKAIKEGKAIEKPIYNHVTGLLDPAELIQPPKIFVIEGLHPMYDERVRELLDFSIYLDISNEVKFAWKIQRDMAERGHSLESIKASIEARKPDFDAFIDPQKQYADAVIEVLPTQLIPDDNEGKVLRVKLIMKEGIKFFNPVYLFDEGSTINWIPCGRKLTCSYPGIKFSYGPDTYFGQEVSVLEMDGQFDRLDELIYVESHLSNLSTKFYGEVTQQMLKHADFPGSNNGTGLFQTIVGLKIRDLYEQIIAERAGVPAEAAKV

SEQ ID NO: 9434 - protein, 404 aa, Triticum aestivum
MAFCSPHTTASLRSPCTTIPNSGFRQNQVILFTTRSSRRSNTRHGARTFQVSCAVEQPIVIGLAADSGCGKSTFMRRLTSVFGGAAEPPKGGNPDSNTLISDTTTVICLDDYHSLDRTGRKEKGVTALDPKANDFDLMYEQVKAIKEGKAIEKPIYNHVTGLLDPAELIQPPKIFVIEGLHPMYDERVRELLDFSIYLDISNEVKFAWKIQRDMAERGHSLESIKASIEARKPDFDAFIDPQKQYADAVIEVLPTQLIPDDNEGKVLRVKLIMKEGIKFFNPVYLFDEGSTINWIPCGRKLTCSYPGIKFSYGPDTYFGQEVSVLEMDGQFDRLDELIYVESHLSNLSTKFYGEVTQQMLKHADFPGSNNGTGLFQTIVGLKIRDLYEQIIAERAGVPAEAAKV

SEQ ID NO: 9435 - protein, 404 aa, Triticum aestivum
MAFCSPHTTTSLRSPCTTIPNSGFRQNQVILFTTRSSRRSNTRHGARTFQVSCAVEQPIVIGLAADSGCGKSTFMRRLTSVFGGAAEPPKGGNPDSNTLISDTTTVICLDDYHSLDRTGRKEKGVTALDPKANDFDLMYEQVKAIKEGKAIEKPIYNHVTGLLDPAELIQPPKIFVIEGLHPMYDERVRELLDFSIYLDISNEVKFAWKIQRDMAERGHSLESIKASIEARKPDFDAFIDPQKQYADAVIEVLPTQLIPDDNEGKVLRVKLIMKEGIKFFNPVYLFDEGSTINWIPCGRKLTCSYPGIKFSYGPDTYFGQEVSVLEMDGQFDRLDELIYVESHLSNLSTKFYGEVTQQMLKHADFPGSNNGTGLFQTIVGLKIRDLYEQIIAERAGVPAEAAKV

SEQ ID NO: 9436 - protein, 411 aa, Unknown
  Sequence found in Organisms: Theobroma cacao, Pteridium aquilinum
MAVCTVYTTQSLNSTCSISTPTKTHLGFHQKQVVFYSTGKRTSKRGSSSSGGPCVITCSAVDSQTVVIGLAADSGCGKSTFMRRLTSVFGGAAEPPRGGNPDSNTLISDMTTVICLDDYHSLDRTGRKEKGVTALDPRANNFDLMYEQVKALKSGVAVDKPIYNHVTGLLDPPELIKPPKILVIEGLHPMFDERVRDLLDFSIYLDISNEVKFAWKIQRDMAERGHSLESIKASIEARKPDFDAFIDPQKQYADAVIEVLPTQLIPGDNEGKVLRVRLIMKEGVKHFSPVYLFDEGSTLSWIPCGRKLTCSYPGIKFHYGPDTYFGNEVSILEMDGQFDRLDELIYVESHLSNISTKFYGEVTQQMLKHADFPGSNNGTGLFQTIVGLKIRDLYEQITTSKTATPLEATKA

SEQ ID NO: 9437 - protein, 400 aa, Solanum lycopersicum
MAVCTVYTAQSLNSSCSISTPSKPHLRFHQKQVIFLTKRPRKMTCSASSDGEKTVVIGLAADSGCGKSTFMRRLTSVFGGAAEPPKGGNPDSNTLISDMTTVICLDDYHSLDRTGRKEKGVTALDPRANDFDLMYEQVKAIKDGVPVDKPIYNHVSGLLDPPEVIKPPKILVIEGLHPMYDERVRDLLDFSIYLDISNEVKFAWKIQRDMAERGHSLESIKASIEARKPDFDAYIDPQKQYADAVIEVLPTQLIPDDNEGKVLRVRLIMKEGVKNFNPVYLFDEGSTISWIPCGRKLTCSYPGIKFTYGPDTYFGNEVSVLEMDGQFDRLDELIYVESHLSNLSSKFYGEVTQQMLKHADFPGSNNGTGFFQTIVGLKIRDLYEQIVASRAGAPVAAAKA

SEQ ID NO: 9438 - protein, 406 aa, Triphysaria pusilla
MAVCTVYTVQSLNSISTPPKTHLGFNQKQVFFYSTTKKPIKSKSFSTEISCSADDKTVVIGLAADSGCGKSTFMRRLTSVFGGAAEPPKGGNPDSNTLISEMTTVICLDDYHSLDRTGRKEKGVTALDPRANDFDLMYEQVKSIKNGVAVEKPIYNHVTGLLDPPELIKSPKIFVIEGLHPLYDARVRDLLDFSIYLDISNEVKFAWKIQRDMAERGHSLESIKASIEARKPDFDAFIDPQKQYADAVIEVLPTQLIPDDNEGKYLRVRLIQKEGVKFFNPVYLFDEGSTISWIPCGRKLTCSYPGIKFTYGPDTYYGNEVSVLEMDGQFDRLDELIYVESHLSNLSSKFYGEVTQQMLKHADFPGSNNGTGLFQTIVGLKIRDLYEQLTTTKTSKTAAPLKATKA

SEQ ID NO: 9439 - protein, 402 aa, Flaveria ramosissima
MAVSTVYTAQSLNSTCSISTPTKTHLGIQQRQVLFYTKKTNRGRVRGGEIRCSGDTIVIGLAADSGCGKSTFMRRLTSVFGGAAEPPKGGNPDSNTLISDTTTVICLDDYHSLDRTGRKVEGVTALDPRANNFDLMYEQVKALKDGIAVEKPIYNHVSGLLDPPETIKPPKILVIEGLHPMYDQRVRDLLDFSIYLDISNDVKFAWKIQRDMAERGHSLESIKASIEARKPDFDAYIDPQKQYADAVIEVLPTQLIPGDNEGKVLRVKLIMKEGVKYFSPVYLFDEGSTISWVPCGRKLTCSYPGIKFAYGPDTYYGHEVSVLEMDGQFDKLDELVYVENHLSNISTKFYGEITQQMLKHSDFPGSNNGTGLFQTIVGLKIRDLFEQITASKASATLEATKA

SEQ ID NO: 9440 - protein, 416 aa, Citrullus lanatus
MAVCTVYTTQSLNSTFSSSTKSHLGFHQKSLVFLSSNGKKWGSSNKRDGHSTVTNNNSYLITCSAGDQQTVVIGLAADSGCGKSTFMRRLTSVFGGAAEPPKGGNPDSNTLISDTTTVICLDDYHSLDRTGRKEKGVTALDPRANDFDLMYEQVKAIKNGVSVEKPIYNHVTGLLDPPELIKPPKILVIEGLHPMYDSRVRDLLDFSIYLDISNEVKFAWKIQRDMAERGHSLESIKASIEARKPDFDAYIDPQKQYADAVIEVLPTKLIPDDNEGKVLRVRLIMKEGVEFFNPVYLFDEGSTISWIPCGRKLTCSYPGIKFSYGPETYYGHEVSVLEMDGQFDRLDELIYVESHLSNLSTKFYGEVTQQMLKHSDFPGSNNGTGFFQTIVGLKIRDLYEQISASRVKAPVQAAKA

SEQ ID NO: 9441 - protein, 404 aa, Festuca arundinacea
MAFCSPHTTTSLHSPRTTIPNSGFRQNQVILFTTRSSRRSNTRNGARTFQVSCAVDKPIVIGLAADSGCGKSTFMRRLTSVFGGAAEPPRGGNPDSNTLISDTTTVICLDDYHSLDRTGRKEKGVTALDPKANDFDLMYEQVKAIKEGQAIEKPIYNHVTGLLDPAELIQPPKIFVIEGLHPMYDERVRDLLDFSIYLDISNEVKFAWKIQRDMAERGHSLESIKASIEARKPDFDAFIDPQKQYADAVIEVLPTQLIPDDNEGKVLRVKLIMKEGVKFFNPVYLFDEGSTINWIPCGRKLTCSYPGIKFSYGPDTYFGQEVSVLEMDGQFDRLDELIYVESHLSNLSSKFYGEVTQQMLKHADFPGSNNGTGLFQTIVGLKIRDLYEQIIAERVGAPAQAAKV

SEQ ID NO: 9442 - protein, 403 aa, Oryza sativa
MAISSLHATTSLHSPCTTNTSFRQNQVIFFTTRSNRRGSTRYGGARTFQVSCSVDKPVVIGLAADSGCGKSTFMRRLTSVFGGAAEPPKGGNPDSNTLISDTTTVICLDDYHSLDRTGRKEKGVTALDPRANDFDLMYEQVKAIKEGKAIEKPIYNHVTGLLDPPELIQPPKIFVIEGLHPMFDERVRDLLDFSIYLDISDEVKFAWKIQRDMAERGHSLESIKASIEARKPDFDAFIDPQKQYADAVIEVLPTQLIPDDNEGKVLRVKLIMKEGVKNFNPVYLFDEGSSITWVPCGRKLTCSYPGIKFAYGPDTYFGHEVSVLEMDGQFDRLDELIYVESHLSNLSTKFYGEVTQQMLKHADFPGSNNGTGLFQTIVGLKIRDLYEQIIAERAGAPTEAAKV

SEQ ID NO: 9443 - protein, 380 aa, Artemisia annua
MGFNQNHVFLYTTSGKKTNTCKFRSGVITCSGDTIVIGLAADSGCGKSTFMRRLTSVFGGAASPPKGGNPDSNTLISDTTTVICLDDYHSLDRTGRKQKGVTALDPRANDFDLMYEQVKALKDGKAVEKPIYNHVSGLLDPPELIIPPKILVIEGLHPMYDERVRDLLDFSIYLDISNEVKFAWKIQRDMAERGHSLETIKASIEARKPDFDAYIDPQKQYADAVIEVLPTQLIPDDNEGKVLRVKLIMKEGVQYFNPVYLFDEGSTISWIPCGRKLTCSYPGIKFAYGPDAYFSHEVSVLEMDGQFDRLDELVYVESHLSNISTKFFGEITQQMLKHADFPGSNNGTGLFQTIVGLKIRDLFEQITTNKVSAPFEAAKA

SEQ ID NO: 9444 - protein, 396 aa, Linum usitatissimum
MAICTSHFLTSSTTLNHLNQPEPILFRTTRHHYTPRRQTHLTISCAAAHDTVVIGLAADSGCGKSTFMRRLTSVFGGAAEPPKGGNPDSNTLISDTTTVICLDDYHSLDRTGRKEKGVTALDPKANDFDLMFDQVKKLKDGVAVDKPIYNHVSGLLDPAEVIQPPKILVIEGLHPMYDERVRKLLDFSIYLDISNEVKFAWKIQRDMAERGHSLESIKASIEARKPDFDAYIDPQKQYADAVIEVLPTKLIPDDNGGKVLRVRLIMKEGVKFFNPVYLFDEGSTIDWVPCGRKLTCSYPGIKFTYGPDTYFGQEVSVLEMDGQFDRLDELIYVESHLSNLSTKFYGEVTQQMLKHADFPGSNNGTGLFQTIVGLKIRDLYEQLIAAKAKTPAQAKA

SEQ ID NO: 9445 - protein, 404 aa, Lolium multiflorum
MAFCSPHTTTSLHSPRTTIPNSGFRQNQVILFTTRSSRRSNTRNGARTFQVSCAVDKPIVIGLAADSGCGKSTFMRRLTSVFGGAAEPPRGGNPDSNTLISDTTTVICLDDYHSLDRTGRKEKGVTALDPKANDFDLMYEQVKAIKEGKAIEKPIYNHVTGLLDPAELIQPPKIFVIEGLHPMYDERVRDLLDFSIYLDISNEVKFAWKIQRDMAERGHSLESIKASIEARKPDFDAFIDPQKQYADAVIEVLPTQLIPDDNEGKVLRVKLIMKEGVKFFNPVYLFDEGSTINWIPCGRKLTCSYPGIKFSYGPDTYFGQEVSVLEMDGQFDRLDELIYVESHLSNLSSKFYGEVTQQMLKHADFPGSNNGTGLFQTIVGLKIRDLYEQIIAERVGAPAQAAKV

SEQ ID NO: 9446 - protein, 413 aa, Prunus mume
MAICAVYTTQLNPTCSFSTPASKTQTQLGFGFGFCQKQQVVFYKRSQSSSRRASVSLITCSAGGQETVVIGLAADSGCGKSTFMRRLTSVFGGAAEPPKGGNPDSNTLISDTTTVICLDDYHSLDRTGRKEKGVTALDPRANNFDLMYEQVKAIKEGKAVDKPIYNHVSGLLDPPELIKPPKILVIEGLHPMYDQRVRDLLDFSIYLDISNEVKFAWKIQRDMAERGHSLESIKASIEARKPDFDAYIDPQKQYADAVIEVLPTQLIPGDNEGKVLRVRLIMKEGVKFFNPVYLFDEGSTISWIPCGRKLTCSYPGIKFTYGPDTYFGNEVSVLEMDGQFDRLDELIYVESHLSNISTKFYGEVTQQMLKLSDFPGSNNGTGLFQTIVGLKIRDLFEQLIASKAKTPVEATKA

SEQ ID NO: 9447 - protein, 404 aa, Pseudoroegneria spicata
MAFCSPHTTTSLRSPCTTISNSGFRQNQVILFTTRSSRRSNTRHGARTFQVSCAIEKPIVIGLAADSGCGKSTFMRRLTSVFGGAAEPPKGGNPDSNTLISDTTTVICLDDYHSLDRTGRKEKGVTALDPKANDFDLMYEQVKAIKEGKAIEKPIYNHVTGLLDPAELIQPPKIFVIEGLHPMYDERVRELLDFSIYLDISNEVKFAWKIQRDMAERGHSLESIKASIEARKPDFDAFIDPQKQYADAVIEVLPTQLIPDDNEGKVLRVKLIMKEGIKFFNPVYLFDEGSTINWIPCGRKLTCSYPGIKFSYGPDTYYGQEVSVLEMDGQFDRLDELIYVESHLSNLSTKFYGEVTQQMLKHADFPGSNNGTGLFQTIVGLKIRDLYEQIIAERAGVPAEAAKV

SEQ ID NO: 9448 - protein, 404 aa, Secale cereale
MAFCSPQATTSLRSPCTTIPSSGLRQNQVILFTTRSSRRSNTRHGARTFQVSCAVEKPIVIGLAADSGCGKSTFMRRLTSVFGGAAEPPKGGNPDSNTLISDTTTVICLDDYHSLDRTGRKEKGVTALDPKANDFDLMYEQVKAIKEGKPIEKPIYNHVTGLLDPAELIQPPKIFVIEGLHPMYDERVRELLDFSIYLDISNEVKFAWKIQRDMAERGHSLESIKASIEARKPDFDAFIDPQKQYADAVIEVLPTQLIPDDNEGKVLRVKLIMKEGIKFFNPVYLFDEGSTINWIPCGRKLTCSYPGIKFSYGPDTYFGQEVSVLEMDGQFDRLDELIYVESHLSNLSTKFYGEVTQQMLKHADFPGSNNGTGLFQTIVGLKIRDLYEQIIAERAGVPAEAAKV

SEQ ID NO: 9449 - protein, 408 aa, Vitis vinifera
MAICTVYTTQSLNSTCSVSKPAKPQLGFHQKQVVFFTKSRRRSGMSSCGSSVITCSAGEQRTVVIGLAADSGCGKSTFMRRLTSVFGGAAEPPRGGNPDSNTLISDTTTVICLDDYHSLDRTGRKEKGVTALDPRANDFDLMYEQVKAIKDGIAVEKPIYNHVTGLLDPPETIKPPKILVIEGLHPMYDARVRDLLDFSIYLDISNEVKFAWKIQRDMAERGHSLESIKASIEARKPDFDAYIDPQKQYADAVIEVLPTQLIPDDNEGKVLRVRLIMKEGVTYFSPVYLFDEGSTISWIPCGRKLTCSYPGINFSYGPDTYYGHEVSVLEMDGQFDRLDELIYVESHLSNISTKFYGEITQQLLKHSDFPGSNNGTGLFQTIVGLKIRDLFEQIVASRAATPLEATKA

SEQ ID NO: 9450 - protein, 407 aa, Musa acuminata
MATCTVYPAPSLHSSCSFPGPAKTYLGFHQRQVIFFTGGRRSGSRGGRSSSEISCSAEAKTVVIGLAADSGCGKSTFMRRLTSVFGGAAEPPKGGNPDSNTLISDTTTVICLDDYHSLDRTGRKEKGVTALDPRANDFDLMYDQVKALKEGVAVDKPIYNHVTGLLDPPELINPPKILVIEGLHPMFDARVRDLLDFSIYLDISNEVKFAWKIQRDMAERGHSLESIKASIEARKPDFDAYIDPQKQYADAVIEVLPTLLIPDDNEGKVLRVRLIMKEGVKHFSPVYLFDEGSTISWIPCGRKLTCSYPGIQFSYGPDTYYSNEVSVLEMDGQFDRLDELIYVESHLSNLSTKFYGEVTQQMLKHADFPGSNNGTGLFQTIIGLKIRDLYEQIVAERAAAAVEAAKV

SEQ ID NO: 9451 - protein, 413 aa, Gossypium hirsutum
MAVCSAYTTQSLNSTCSISTPAKTHLGFHQKQVVFYRRSSKRGGSGSGSGSSSGPCVITCSAGDSQTVVIGLAADSGCGKSTFMRRLTSVFGGAAEPPKGGNPDSNTLISDMTTVICLDDYHSLDRTGRKEKGVTALDPRANDFDLMYEQVKAIKSGVAVDKPIYNHVTGLLDPPELIKPPKILVIEGLHPMFDERVRDLLDFSIYLDISNEVKFAWKIQRDMAERGHSLESIKASIEARKPDFDAYIDPQKKYADAVIEVLPTQLIPDDNEGKVLRVRLIMKEGVKHFSPVYLFDEGSTISWIPCGRKLTCSYPGIKFHYGPDTYFGNEVSILEMDGQFDRLDELIYVESHLSNISTKFYGEVTQQMLKHADFPGSNNGTGLFQTIVGLKIRDLYEQITSSKTAAPLEATKA

SEQ ID NO: 9452 - protein, 402 aa, Flaveria ramosissima
MAVSTVYTAQSLNSTCSISTPTKTHLGIQQRQVLFYTKKTNRGRVRGGEIRCSGDTIVIGLAADSGCGKSTFMRRLTSVFGGAAEPPKGGNPDSNTLISDTTTVICLDDYHSLDRTGRKVEGVTALDPRANNFDLMYEQVKALKDGIAVEKPIYNHVSGLLDPPETIKPPKILVIEGLHPMYDQRVRDLLDFSIYLDISNDVKFAWKIQRDMAERGHSLESIKASIEARKPDFDAYIDPQKQYADAVIEVLPTQLIPGDNEGKVLRVKLIMKEGVKYFSPVHLFDEGSTISWVPCGRKLTCSYPGIRFAYGPDTYYGHEVSVLEMDGQFDRLDELVYVESHLSNISTKFYGEITQQMLKHSDFPGSNNGTGLFQTIVGLKIRDLFEQITATKASPTLEATKA

SEQ ID NO: 9453 - protein, 403 aa, Setaria italica
MAISSAHTTTSLHSPCTTVSNAGFRQKQVIFFTSNRRGGRRHGGARTFQISCSVEKPVVIGLAADSGCGKSTFMRRLTSVFGGAAEPPKGGNPDSNTLISDTTTVICLDDYHSLDRTGRKEKGVTALDPRANNFDLMYEQVKAIKEGQTIEKPIYNHVTGLLDPPEVITPPKIFVIEGLHPMFDERVRDLLDFSIYLDISDEVKFAWKIQRDMAERGHSLESIQASIEARKPDFDAFIDPQKQYADAVIEVLPTQLIPDDNEGKVLRVKLIMKEGVKHFNPVYLFDEGSSISWVPCGRKLTCSYPGIKFAYGPDTYFGHEVSVLEMDGQFDRLDELIYVESHLSNLSTKFYGEVTQQMLKHADFPGSNNGTGLFQTIVGLKIRDLYEQIVAERAGAPAESAKV

SEQ ID NO: 9454 - protein, 406 aa, Triphysaria pusilla
MAVCTVYTVQSLNSISTPPKTHLGFNQKQVFFYSTTKKPIKSKSFSTEISCSADDKTVVIGLAADSGCGKSTFMRRLTSVFGGAAEPPKGGNPDSNTLISEMTTVICLDDYHSLDRTGRKEKGVTALDPRANDFDLMYEQVKSIKDGVAVEKPIYNHVTGLLDPPELIKSPKIFVIEGLHPLYDARVRDLLDFSIYLDISNEVKFAWKIQRDMAERGHSLESIKASIEARKPDFDAFIDPQKQYADAVIEVLPTQLIPDDNEGKYLRVRLIQKEGVKFFNPVYLFDEGSTISWIPCGRKLTCSYPGIKFTYGPDTYYGNEVSVLEMDGQFDRLDELIYVESHLSNLSSKFYGEVTQQMLKHADFPGSNNGTGLFQTIVGLKIRDLYEQLTTTKTSKTAAPLKATKA

SEQ ID NO: 9455 - protein, 411 aa, Theobroma cacao
MAVCTVYTTQSLNSTCSISTPTKTHLGFHQKQVVFYSTGKRTSKRGSSSSGGPCVITCSAVDSQTVVIGLAANSGCGKSTFMRRLTSVFGGAAEPPRGGNPDSNTLISDMTTVICLDDYHSLDRTGRKEKGVTALDPRANNFDLMYEQVKALKSGVAVDKPIYNHVTGLLDPPELIKPPKILVIEGLHPMFDERVRDLLDFSIYLDISNEVKFAWKIQRDMAERGHSLESIKASIEARKPDFDAFIDPQKQYADAVIEVLPTQLIPGDNEGKVLRVRLIMKEGVKHFSPVYLFDEGSTLSWIPCGRKLTCSYPGIKFHYGPDTYFGNEVSILEMDGQFDRLDELIYVESHLSNISTKFYGEVTQQMLKHADFPGSNNGTGLFQTIVGLKIRDLYEQITTSKTATPLEATKA

SEQ ID NO: 9456 - protein, 405 aa, Lactuca sativa
MAACTVYTLQALNTTCSISTPTKTHLGFNQKRVFFYSNGGKGTSSGKMRGGEITCSGDTIVIGLAADSGSGKSTFMRRLTSVFGGAASPPKGGNPDSNTLISDTTTVICLDDYHSLDRTGRKEKGVTALDPRANDFDLMYEQVKALKNGVAVEKPIYNHVTGLLDPPELIKSPKILVIEGLHPMYDPRVRDLLDFSIYLDISNEVKFAWKIQRDMAERGHSLESIKASIEARKPDFDAYIDPQKQYADAVIEVLPTRLIPDDNEGKVLRVKLIMKEGVPYFNPVYLFDEGSTISWIPCGRKLTCSYPGISFSYGPDAYFGHEVSVLEMDGQFDRLDELIYVESHLSNISTKFYGEITQQMLKHADFPGSNNGTGLFQTIVGLKIRDLFEQIAAKRESTPLQSTKS

SEQ ID NO: 9457 - protein, 406 aa, Triphysaria pusilla
MAVCTVYTVQSLHSISTPPKTHLGFNQKQVFFYSTTKKPIKSKSFSTEISCSADDKTVVIGLAADSGCGKSTFMRRLTSVFGGAAEPPKGGNPDSNTLISEMTTVICLDDYHSLDRTGRKEKGVTALDPRANDFDLMYEQVKSIKNGVAVEKPIYNHVTGLLDPPELIKSPKIFVIEGLHPLYDARVRDLLDFSIYLDISNEVKFAWKIQRDMAERGHSLESIKASIEARKPDFDAFIDPQKQYADAVIEVLPTQLIPDDNEGKYLRVRLIQKEGVKFFNPVYLFDEGSTISWIPCGRKLTCSYPGIKFTYGPDTYYGNEVSVLEMDGQFDRLDELIYVESHLSNLSSKFYGEVTQQMLKHADFPGSNNGTGLFQTIVGLKIRDLYEQLTTTKTSKTAAPLKATKA

SEQ ID NO: 9458 - protein, 302 aa, Vaccinium corymbosum
MTTVICLDDYHSLDRTGRKQKGVTALDPRANDFDLMYEQVKAIKDGIAVDKPIYNHVSGLLDPPELIKPPKILVIEGLHPMYDQRVRDLLDFSIYLDISNDVKFAWKIQRDMAERGHSLESIKASIEARKPDFDAYIDPQKQYADAVIEVLPTQLIPGDNEGKVLRVRLIMKEGVKYFNPVYLFDEGSTINWIPCGRKLTCSYPGIKFTYGPESYFGHEVSVLEMDGQFDRLDELIYVESHLSNISTKFYGEVTQQMLKLSDFPGSNNGTGLFQTIVGLKIRDLYEQIIAAKAAAPLQATKA

SEQ ID NO: 9459 - protein, 270 aa, Triticum aestivum
MAFCSPHTTASLRSPCTTIPNSGFRQNQVILFTTRSSRRSNTRHGARTFQVSCAVEQPIVIGLAADSGCGKSTFMRRLTSVFGGAAEPPKGGNPDSNTLISDTTTVICLDDYHSLDRTGRKEKGVTALDPKANDFDLMYEQVKAIKEGKAIEKPIYNHVTGLLDPAELIQPPKIFVIEGLHPMYDERVRELLDFSIYLDISNEVKFAWKIQRDMAERGHSLESIKASIEARKPDFDAFIDPQKQYADAVIEVLPTQLIPDDNEGRCCVLN

SEQ ID NO: 9460 - protein, 198 aa, Zostera marina
MAVCTVYSPHSLKSTCPIPNTSRIQLGSHQKQVIFFTRRKGGNYRSNKLSGTITCEANTIVIGLAADSGCGKSTFMRRLTSVFGGAASPPKGGNPDSNTLISDTTTVICLDDYHSLDRYGKRSRVLLHLIQKPTTLISCMNKLRHLNKVLLWRNQFIIMLLEFSILLSSFNLPRSWLLKDCTQCTILVSVICWTSVFT

SEQ ID NO: 9461 - protein, 227 aa, Sarracenia psittacina
MATCTTTVYTIQSLNSTSSISTPTKTHLGSHHKQVVFYSHGIKNSRKGTTNITTTTTITCSADKTVVIGLAADSGCGKSTFMRRLTSVFGGAAEPPRGGNPDSNTLISDTTTVICLDDYHSLDRTGRKEKGVTALDPRANNFDLMYEQVKALKSGIAVEKPIYNHVTGLLDPPELIKPPKILVIEGLHPMYDERVRKLLDFSIYLDISNDVNLHGKFRGHGRAGTQS

SEQ ID NO: 9462 - protein, 418 aa, Cucumis melo
MAVCTVYTTQSLNSTFSSSTKSHLGFHQKNQQLVFLSSNGKKWGSGNKRDGHNTVTNNNPYLITCSAADQQTIVIGLAADSGCGKSTFMRRLTSVFGGAAEPPKGGNPDSNTLISDTTTVICLDDYHSLDRTGRKEKGVTALDPRANDFDLMYEQVKAIKSGVSVDKPIYNHVTGLLDPPELIKPPKILVIEGLHPMYDSRVRDLLDFSIYLDISNEVKFAWKIQRDMAERGHSLESIKASIEARKPDFDAYIDPQKQYADAVIEVLPTKLIPDDNEGKVLRVRLIMKEGVEFFNPVYLFDQGSTISWIPCGRKLTCSYPGIKFSYGPETYYGHEVSVLEMDGQFDRLDELIYVESHLSNLSTKFYGEVTQQMLKHSDFPGSNNGTGFFQTIVGLKIRDLYEQITASRVKAPVEAAKA

SEQ ID NO: 9463 - protein, 404 aa, Avena sativa
MAFCSPHTTTSLHSPRTTIPNSGFRQNQVILFTTRSSRRSNTRNGARTFQVSCAVDKPIVIGLAADSGCGKSTFMRRLTSVFGGAAEPPRGGNPDSNTLISDTTTVICLDDYHSLDRTGRKEKGVTALDPKANDFDLMYEQVKAIKEGKAIEKPIYNHVTGLLDPPETIQPPNIFVIEGLHPMYDARVRDLLDFSIYLDISNEVKFAWKIQRDMAERGHSLESIKASIEARKPDFDAFIDPQKQYADAVIEVLPTQLIPDDNEGKVLRVKLIMKEGVKFFNPVYLFDEGSTINWIPCGRKLTCSYPGIKFSYGPDTYFGQEVSVLEMDGQFDRLDELIYVESHLSNLSTKFYGEVTQQMLKHADFPGSNNGTGLFQTIVGLKIRDLYEQIIAERVGAPAQAAKV

SEQ ID NO: 9464 - protein, 384 aa, Phalaenopsis aphrodite
MAVCTAYTSPSHHHFIFSTHRPNRRIITGKISCSSETNTVVIGLAADSGCGKSTFMRRLTSVFGGAAEPPKGGNPDSNTLISSTTTVICLDDYHSLDRTGRKEKGVTALDPRANDFDLMYQQVKDLKEGKAVEKPIYNHVSGLLDPPELIRPPKILVIEGLHPMYDARVRELLDFSIYLDISNEVKFAWKIQRDMAERGHSLESIKASIEARKPDFNAYIDPQKQYADCVIEVLPTQLIPDDNEGKILRVKLVMKEGVKHFSPVYLFDEGSTVSWIPCGRKLTCSYPGIKFFYGPDTYFDHEVSVLEMDGQFDRLDELIYVESHLSSLSTKFYGEVTQQMLKHSDFPGSNNGTGLFQTIVGLKIRDLFEQVITENSSAPAVSKV

SEQ ID NO: 9465 - protein, 414 aa, Prunus persica
MAICAVYTTTQLNPTCSFSTPASKTQTQLGFGLGFCQKQQVVFYKRSQSNSRRASVSLITCSAGGQETVVIGLAADSGCGKSTFMRRLTSVFGGAAEPPKGGNPDSNTLISDTTTVICLDDYHSLDRTGRKEKGVTALDPRANNFDLMYEQVKAIKEGKAVDKPIYNHVSGLLDPPELIKPPKILVIEGLHPMYDQRVRDLLDFSIYLDISNEVKFAWKIQRDMAERGHSLESIKASIEARKPDFDAYIDPQKQYADAVIEVLPTQLIPGDNEGKVLRVRLIMKEGVKFFNPVYLFDEGSTISWIPCGRKLTCSYPGIKFTYGPDTYFGNEVSVLEMDGQFDRLDELIYVESHLSNISTKFYGEVTQQMLKLSDFPGSNNGTGLFQTIVGLKIRDLFEQLIASKAKTPVEATKA

SEQ ID NO: 9466 - protein, 253 aa, Utricularia gibba
TLQSVNSICSSSFSFTHKHQQQHLLVCTGNKHRISCSATSSDDKTVVIGLAADSGCGKSTFMRRLTSVFGGAAEPPKGGNPDSNTLISDTTTVICLDDYHSLDRTGRKEKGVTALDPRANNFDLMYEQVKALKDGIAVEKPIYNHVSGLLDPPELIKPPKILVIEGLHPMFDSRVRDLLDFSIYLDISNEVKFAWKIQRDMAERGHSLESIKASIEARKPDFDAYIDPQKQYADAVIEVLPTQLIPDDNEARF

SEQ ID NO: 9467 - protein, 411 aa, Medicago truncatula
MAACTVYSTQPLRTNISIPTSSKTHVGFNQKQVVFYTTTKKSSNRRTNSNNRRYLITCGAGDSQTIVIGLAADSGCGKSTFMRRLTSVFGGAAEPPKGGNPDSNTLISDTTTVICLDDYHSLDRTGRKEKGVTALDPRANDFDLMYEQVKAIKEGVSVQKPIYNHVTGLLDPPELIKPPKILVIEGLHPMYDSRVRDLLDFSIYLDISNEVKFAWKIQRDMAERGHSLESIKASIEARKPDFEAYIDPQKQYADAVIEVLPTQLIPDDNEGKILRVRLIQKEGVKYFSPVYLFDDGSTISWIPCGRKLTCSYPGIKFSYGPETYKGNEVSVVEMDGQFDRLDELIYVESHLSNLSSKFYGEVTQQMLKHADFPGSNNGTGLFQTIVGLKIRDLFEQIVASRAETPVGAAKA

SEQ ID NO: 9468 - protein, 391 aa, Triphysaria pusilla
MAVCTVYTVQSLHSISTPPKTHLGFNQKQVFFYSTTKKPIKSKSFSTEISCSADDKTVVIGLAADSGCGKSTFMRRLTSVFGGAAEPPKGGNPDSNTLISEMTTVICLDDYHSLDRTGRKEKGVTALDPRANDFDLMYEQVKSIKNGVAVEKPIYNHVTGLLDPPELIKSPKIFVIEGLHPLYDARVRDLLDFSIYLDISNEVKFAWKIQRDMAERGHSLESIKASIEARKPDFDAFIDPQKQYADAVIEVLPTQLIPDDNEGKYLRVRLIQKEGVKFFNPVYLFDEGSTISWIPCGRKLTCSYPGIKFTYGPDTYYGNEVSVLEMDGQFDRLDELIYVESHLSNLSSKFYGEVTQQMLKHADFPGSNNGTGLFQTIVGLKIRDLYEQLTT

SEQ ID NO: 9469 - protein, 406 aa, Triphysaria pusilla
MAVCTVYTVQSLHSISTPPKTHLGFNQKQVYFYSTTKKPIKSKSFSTEISCSADDKTVVIGLAADSGCGKSTFMRRLTSVFGGAAEPPKGGNPDSNTLISEMTTVICLDDYHSLDRTGRKEKGVTALDPRANDFDLMYEQVKSIKNGVAVEKPIYNHVTGLLDPPELIKSPKIFVIEGLHPLYDARVRDLLDFSIYLDISNEVKFAWKIQRDMAERGHSLESIKASIEARKPDFDAFIDPQKQYADAVIEVLPTQLIPDDNEGKYLRVRLIQKEGVKFFNPVYLFDEGSTISWIPCGRKLTCSYPGIKFTYGPDTYYGNEVSVLEMDGQFDRLDELIYVESHLSNLSSKFYGEVTQQMLKHADFPGSNNGTGLFQTIVGLKIRDLYEQLTTTKTSKTAAPLKATKA

SEQ ID NO: 9470 - protein, 411 aa, Cajanus cajan
MAACTVYSTQSLSTNCSISTPAKTQHGFHQRQVVFYTTSRRNSKRGSLSGSSRYVITCAAGDSQTVVIGLAADSGCGKSTFMRRLTSVFGGAAEPPKGGNPDSNTLISDTTTVICLDDYHSLDRTGRKEKGVTALDPRANDFDLMYDQVKALKDGIAVEKPIYNHVTGLLDPPELIKPPKILVIEGLHPMFDPRVRDLLDFSIYLDISNEVKFAWKIQRDMAERGHSLESIKASIEARKPDFEAYIDPQKQYADAVIEVLPTQLIPDDNEGKILRVRLIQKEGVKYFSPVYLFDDGSTISWIPCGRKLTCSYPGIKFFYGPETYYGNEVSVVEMDGQFDRLDELIYVESHLSNLSTKFYGEVTQQMLKHADFPGSNNGTGLFQTIVGLKIRDLYEQIISTKAETPVGAAKA

SEQ ID NO: 9471 - protein, 405 aa, Musa acuminata
MATCAVYTTPSLHSCSITSPAKTSLGFHQRQVIFFTSRRITKRGGRSTSEVTCSAEAKTVVIGLAADSGCGKSTFMRRLTSVFGGAAEPPKGGNPDSNTLISDTTTVICLDDYHSLDRTGRKEKGVTALDPRANNFDLMYEQVKALKDGVAVDKPIYNHVTGLLDPPELIRPPKILVIEGLHPMFDPRVRELLDFSIYLDISDEVKFAWKIQRDMAERGHSLESIKASIEARKPDFDAYIDPQKQHADAVVEVLPTQLIPDDNEGKVLRVRLIMKEGLKHFSPVYLFDEGSTISWIPCGRKLTCSYPGIKFAYAPDTYYSNEVSVLEMDGQFDRLDELIYVESHLSNLSTKFYGEVTQQMLKHSDFPGSNNGTGLFQTIVGLKIRDLFEQIVAERAAAVAEAAKV

SEQ ID NO: 9472 - protein, 404 aa, Brachypodium distachyon
MAICSAHTTTSLRSPCTTISNTGLRQNQVILFTTRSSRRGSTRHGARTFQVSCTAEKPIIIGLAADSGCGKSTFMRRLTSVFGGAAEPPKGGNPDSNTLISDTTTVICLDDYHSLDRTGRKEKGVTALDPKANDFDLMYEQVKAIKEGKAIEKPIYNHVTGLLDPAELIQPPKIFVIEGLHPMYDQRVRDLLDFSIYLDISNEVKFAWKIQRDMAERGHSLESIKASIEARKPDFDAYIDPQKQYADAVIEVLPTLLIPDDNEGKVLRVKLIMKEGVKYFNPVYLFDEGSSISWIPCGRKLTCSYPGIKFSYGPDTYFGQEVSVLEMDGQFDRLDELIYVESHLSNLSTKFYGEVTQQMLKHSDFPGSNNGTGLFQTIVGLKIRDLYEQIIAERAGVPAEAAKV

SEQ ID NO: 9473 - protein, 418 aa, Cucumis sativus
MAVCTVYTTQSLNSTFSSSIKSHLGFHQKNQQLVFLSSNGKKWGSSNKKDGHNTVTNNNSYLITCSAADQQTVVIGLAADSGCGKSTFMRRLTSVFGGAAEPPRGGNPDSNTLISDTTTVICLDDYHSLDRTGRKEKGVTALDPRANDFDLMYEQVKAIKSGVTVDKPIYNHVTGLLDPPELIKPPKILVIEGLHPMYDSRVRDLLDFSIYLDISNEVKFAWKIQRDMAERGHSLESIKASIEARKPDFDAYIDPQKQYADAVIEVLPTKLIPDDNEGKVLRVRLIMKEGVEFFNPVYLFDEGSTISWIPCGRKLTCSYPGIKFSYGPETYYGHEVSVLEMDGQFDRLDELIYVESHLSNLSTKFYGEVTQQMLKHSDFPGSNNGTGFFQTIVGLKIRDLYEQISASRAKAPVEVAKA

SEQ ID NO: 9474 - protein, 405 aa, Lippia dulcis
MAVSSVHTVQSLNSTSSLSTPSKTHSLFNQKHIFLFSQAKKTATRRATTVISCSADNKTVVIGLAADSGCGKSTFMRRLTSVFGGTAAPPKGGNPDSNTLISNTTTVICLDDYHSLDRTGRKEKGVTALDPKANDFDLMYEQVKALKEGKAVDKPIYNHVSGLLDPPELIKPPKILVIEGLHPMYDSRVRDLLDFSIYLDISNEVKFAWKIQRDMAERGHSLESIKASIEARKPDFDAYIDPQKQYADAVIEVLPTQLIPDENEGNILRVKLIMKEGVKYFNPVYLFDEGSTISWIPCGRKLTCSYPGIKFTYCPDTYFGNEVSVLEMDGQFDRLDELIYVESHLSNISTKFYGEVTQQMLKHSDFPGSNNGTGLFQTIIGLKIRDLYEQLTAKKGAGRLQATRS

SEQ ID NO: 9475 - protein, 106 aa, Zostera marina
MAVCTVYSPHSLKSTCPIPNTSRIQLGSHQKQVIFFTRRKGGNYRSNKLSGTITCEANTIVIGLAADSGCGKSTFMRGLTSVFGGAASPPKVGIQTQTRLSVTRQL

SEQ ID NO: 9476 - protein, 393 aa, Fagopyrum esculentum
MAICAVNAVTHLSSTQNAVFYYTNKLNNNNIPRRARVITCAVGDSQTVVIGLAADSGCGKSTFMRRLTSVFGGAAEPPKGGNPDSNTLISDTTTVICLDDYHSLDRTGRKEKGVTALDPKANDFDLMYEQVKAIKEGKAVEKPIYNHVSGLLDPPELIKPPKILVIEGLHPMFDQRVRDLLDFSIYLDISNEVKFAWKIQRDMAERGHSLESIKASIEARKPDFDAYIDPQKQYADAVIEVLPTQLIPDDTEKKVLRVRLIMKEGVKHFNPVYLFDEGSTVTWIPCGRKLTCSYPGIKFAYGPDTYFGQEVTVVEMDGQFDRLDELIYVESHLSNLSTKFYGEVTQQMLKHADFPGSNNGTGFFQTIVGLKIRDLYEQIVASREGATTTAGKA

SEQ ID NO: 9477 - protein, 416 aa, Humulus lupulus
MAVCTVYTTQLNPTCSSISTPSKSHLGFHQRQVVFYSTGKRATRRGGNSSSISTSCSPYVITCSAGDSQTVVIGLAADSGCGKSTFMRRLTSVFGGAAEPPKGGNPDSNTLISDTTTVICLDDYHSLDRTGRKEQGVTALDPRANNFDLMYDQVKALKDGIPVEKPIYNHVSGLLDPPELIQPPKILVIEGLHPMYDSRVRDLLDFSIYLDISNEVKFAWKIQRDMAERGHSLESIKASIEARKPDFDAYIDPQKQYADAVIEVLPTQLIPDDNEGKVLRVKLIMKEGVKYFSPVYLFDEGSTISWIPCGRKLTCSYPGIKFAYGPDSYYGNEVSVLEMDGQFDRLDELIYVESHLSNISTKFYGEVTLQMLKHSDFPGSNNGTGLFQTIVGLKIRDLYEQITSSRAKTPVQASKA

SEQ ID NO: 9478 - protein, 403 aa, Lippia dulcis
MAVCTMYTAQSLTSISTPPKTHLGFNQRQVVFYTTAKKTTSASRRAAVISCSGEEKPVVIGLAADSGCGKSTFMRRLTSVFGGAAEPPKGGNPDSNTLISDTTTVICLDDYHSLDRTGRKEKGVTALDPRANDFDLMYEQVKAIKEGKAIDKPIYNHVTGLLDPPELIKPPKIFVIEGLHPMYDARVRELLDFSIYLDISNEVKFAWKIQRDMAERGHSLESIKASIEARKPDFDAYIDPQKQYADAVIEVLPTQLIPDDNEGKVLRVRLIMKEGVKFFNPVYLFDEGSTISWIPCGRKLTCSYPGIKFTYGPETYYGHEVSVLEMDGQFDKLDELIYVESHLSSISTKFYGEVTQQMLKHADFPGSNNGTGLFQTIIGLKIRDLYEQIVASRGAAPLEATKA

SEQ ID NO: 9479 - protein, 357 aa, Helianthus annuus
RGGEIRCAGDTIVIGLAADSGCGKSTFMRRLTSVFGGAAEPPKGGNPDSNTLISDTTTVICLDDYHSLDRTGRKVEGVTALDPRANNFDLMYEQVKALKDGIAVDKPIYNHVSGLLDPPELIKPPKILVIEGLHPMYDERVRDLLDFSIYLDISNDVKFAWKIQRDMAERGHSLESIKASIEARKPDFDAYIDPQKQYADAVIEVLPTQLIPDDNEGKVLRVKLIMKEGVKYFSPVYLFDEGSTISWIPCGRKLTCSYPGIKFAYGPDTYYGQEVSVLEMDGQFDKLDELIYVESHLSNISTKFYGEITQQMLKHADFPGSNNGTGLFQTIVGLKIRDLFEQITASKASATLEATKA

SEQ ID NO: 9480 - protein, 403 aa, Panicum virgatum
MAICSTHTTTSLHSPCTTVSNAGFRQKQVIFFTSNRRSGRRHGGARTFQVSCSVEKPVVIGLAADSGCGKSTFMRRLTSVFGGAAEPPKGGNPDSNTLISDTTTVICLDDYHSLDRTGRKEKGVTALDPRANNFDLMYEQVKAIKEGQTIEKPIYNHVTGLLDPPEVIKPPKIFVIEGLHPMFDERVRDLLDFSIYLDISDEVKFAWKIQRDMAERGHSLESIQASIEARKPDFDAFIDPQKQYADAVIEVLPTQLIPDDNEGKVLRVKLIMKEGVKHFNPVYLFDEGSSISWVPCGRKLTCSYPGIKFAYGPDTYFGHEVSVLEMDGQFDRLDELIYVESHLSNLSTKFYGEVTQQMLKHADFPGSNNGTGLFQTIVGLKIRDLYEQIVAERAGAPAETAKV

SEQ ID NO: 9481 - protein, 388 aa, Triticum aestivum
HHHPNSGFRQNQVILFTTRSSRRSNTRHGARTFQVSCAVEQPIVIGLAADSGCGKSTFMRRLTSVFGGAAEPPKGGNPDSNTLISDTTTVICLDDYHSLDRTGRKEKGVTALDPKANDFDLMYEQVKAIKEGKAIEKPIYNHVTGLLDPAELIQPPKIFVIEGLHPMYDERVRELLDFSIYLDISNEVKFAWKIQRDMAERGHSLESIKASIEARKPDFDAFIDPQKQYADAVIEVLPTQLIPDDNEGKVLRVKLIMKEGIKFFNPVYLFDEGSTINWIPCGRKLTCSYPGIKFSYGPDTYFGQEVSVLEMDGQFDRLDELIYVESHLSNLSTKFYGEVTQQMLKHADFPGSNNGTGLFQTIVGLKIRDLYEQIIAERAGVPAEAAKV

SEQ ID NO: 9482 - protein, 398 aa, Zingiber officinale
  misc_feature (38)..(38): Xaa can be any naturally occurring amino acid
RASCTIHTAPYSCSISRPAAKAFSLGFHQRHQQLIFFXSGRRSAVVCSAEKTVVIGLAADSGCGKSTFMRRLTSVFGGAAEPPRGGNPDSNTLISDTTTVICLDDYHSLDRTGRKEKGVTALDPRANDFDLMYEQVKAIKDGVAVEKPIYNHVTGLLDPPELIKPPKILVIEGLHPMYDSRVRDLLDFSIYLDISNEVKFAWKIQRDMAERGHSLESIKASIEARKPDFDAYIDPQKQYADAVIEVLPTQLIPDDDEGKVLRVRLIMKEGVKRFAPIYLFDEGSTISWIPCGRKLTCSYPGIKFFYGPETYFSNEVSVVEMDGKFDRLDELIYVESHLSNLSTKFYGEVTQQMLKHSDFPGSNNGTGLFQTIVGLKIRDLYEQIVAERAAASAAAAKV

SEQ ID NO: 9483 - protein, 387 aa, Euphorbia esula
  misc_feature (304)..(305): Xaa can be any naturally occurring amino acid
  misc_feature (317)..(318): Xaa can be any naturally occurring amino acid
  misc_feature (352)..(352): Xaa can be any naturally occurring amino acid
KNTQLSFLNHKHVSIFYSTRRTINTPKNGTSITCAANEEQTIVIGLAADSGCGKSTFMRRLTSVFGGAAEPPKGGNPDSNTLISDTTTVICLDDYHSLDRTGRKEKGVTALDPRANDFDLMYEQVKAIKDGVAVQKPIYNHVTGLLDPPELIKPPKILVIEGLHPMYDERVRDLLDFSIYLDISNEVKFAWKIQRDMAERGHSLESIKASIEARKPDFDAFIDPQKQYADAVIEVLPTQLIPDDNEGKVLRVKLIMKEGVKYFSPVYLFDEGSTISWIPCGRKLTCSYPGIKFAYGPDAYFGNXXSVLEMDGQFDRXXELIYVESHLSNISTKFYGEVTQQMLKHSDFPGSXNGTGLFQTIVGLKIRDLFEQIVASRSAKTPAKAKA

SEQ ID NO: 9484 - protein, 400 aa, Pinus taeda
MACPAPTAASTPATVRSWNSRFCSNSPLASFSLANTTRRPRRALVVCTVGPEKTVVIGLAADSGCGKSTFMRRLTSVFGGAAEPPKGGNPDSNTLISDTTTVICLDDYHSLDRYGRKEKAVTALDPRANNFDLMYEQVKAMKEGKAVMKPIYNHVTGLLDPPEQIKPPKILVIEGLHPMFDARVRELLDFSIYLDISNEVKFAWKIQRDMAERGHSLESIKASIEARKPDFDAYIDPQKQYADVVIQVLPTELIPDDNEGKVLRVRMVMKEGVNFFNPVYLFDEGSTISWIPCGRKLTCSYPGIKFFYGPDVYYDNEVSVLEMDGQFDRLEELIYVESHLSNISTKFYGEVTQQMLKHADFPGSNNGTGLFQTIVGLKIRDVYEQIIAKRAGASLEAAKA

SEQ ID NO: 9485 - protein, 95 aa, Zostera marina
MWKKLTCSYPGIKFSYGPDSYYSNEVSVLEMDGQFDKLDELIYVESHLSNLSTKFYGEVTQQMLSLSNFPGSTNGTGLFQTIVGMKIRDLYEQII

SEQ ID NO: 9486 - protein, 139 aa, Zostera marina
MKEGVKYFSPSYLFDEGSTIDWIPCGRKLTCSYPGIKFSYGPDSYYSNEVSVLEMDGQFDKLDELIYVESHLSNLSTKFYGEVTQQMLSLSNFPGSTNGTGLFQTIVGMKIRDLYEQIIAERRQLQLTSSQNVEMFFTI

SEQ ID NO: 9487 - protein, 404 aa, Brachypodium distachyon
MAICSAHTTTSLRSPCTTISNTGLRQNQVILFTTRSSRRGSTRHGARTFQVSCTAEKPIIIGLAADSGCGKSTFMRRLTSVFGGAAEPPKGGNPDSNTLISDTTTVICLDDYHSLDRTGRKEKGVTALDPKANDFDLMYEQVKAIKEGKAIEKPIYNHVTGLLDPAELIQPPKIFVIEGLHPMYDQRVRDLLDFSIYLDISNEVKFAWKIQRDMAERGHSLESIKASIEARKPDFDAYIDPQKQYADAVIEVLPTLLIPDDNEGKVLRVKLIMKEGVKYFNPVYLFDEGSSIGWIPCGRKLTCSYPGIKFSYGPDTYFGQEVSVLEMDGQFDRLDELIYVESHLSNLSTKFYGEVTQQMLKHSDFPGSNNGTGLFQTIVGLKIRDLYEQIIAERAGVPAEAAKV

SEQ ID NO: 9488 - protein, 101 aa, Zostera marina
MAVCTVYSPHSLKSTCPIPNTSRIQLGSHQKQVIFFTRRKGGNYRSNKLSGTITCEANTIVIGLAADSGCGKSTFMRRLTSVFGGAASPPRVESRLKHAYQ

SEQ ID NO: 9489 - protein, 409 aa, Amborella trichopoda
MASCTVYTTHSLSSSGTISKTSIGFLHQSPLRPENQIIFCKRTTKRPNSLSTITCSVPEYPKTVVIGLAADSGCGKSTFMRRLTSVFGGDAAPPKGGNPDSNTLISDTTTVICLDDYHSLDRNGRKVKGVTALDPRANDFDLMYTQVKALKEGKAVEKPIYNHVSGLLDPPELIQPPKILVIEGLHPMYDERVRELLDFSIYLDISNEVKFAWKIQRDMAERGHSLESIKASIEARKPDFDAYIDPQKQYADAVIEVLPTQLIPDDNEGKILRVKLVMKEGVKYFSPVYLFDEGSTISWIPCGRKLTCSYPGIKFFYGPDAYFSNEVSILEMDGQFDRLDELIYVESHLSNLSTKFYGEVTQQMLKHVDFPGSNNGTGLFQTIVGLKIRDLYEQIVASRAGATLETAKV

SEQ ID NO: 9490 - protein, 407 aa, Coffea canephora
MAVSTVHTIQPLNSSCSISTPTKSHLGFSQKQQVLFFSKRIKTSSSSSRRSSSEITCSAEKTVVIGLAADSGCGKSTFMRRLTSVFGGAAEPPRGGNPDSNTLISDTTTVICLDDYHSLDRTGRKEKGVTALDPRANNFDLMYEQVKAIKDGVAVDKPIYNHVTGLLDPPELIKPPKILVIEGLHPMYDQRVRDILDFSIYLDISSEVKFAWKIQRDMAERGHSLESIKASIEARKPDFDAYIDPQKQYADVVIEVLPTQLIPDDNEGKVLRVKLIQKEGVNHFSPVYLFDEGSTISWIPCGRKLTCSYPGIKFAYGPDTYFGNEVSVVEMDGQFDRLDELIYVESHLSNISSKFYGEVTQQMLKHADFPGSSNGTGLFQTIVGLKIRDLYEQIVASRAEALQTAKA

SEQ ID NO: 9491 - protein, 412 aa, Mimulus guttatus
MAVCTVYTVQSLNSTYSISTTPAKKNNLLGFNQKQAVVFYSRKTTTATRSGRPGAAVISCSAADKTIVIGLAADSGCGKSTFMRRLTSVFGGAAEPPKGGNPDSNTLISDTTTVICLDDYHSLDRTGRKEKGVTALDPRANDFDLMYEQVKAIKDGVAVDKPIYNHVSGLLDPPELIKPPKILVIEGLHPMYDSRVRDLLDFSIYLDISNEVKFAWKIQRDMAERGHSLESIKASIEARKPDFDAYIDPQKQYADAVIEVLPTQLIPDDNEGKVLRVRLIMKEGIKFFNPVYLFDEGSTISWVPCGRKLTCSYPGIKFTYGPDTYYGNEVSVLEMDGQFDRLDELIYVESHLSNISTKFYGEITQQMLKLSDFPGSNNGTGLFQTIVGLKIRDLYEQIIATRAAAPLEATKA

SEQ ID NO: 9492 - protein, 400 aa, Pseudotsuga menziesii
MACPAPTATSTPSIVRSWNSHFCSSSPLASFSLAHSIRRPRRTLIVCSAGPEKTVVIGLAADSGCGKSTFMRRLTSVFGGAAEPPKGGNPDSNTLISDTTTVICLDDYHSLDRYGRKDQGVTALDPRANNFDLMYEQVKALKEGKPVMKPIYNHVTGILDPAEQINPPKILVIEGLHPMFDARVRELLDFSIYLDISNEVKFAWKIQRDMAERGHSLESIKASIEARKPDFDAFIDPQKQYADVVIQVLPTELIPDDNEGKVLRVRMVMKEGVNFFNPVYLFDEGSTISWIPCGRKLTCSYPGIKFFYGPDVYYDNEVSVLEMDGQFDRLEELIYVESHLSNISTKFYGEVTQQMLKHADFPGSNNGTGLFQTIVGLKIRDVYEQLIAQMTGASLEAAKA

SEQ ID NO: 9493 - protein, 276 aa, Triphysaria pusilla
MAVCTVYTVQSLHSISTPPKTHLGFNQKQVYFYSTTKKPIKSKSFSTEISCSADDKTVVIGLAADSGCGKSTFMRRLTSVFGGAAEPPKGGNPDSNTLISEMTTVICLDDYHSLDRTGRKEKGVTALDPRANDFDLMYEQVKSIKNGVAVEKPIYNHVTGLLDPPELIKSPKIFVIEGLHPLYDARVRDLLDFSIYLDISNEVKFAWKIQRDMAERGHSLESIKASIEARKPDFDAFIDPQKQYADAVIEVLPTQLIPDDNEGKYLRVRLIQKEGG

SEQ ID NO: 9494 - protein, 405 aa, Zea mays
MAICSAHTTTSLRSPCTTVSNAGLRQKQVIFVTSNRRSGGGRRHGGARSFQVSCSVDKPVVIGLAADSGCGKSTFMRRLTSVFGGAAEPPKGGNPDSNTLISDTTTVICLDDYHSLDRNGRKEKGVTALDPRANNFDLMYEQVKAIKEGQAVEKPIYNHVTGLLDPPELIAPPKIFVIEGLHPMFDERVRDLLDFSIYLDISDEVKFAWKIQRDMAERGHSLESIKASIEARKPDFDAFIDPQKQYADAVIEVLPTQLIPDDNEGKVLRVKLIMKEGVKNFNPVYLFDEGSTISWVPCGRKLTCSYPGIKFAYGPDTYFGNEVSVLEMDGQFDRLDELIYVESHLSNLSTKFYGEVTQQMLKHADFPGSNNGTGLFQTIIGLKIRDLYEQIVAERAGVPAEAAKV

SEQ ID NO: 9495 - protein, 405 aa, Zea mays
MAICSAHTTTSLRSPCTTVSNAGLRQKQVIFVTSNRRSGGGRRHGGARSFQVSCSVDKPVVIGLAADSGCGKSTFMRRLTSVFGGAAEPPKGGNPDSNTLISDTTTVICLDDYHSLDRNGRKEKGVTALDPRANNFDLMYEQVKAIKEGQAVEKPIYNHVTGLLDPPELIAPPKIFVIEGLHPMFDERVRDLLDFSIYLDISDEVKFAWKIQRDMAERGHSLESIKASIEARKPDFDAFIDPQKQYADAVIEVLPTQLIPDDNEGKVLRVKLIMKEGVKNFNPVYLFDEGSTISWVPCGRKLTCSYPGIKFSYGPDTYFGNEVSVLEMDGQFDRLDELIYVESHLSNLSTKFYGEVTQQMLKHADFPGSNNGTGLFQTIIGLKIRDLYEQIVAERAGVPAEAAKV

SEQ ID NO: 9496 - protein, 400 aa, Pinus pinaster
MACPAPTAASTPATVRSWNSRFCSNSPLASFSLAHTTRRPRRALVVCTVGPEKTVVIGLAADSGCGKSTFMRRLTSVFGGAAEPPKGGNPDSNTLISDTTTVICLDDYHSLDRYGRKEKAVTALDPRANNFDLMYEQVKAMKEGKAVMKPIYNHVTGLLDPPEQINPPKILVIEGLHPMYDARVRELLDFSIYLDISNEVKFAWKIQRDMAERGHSLESIKASIEARKPDFDAYIDPQKQYADVVIQVLPTELIPDDNEGKVLRVRMVMKEGVSFFNPVYLFDEGSTISWIPCGRKLTCSYPGIKFFYGPDVYYDNEVSVLEMDGQFDRLEELIYVESHLSNISTKFYGEVTQQMLKHADFPGSNNGTGLFQTIVGLKIRDVYEQIIAKRAGASLEAAKA

SEQ ID NO: 9497 - protein, 409 aa, Elaeis guineensis
MAVCTVYTTPSLHSPCSVSNPTKTSFGFNQRQQVIFYTSGRGSRRRGGKKISEALYCSAEAKTVVIGLAADSGCGKSTFMRRLTSVFGGAAEPPKGGNPDSNTLISDTTTVICLDDYHSLDRTGRKEKGVTALDPRANNFDLMYEQVKALKEGVAVDKTYLQPCHWSLDPPELIQPPKILVIEGLHPMFDPRVRDLLDFSIYLDISNEVKFAWKIQRDMAERGHSLESIKASIEARKPDFDAYIDPQKQYADAVIEVLPTQLIPDDNEGKVLRVRLIMKEGSKYFSPVYLFDEGSTISWIPCGRKLTCSYPGIKFFYGPDTYFSHEVSVLEMDGQFDRLDELIYVESHLSNISTKFYGEVTQQLLKHADFPGSNNGTGLFQTIVGLKIRDLYEQIVAKKAAAPAEAAKV

SEQ ID NO: 9498 - protein, 349 aa, Centaurea maculosa
GDTIVIGLAADSGCGKSTFMRRLTSVFGGAASPPKGGNPDSNTLISDTTTVICLDDYHSLDRTGRKVEGVTALDPRANNFDLMYEQVKALKDGIAVDKPIYNHVSGLLDPPELIKPPKILVIEGLHPMYDERVRDLLDFSIYLDISNDVKFAWKIQRDMAERGHSLESIKASIEARKPDFDAYIDPQKQYADAVIEVLPTQLIPGDNEGKVLRVKLIMKEGVKYFSPVYLFDEGSTISWIPCGRKLTCSYPGIKFNYGPDSYFGQEVSVLEMDGQFDRLDELIYVESHLSNISTKFYGEITQQMLKHADFPGSNNGTGLFQTIVGLKIRDLFEQITASRASAPLEATKA

SEQ ID NO: 9499 - protein, 396 aa, Flaveria ramosissima
YTAQSLNSTCSISTPTKTHLGIQQRQVLFYTKKTNRGRVRGGEIRCSGDTIVIGLAADSGCGKSTFMRRLTSVFGGAAEPPKGGNPDSNTLISDTTTVICLDDYHSLDRTGRKVEGVTALDPRANNFDLMYEQVKALKDGIAVEKPIYNHVSGLLDPPETIKPPKILVIEGLHPMYDQRVRDLLDFSIYLDISNDVKFAWKIQRDMAERGHSLESIKASIEARKPDFDAYIDPQKQYADAVIEVLPTQLIPGDNEGKVLRVKLIMKEGVKYFSPVYLFDEGSTISWVPCGRKLTCSYPGIKFAYGPDTYYGHEVSVLEMDGQFDKLDELVYVENHLSNISTKFYGEITQQMLKHSDFPGSNNGTGLFQTIVGLKIRDLFEQITASKASATLEATKA

SEQ ID NO: 9500 - protein, 267 aa, Olea europaea
MYEQVKAIKNGVAVEKPIYNHVTGLIDPPELIKPPKIFVIEGLHPMYDARVRELLDFSIYLDISNEVKFAWKIQRDMAERGHSLESIKASIEARKPDFDAYIDPQKQYADAVIEVLPTQLIPDDNEGKVLRVRLIMKEGVKYFNPVYLFDEGSTISWIPCGRKLTCSYPGIKFSYGPETYFGHEVSVLEMDGQFDRLDELIYVESHLSNISTKFYGEVTQQMLKHADFPGSNNGTGLFQTIVGLKIRDLYEQIVASKTGAPLEATKA

SEQ ID NO: 9501 - protein, 402 aa, Panicum virgatum
MAICSTHTTTSLHSPCTVSNTGFRQKQVIFFTSNRRSGRRHGGARTFQVSCSVEKPVVIGLAADSGCGKSTFMRRLTSVFGGAAEPPKGGNPDSNTLISDTTTVICLDDYHSLDRTGRKEKGVTALDPRANNFDLMYEQVKAMKEGQTIEKPIYNHVTGLLDPPEVITPPKIFVIEGLHPMFDERVRDLLDFSIYLDISDEVKFAWKIQRDMAERGHSLESIQASIEARKPDFDAFIDPQKQYADAVIEVLPTQLIPDDNEGKVLRVKLIMKEGVKHFNPVYLFDEGSSINWVPCGRKLTCSYPGIKFAYGPDSYFGHEVSVLEMDGQFDRLDELIYVESHLSNLSTKFYGEVTQQMLKHADFPGSNNGTGLFQTIVGLKIRDLYEQIVAERAGVPAEAAKV

SEQ ID NO: 9502 - protein, 400 aa, Tripterygium wilfordii
TQLSQLNMLNLHTNKTNLGFLPKQVVFYSTSGKRSSKRGGSTTTVITCSAGDSQTVVIGLAADSGCGKSTFMRRLTSVFGGAAEPPRGGNPDSNTLISDTTTVICLDDYHSLDRTGRKEKGVTALDPRANNFDLMYEQVKAIKDGIAIQKPIYNHVSGLIDPPELIKPPKIFVIEGLHPMYDERVRDLLDFSIYLDISNEVKFAWKIQRDMAERGHSLESIKASIEARKPDFDAYIDPQKQYADAVIEVLPTELIPDDNEGKVLRVRLIMKEGVKFFNPVYLFDEGSTISWIPCGRKLTCSYPGIKFSYGPDSYFGHEVSVLEMDGQFDRLDELIYVESHLSNISTKFYGEVTQQMLKHSDFPGSNNGTGLFQTIIGLKIRDLFEQLVASRAGAPVEAKA

SEQ ID NO: 9503 - protein, 377 aa, Triticum aestivum
QVILFTTRSSRRSNTRHGARTFQVSCAVEQPIVIGLAADSGCGKSTFMRRLTSVFGGAAEPPKGGNPDSNTLISDTTTVICLDDYHSLDRTGRKEKGVTALDPKANDFDLMYEQVKAIKEGKAIEKPIYNHVTGLLDPAELIQPPKIFVIEGLHPMYDERVRELLDFSIYLDISNEVKFAWKIQRDMAERGHSLESIKASIEARKPDFDAFIDPQKQYADAVIEVLPTQLIPDDNEGKVLRVKLIMKEGIKFFNPVYLFDEGSTINWIPCGRKLTCSYPGIKFSYGPDTYFGQEVSVLEMDGQFDRLDELIYVESHLSNLSTKFYGEVTQQMLKHADFPGSNNGTGLFQTIVGLKIRDLYEQIIAERAGVPAEAAKV

SEQ ID NO: 9504 - protein, 404 aa, Pennisetum glaucum
MAISSAHTTTSLHSPCTTVSNAGFRQQQVIFFTSNRGSGRRHGGARTCFQVSCSVQKPVVIGLAADSGCGKSTFMRRLTSVFGGAAEPPKGGNPDSNTLISDTTTVICLDDYHSLDRNGRKENGVTALDPRANNFDLMYEQVKAIKEGQTIEKPIYNHVTGLLDPPEVITPPKIFVIEGLHPMFDERVRDLLDFSIYLDISDDVKFAWKIQRDMAERGHSLESIKASIEARKPDFDAFIDPQKQYADAVIEVLPTQLIPDDNEGKVLRVKLIMKEGVKHFNPVYLFDEGSSISWVPCGRKLTCSYPGIKFAYGPDTYFGHEVSVLEMDGQFDRLDELIYVESHLSNLSTKFYGEVTQQMLKHADFPGSNNGTGLFQTIIGLKIRDLYEQIVAERAGVPAEAAKV

SEQ ID NO: 9505 - protein, 399 aa, Sciadopitys verticillata
MACPAPTITTPAHRYSSVSLAPSTKFLPGVSSLRSRGRRAGALVICSAAPDKTVVIGLAADSGCGKSTFMRRLTSVFGGAAEPPQGGNPDSNTLISDTTTVICLDDYHSLDRYGRKEKGVTALDPKANNFDLMYEQVKALKEGKSIMKPIYNHVSGLLDPPEEIPPPKILVIEGLHPMFDSRVRELLDFSIYLDISNEVKFAWKIQRDMAERGHSLESIKASIEARKPDFDAFIDPQKQYADVVIQVLPTQLIPDDNEGKILRVRMIMKEGVEDFSPVYLFDEGSTISWIPCGRKLTCSYPGIKFFYGPDVYYDQEVSMLEMDGQFDRLDELIYVESHLSNISTKFYGEITQQMLKHADFPGSNNGTGLFQTIVGLKIRDLYEQIISEKKRTTFAAAKA

SEQ ID NO: 9506 - protein, 772 aa, Arabidopsis lyrata
MAFTFLSPNPVFLSLTGTTSSFSYKPVLLPFSRNSRNLTVAAGPARRNSYPNPADDDPPEAPEDSMHGVSKFQQIQRQAARARKLEEEDFEKNRNTYLSAIADVEDAAETGRDDEESGGDLFSDIDRAISMKRSEFVKQGLLKPNPPKTASLKKIGEEGDEEEGDVTDVVDELDEEEVVDLDEIDKLTGLTEISDEEDWVDEEGNTRINKKKEIGSDHQFEFDLDDFGESKVRIVEPKFKMSLAELLDESKVVPISVYGDLDVEITGIQHDSRGVSAGDLFVCCVGSESFLSEADKRGAVAVVASKEIDIEDTLGCKALVIVEDTNAVLAALASSFYRHPSKNMSVIGVTGTDGKTTTTYLIKSLYEAMGVRTGMFSTVSCYIHGDNKLDTPNATTNPDAVLVQSLMAKMLHNGTEALVMEASPQELALGKCDEVDFDIAVFTNLTRENTDFRGTDEEYRDAEAKLFARMVDPGRHRKVVNIDDPNATFFVQQGNPNVPVVTFAMENTKADVHPLMFELSLFETQVLVNTPQGILEISSGLLGRHNIYNILAAVAVGIAVGAPLEDIVRGVEEVDAVPGRCELIDEEQAFGVIVDHANTPDGLSRLLDSIRELKPRRIITVIGCEGENERGKRPLMTKIATEKSDVTMLTSDNPRNEDPLDILDDMLAGIGWTMQEYLKHGEHDYYPPLANGHRLFLHDIRRVAVRCAVAMGEEGDMVVVAGKGHEAYQLEGEKKEFYDDREECREALQYVDELHQAGIDTSEFPWRLPESH

SEQ ID NO: 9507 - protein, 775 aa, Eutrema parvulum
MAFTFLSPHPVFLSLAGTTSSFSYKPVLLPFSRNSRSLHLAAGPARRNSYPNPADDDPPEAPEDSMHGVSKFQQIQRQAARARKLEEEDFEKNRNTYLSAIADVEDAPETGRDDVESGGDLFSDIDRAISMKRSEFVKKGLLQPNPPKTASSKKIEEEDGEDGDVTDAGDELDEEEVVDLDEIDKLTGLTEVSDEEDWVDEEGNPKISKKKEMSSDHQFEFDLDDFGGSKVRIVEPKFKLSLAELLDESKVVPISVYGDLDVEITGIQHDSRGVSAGDLFVCCIGSENDGDSVLSEADKRGAVAVVASKEIDIEDTLGCKALVIVEDTDAVLAALASSFYRHPSKNMAVIGVTGTNGKTTTTYLIKSLYEAMGVRTGMFSTVSCYIHGDNKLDSPNTTTNPDAVLVQSLMAKMLHNGTESLVMEASPQELALGKCDEVDFDIAVFTNLTREDSDFRGTDEEYRDAEAKLFARMVDPERHRKVVNIDDPNAAFFVQQGNPNVPVVTFAMENTKADVHPLKFELSLFETQVLVNTPQGILEISSGLLGRHNIYNILAAVAVGIAVGAPLEDIVRGIEEVDAVPGRCELIDEEQAYGVIVDHANTPDGLSRLLDSIRELKPRRIITVIGCAGETERGKRPVMTKIATEKSDVTMLTSDNPGNEDPLDILDDMLAGIGWTMQEYLKHGEHDYYPPLANGHRLFLHDIRRVAVRCAVAMGEEGDMVVVAGKGHEAYQLEGDKKEFYDDREECREALQYVDELHQAGIDTSEFPWRLPESH

SEQ ID NO: 9508 - protein, 775 aa, Eutrema halophilum
MAFTFLSPHPVFLSLGGTTSSFSYKPIILPFSRNSRNLPLAAGPARRNSYPNPADDDPPEAPEDSMHGVSKFQQIQRQAARARKLEEEDFEKNRNTYLSAIADVEDAAETGQDDVESGGDLFSDIDRAISMKRSEFVKKGFLQPNPPKTASSKKIEQEDGEEGDVTDVGDELGEEEVEDLDEIDKLTGLTEVSDEEDWVDEEGNPRINKKKNIGSDHQFEFDLDDFGGSKVRIVEPKFKLSLAELLDESKVVPISVYGDLDVEITGIQQDSRGVSAGDLFVCCVASENDGDSFLSEADKRGAVAVVASKEIDIEDTLGCKALVIVEDTNAVLAALASSFYRHPSKNMAVIGVTGTNGKTTTTYLIKSLYEAMGVRTGIFSTVSCYIHGDTKLDTPNATMNPDAVLVQSLMAKMLHNGTEALVMEASPQELALGKCDEVDFDIAVFTNLTREDTDFLGTDEEYRDAEAKLFARMVDPERHRKVVNIDDPNAAFFVRQGNPNVPVVTFAMENTKADVYPLKFELSLFETQVLVNTPQGILEISSGLLGRHNIYNILAAVAVGIAVGAPLEDIVRGVEEVDAVPGRCELIDEEQAFGVIVDHANTPAGLSRLLDSVRELKPRRIITVIGCEGENERGKRPLMTKIATEKSDVTMLTSDNPRNEDPLDILDDMLAGIGWTMQEYLKHGEHDYYPPLANGHRLFLHDIRRVAVRCAVAMGEEGDMVVVAGKGHEAYQLEGDKKEFYDDREECREALQYVDELHQAGIDTSEFPWRLPESH

SEQ ID NO: 9509 - protein, 770 aa, Eutrema halophilum
MAFTFLSPHPVFLSLGGTTSSFSYKPIILPFSRNSRNLPLAAGPARRNSYPNPADDDPPEAPEDSMHGVSKFQQIQRQAARARKLEEEDFEKNRNTYLSAIADVEDAAETGQDDVESGGDLFSDIDRAISMKRSEFVKKGFLQPNPPKTASSKKIEQEDGEEGDVTDVGDELGEEEVEDLDEIDKLTGLTEVSDEEDWVDEEGNPRINKKKNIGSDHQFEFDLDDFGGSKVRIVEPKFKLSLAELLDESKVVPISVYGDLDVEITGIQQDSRGVSAGDLFVCCVASENDGDSFLSEADKRGAVAVVASKEIDIEDTLGCKALVIVEDTNAVLAALASSFYRHPSKNMAVIGVTGTNGKTTTTYLIKSLYEAMGVRTGIFSTVSCYIHGDTKLDTPNATMNPDAVLVQSLMAKMLHNGTEALVMEASPQELALGKCDEVDFDIAVFTNLTREDTDFLGTDEEYRDAEAKLFARMVDPERHRKVVNIDDPNAAFFVRQGNPNVPVVTFAMENTKADVYPLKFELSLFETQVLVNTPQGILEISSGLLGRHNIYNILAAVAVGIAVGAPLEDIVRGVEEVDAVPGRCELIDEEQAFGVIVDHANTPAGLSRLLDSVRELKPRRIITVIGCEGENERGKRPLMTKIATEKSDVTMLTSDNPRNEDPLDILDDMLAGIGWTMQEYLKHGEHDYYPPLANGHRLFLHDIRRVAVRCAVAMGEEGDMVVVAGKGHEAYQLEGDKKEFYDDREECREALQYVDELHQAGIDTSEFPWR

SEQ ID NO: 9510 - protein, 767 aa, Brassica rapa
MAFTFLSPHPLFLSLAGTTSSFSYKPVYLPSSRNSRNLQLSAAPARRNSYPNPADDDPPEAPEDSMHGVSKFQQIQRQAARARKLEEEDFEKNRNTYLSAIADVEDAPETGRDDVESGGDLFSDIDRAISMKRSEFVKKGLLQPNPPKTASDKKIDEEEDDDVTDVVDELDEEEVVDLDEIDKLTGLTEVSDEDDWVDEEGNPRINKTRSDHQFEFDLDDFGGSKARIVEPKFRLSLAELLDESKVVPISVYGDLDVEITGIQHDSRGVSAGDLFVCCENDGDSVLSEADKRGAVAVVASKEIDIEDTLGCRALVIVEDTEAVLAALASSFYRHPSKNMAVIGVTGTNGKTTTTYLIKSLYEAMGVRTGMFSTVSCYVHGDNKLDSPATTTSPDAVLVQSMMAKMLHNGTEALVMEASPQELASGKCDEVDFDIAVFTNLAREESGFRGTDEEYRDAEAKLFARMVDPERHRKVVNIDDPNAAFFVQQGNADVPVVTFAMENTKADVHPLKFELSLFETQVLVNTPQGILEISSGLLGRHNIYNILAAVAVGIAVGAPLEDIVRGVEEVDAVPGRCELIDEEQAFGVIVDHANTPDGLSRLLDSVRELKPRRIITVIGCAGETERGKRPVMTKIATEKSDVTMLTSDNPGNEDPLDILDDMLAGIGWTMQEYLKHGEHDYYPPLANGHRLFLHDVRRVAVRCAVAMGEEGDMVVVAGKGHEAYQLEGDKKEFYDDREECREALQYVDELHQAGIDTSEFPWRLPESH

SEQ ID NO: 9511 - protein, 754 aa, Brassica napus
SLAGTTSSFSYKPVYLPSSRNSRNLQLSAGPARRNSSYPNPADDDPPEAPEDSMHGVSKFQQIQRQAARARKLEEEDFEKNRNTYLSAIADVEDAPETGSDDVESGGDLFSDIDRAISMKRSEFVKKGLLQPNPPKTASDKKINEEEEDDVTDVVDELDEEEVVDLDEIDKLTGLTEVSDEDDWVDEEGNPRINKTRSDHQFEFDLDDFGGSKARIVEPKFRFSLAELLDESKVVPISVYGDLDVEITGIQHDSRGVSAGDLFVCCENDGDSVLSEADKRGAVAVVASKEIDIEDTLGCRALVIVEDTEAVLAALASSFYRHPSKNMAVIGVTGTNGKTTTTYLIKSLYEAMGVRTGMFSTVSCYVHGDNKLDSPTTTSPDAVLVQSMMAKMLHNGTEALVMEASPQELASGKCDEVDFDIAVFTNLAREESGFRGTDEEYRDAEAKLFARMVDPERHRKVVNIDDPNAAFFVQQGNPEVPVVTFAMENTKADVHPLKFELSLFETQVLVNTPQGILEISSGLLGRHNIYNILAAVAVGIAVGAPLEDIVRGVEEVDAVPGRCELIDEEQAFGVIVDHANTPDGLSRLLDSVRELKPRRIITVIGCAGETERGKRPVMTKIATEKSDVTMLTSDNPGNEDPLDILDDMLAGIGWTMQEYLKHGEHDYYPPLANGHRLFLHDVRRVAVRCAVAMGEEGDMVVVAGKGHEAYQLEGDKKEFYDDREECREALQYVDELHQAGIDTSEFPWRLPESH

SEQ ID NO: 9512 - protein, 236 aa, Arabidopsis lyrata
MVSMTTSSSSYAPFSTVFNSSRPNSSATFLVPSFKFSTGISNFANLSNGFSLKSPINPGFLFKSRPFTVQARAAAEKTVHDFTVKDIDGKDVALNKFKGKVMLIVNVASRCGLTSSNYSELSHLYEKYKSQGFEILAFPCNQFGFQEPGSNSEIKQFACTRFKAEFPIFDKVDVNGPSTAPIYEFLKSNAGGFLGGLIKWNFEKFLIDKKGKVVERYPPTTSPFQIEKDIQKLLAA

SEQ ID NO: 9513 - protein, 235 aa, Eutrema parvulum
MASTSSYAPFSAIFNGSRPNPSVKPAAFLASSLKFSTVISNFANLSNGFSLKSPINPGYLFKSRYFNVQARAAAEKTVHDFTVKDIDGNDVSLNKFKGKVMLIVNVASRCGLTSSNYSELSHLYEKYKSQGFEILAFPCNQFGGQEPGSNPEIKQFACTRFKAEFPIFDKVDVNGPSTAPIYEFLKSNAGGFLGGLIKWNFEKFLIDKKGKVVERYPPTTSPFQIEKDIKKLLAA

SEQ ID NO: 9514 - protein, 235 aa, Eutrema halophilum
MASSSSYAPFSAIFNGSRPNPSVKPAAFLASSLKFSTVISNFANLSNGFSLKSPINLGYLFKSRYFNVQARAAAEKTVHDFTVKDIDGNDVSLNKFKGKVMLIVNVASRCGLTSSNYSELSHLYEKYKSQGFEILAFPCNQFGGQEPGSNPEIKQFACTRFKAEFPIFDKVDVNGPSTAPIYEFLKSNAGGFLGGLIKWNFEKFLIDKKGKVVERYPPTTSPFQIEKDIKKLLAA

SEQ ID NO: 9515 - protein, 235 aa, Eutrema parvulum
MASTSSYAPFSAVFNGSKPNPSLNPAAFLVPSLKFSTVISNFANLSNGFSLKSPINPGFLFKSRNFNVQARAAAEKTVHDFTVKDIDGNDVSLNKFKGKVMLIVNVASRCGLTSSNYSELSHLYEKYKSQGFEILAFPCNQFGGQEPGSNPEIKQFACTRFKAEFPIFDKVDVNGPSTAPIYQFLKSNAGGFLGDLVKWNFEKFLIDKKGKVVERYPPTTSPFQIEKDIKKLLAA

SEQ ID NO: 9516 - protein, 236 aa, Brassica juncea
MAFSSSYYSPFSALFDVSKPNPSLNPAAFLVPSLKFSTAISNFANLSNGFSLKSPINPGFLFKSRAFNVQARAAAEKTVHDFTVKDIDGNDVSLNKYKGKVMLIVNVASRCGLTSSNYSELSHLYEKYKSQGFEILAFPCNQFGGQEPGSNPEIKQFACTRFKAEFPIFDKVDVNGPSTAPIYQFLKSNAGGFLGDLIKWNFEKFLIDKKGKVVERYPPTTSPFQIEKDIKKLLAA

SEQ ID NO: 9517 - protein, 233 aa, Brassica rapa
MASSSSYYSPFSALFDVSKPNPSLNPAAFLVPSLKFSTAISNFANGFSLKSPINPGFLFKSRTFNVQARAAAEKTVHDFTVKDIDGNDVSLNKYKGKVMLIVNVASRCGLTSSNYSELSHLYEKYKSQGFEILAFPCNQFGGQEPGSNPEIKQFACTRFKAEFPIFDKVDVNGPSTAPIYQFLKSNAGGFLGDLIKWNFEKFLIDKKGKVVERYPPTTSPFQIEKDIKKLLAA

SEQ ID NO: 9518 - protein, 233 aa, Brassica napus
MAFSSSYYSPFSALFDVSKPNPSLNPAAFLVPSLKFSTAISNFANGFSLKSPINPGFLFKSRTFNVQARAAAEKTVHDFTVKDIDGNDVSLNKYKGKVMLIVNVASRCGLTSSNYSELSHLYEKYKSQGFEILAFPCNQFGGQEPGSNPEIKQFACTRFKAEFPIFDKVDVNGPSTAPIYQFLKSNAGGFLGDLIKWNFEKFLIDKKGKVVERYPPTTSPFQIEKDIKKLLAA

SEQ ID NO: 9519 - protein, 258 aa, Brassica oleracea
EFRHTNAGRKRKRINSSPVTKKMASSSSYYTPFSALFAVSKPNPSLNPAAFLVPSLKFSTAISNFANLSNGFSLKSPVNHGFLFKSRTFNVQARAAAEKTVHEFTVKDIDGNDVSLNKYKGKVMLIVNVASRCGLTSSNYSELSHLYEKYKSQGFEILAFPCNQFGGQEPGSNPEIKQFACTRFKAEFPIFDKVDVNGPSTAPIYQFLKSNAGGFLGDLIKWNFEKFLIDKKGKVVERYPPTTSPFQIEKDIKKLLAA

SEQ ID NO: 9520 - protein, 258 aa, Raphanus sativus
GSFTTLNASPNQKRINSSPVTKKMATSSSHSPFSAIFNVSKPNPSVNPAAFLVPSLKFSTAISNFANLSNGFSLKSPINPGFLFKSRTFNVQARAAAEKTVHDFTVKDIDGSDVSLNKYKGKVMLIVNVASRCGLTSSNYSELSHLYEKYKSQGLEILAFPCNQFGGQEPGSNTEIKQFACTRFKAEFPIFDKVDVNGPSTAPIYQFLKSNAGGFLGDLIKWNFEKFLIDKKGKVVERYPPTTSPFQIEKDIKKLLAD

SEQ ID NO: 9521 - protein, 236 aa, Brassica napus
MASSSSYYTPLSALFDVSKPNPSLNPAAFLVPSLKFSTAISNFANLSNGFSLKSPVNHGFLFKSRTFNVQARAAAEKTVHEFTVKDIDGNDVSLNKYKGKVMLIVNVASRCGLTSSNYSELSHLYEKYKSQGFEILAFPCNQFGGQEPGSNPEIKQFACTRFKAEFPIFDKVDVNGPSTAPIYQFLKSNAGGFLGDLIKWNFEKFLIDKKGKVVERYPPTTSPFQIEKDIKKLLAA

SEQ ID NO: 9522 - protein, 188 aa, Arabidopsis lyrata
MTNYGAIPTSSHASPVVDLESLSRAKHRIKAGLATRRPWRVMFDFHSMGLPHSVSDAFTRIKTNLAYFRMNYAIVVLIVIFFSLIWHPTSLIVFTVLVAVWIFLYFLRDEPIKLFRYQIDDRTVLIVLSVLTVVLLLLTNATFNIVGALVTGAVLVLIHAVVRKTEDLFLDEEAATTETSGLTSYPST

SEQ ID NO: 9523 - protein, 287 aa, Arabidopsis lyrata
MAYHQPYDPFYVYQPHYHPHHLPPQLPQFADEPGAINTLFVSGLPNDVKAREIHNLFRRRYGFESCQLKYTGRGDQVVAFATFTSHRFAMAAMNELNGVKFDPQTGSTLHIELARSNSRRKERPGSGPYVVIDNRNKELSKSQDDQSDEGDSDPDEVQEPRNSESPKENDNAKSEADSEPDSKAPSANGHLEKAYEGGSGARACSTLFIANLGPNCTEDELRQLLSRYSGFNILKIRARGGMPVAFADFEEIEQATDAMNELQGNLLSSSDRGGMHIEYARSKMRKQ

SEQ ID NO: 9524 - protein, 182 aa, Eutrema parvulum
MTNYGAIPTSSHASPVVDLESISRAKQRIKAGLSTRRAWRVMFDFHSMGLPRGVSDAFSTIKKNLGYFQTNYAIVVLIVIFLSLIKHPTSLIVLTVLVFVWIFLYFLRDEPIKVFRYQIDDQTVLICLSVISIVLLFLTNATLNIAGALLVGAVLVLIHAVVRKTEDLFLDEEAATTETLVG

SEQ ID NO: 9525 - protein, 287 aa, Arabidopsis thaliana
MAYHQPYDPFYVYQLHSHPHHLPPQLPLLADEPGAINTLFVSGLPNDVKAREIHNLFRRRHGFESCQLKYTGRGDQVVAFATFTSHRFALAAMNELNGVKFDPQTGSNLHIELARSNSRRKERPGSGPYVVIDNRNKEISKSQDDQSDEGDSDPDEVQEPGNSDSPKENDTTKSEADSEPDSKAPSANGHLEKASEGGSGARACSTLFIANLGPNCTEDELKQLLSRYPGFHILKIRARGGMPVAFADFEEIEQATDAMNHLQGNLLSSSDRGGMHIEYARSKMRKQ

SEQ ID NO: 9526 - protein, 188 aa, Arabidopsis thaliana
MANNDEITTSSHASPAVNHESISRAKQRIKDGLATRRSWRVMFDLHSTGLPHGVSDVFSRIKTNLAYFRSNYAIVILNVIFFSLIWHPTSLIVFTGLVFLWIFLYFLRDVPLKVFRFQIDDRAVLIGLSVITIVLLLLTNATFNIVAALMAGAVLVLIHAVIRKTDDLFLDEEAATTETSGLTSHPSS

SEQ ID NO: 9527 - protein, 426 aa, Arabidopsis lyrata
MASMSFALNRFSGLSSKTTLSADFDPSTRRSFLPPTRVGLKISSATESEPDLSVTVNGLKMPNPFVIGSGPPGTNYTVMKRAFDEGWGAVIAKTVSLDAAKVINVTPRYARLRTGSNGSAKTDVIGWQNIELISDRPLETMLKEFERLKKEYPDRILIASIMEEYNKTAWEELIDRVEQTGVDALEINFSCPHGMPERRMGAAVGQDCVLLDEVCGWINAKATVPVWAKMTPNITDITEPARVSLKSGCEGISAINTIMSVMGVDMKTLRPEPCVEGYSTPGGYSYKAVRPIALAKVMNIAKMMKSEFSENHSLSGIGGVETGYDAAEFILLGSNTVQVCTGVMMHGYGHVKTLCAELQDFMKQHNFSTIEEFRGHSLQYFTTHTDLVKRQKEAVEQRKAEKRGLKSDKDWTGDGFVKETESMVSN

SEQ ID NO: 9528 - protein, 428 aa, Eutrema parvulum
MASMSFALTRFSGLAAKTSLSADFDHSSRRNFLPPTRVGLKISSSSAESEPDLSVTVNGLKMPNPFVIGSGPPGTNYTVMKRAFDEGWGGVIAKTVSLDASKVINVTPRYARLRNGSNGSAKTDVIGWQNIELISDRPLETMLKEFKRLKQEYPDRILIASIMEEYNKTAWEELIDRVEQTGVDALEINFSCPHGMPERRMGAAVGQDCALLDEVCGWINAKATVPVWAKMTPNITDIAEPARVSLKSGCEGISAINTIMSVMGIDLKTLHPEPCVEGYSTPGGYSYKAVRPIALAKVMNIAKMIKSEFSEKDCSLSGIGGVETGYDAAEFILLGSNTVQVCTGVMVHGYGHVKTLCAELQDFMKQHNFSTIEDFRGHSLQYFTTHTDLVRRQKEAIEQRKAERRGLKSDKDWTGDGFVKETESMVSN

SEQ ID NO: 9529 - protein, 431 aa, Eutrema halophilum
MASMSFALTRFSGLTAKTSLSADFDPSSRRNFLPPTRVGLKISSSSDTSAESDPDLSVTVNGLKMPNPFVIGSGPPGTNYTVMKRAFDEGWGGVIAKTVSLDASKVINVTPRYARLRTGSNGSAKTDVFGWQNIELISDRPLETMLKEFKQLKQEYPDRILIASIMEEYNKTAWEELIDRVEQTGVDALEINFSCPHGMPERRMGAAVGQDCALLDEVCGWINAKATVPVWAKMTPNITDITEPARVSLKSGCEGISAINTIMSVMGIDLKTLHPEPCVEGYSTPGGYSYKAVRPIALAKVMNIAQMMKSEFSEKDCSLSGIGGVETGYDAAEFILLGSNTVQVCTGVMVHGYGHVKTLCAELQDFMKQHNFSTIEDFRGHSLQYFTTHTDLVRRQKEAIEQRKAERRGLKSDKDWTGDGFVKETESMVSN

SEQ ID NO: 9530 - protein, 431 aa, Brassica napus
MASMSSALTRFSGLSSKTTLSPDFDHSSRRTFLPPNRVGLKISSSSSAAADSEPDLSVTVNGLKMPNPFVIGSGPPGTNYTVMKRAFDEGWGAVIAKTVSLDASKVINVTPRYARLKTGSNGSAKTDVIGWQNIELISDRPLETMLKEFKQLKQEYPDRILIASIMEEYSKTGWEELIDRVEQTGVDALEINFSCPHGMPERRMGAAVGQDCALLEEVCGWINAKATVPVWAKMTPNITDITEPARVSLKSGCEGIAAINTIMSVMGIDLKTLHPEPCVEGYSTPGGYSYKAVRPIALAKVMNIAQMMKSEFGEKDYSLSGIGGVETGYDAAEFILLGSNTVQVCTGVMVHGYGHVKTLCAELQDFMKQHNFSTIEDFRGHSLQYFTTHTDLVRRQKEAIEQRKAERKGLKSDKDWTGDGFVKETESMVSN

SEQ ID NO: 9531 - protein, 424 aa, Brassica napus
MASMSFALTRFSGLSSKTTLSPDFDHSSRRNFLPPNRVSLKISSSTDSEPDLSVTVNGLKMPNPFVIGSGPPGTNYTVMKRAFDEGWGGVIAKTVSLDASKVINVTPRYARLRTGSAKTDVIGWQNIELISDRPLETMLKEFKQLKQEYPDRILIASIMEEYSKTGWEELIDRVEQTGVDALEINFSCPHGMPERRMGAAVGQDCALLEEVCGWINAKATVPVWAKMTPNITDITEPARVSLKSGCEGISAINTIMSVMGIDLKTLHPEPCVEGYSTPGGYSYKAVRPIALAKVMNIAQMMKSEFGEKDCSLSGIGGVETGYDAAEFILLGSNTVQVCTGVMVHGYGHVKTLCAELQDFMRQHNFSTIEDFRGHSLQYFTTHTDLVRRQKEAIEQRKAERRGLKSDKDWTGDGFVKETESMVSN

SEQ ID NO: 9532 - protein, 431 aa, Brassica napus
MASMSFALTRFSGLSSKSTLSPDFDHSSRRTFLPPNRVGLKISSSSSAAADSEPDLSVTVNGLKMPNPFVIGSGPPGTNYTVMKRAFDEGWGGVIAKTVSLDASKVINVTPRYARLKTGSNGSAKTDVIGWQNIELISDRPLETMLKEFKQLKQEYPDRILIASIMEEYSKTGWEELIDRVEQTGVDALEINFSCPHGMPERRMGAAVGQDCALLEEVCGWINAKATVPVWAKMTPNITDITEPARVSLKSGCEGISAINTIMSVMGIDLKTLHPEPCVEGYSTPGGYSYKAVRPIALAKVMNIAQMMKSEFGEKDYSLSGIGGVETGYDAAEFILLGSNTVQVCTGVMVHGYGHVKTLCAELQDFMRQHNFSTIEDFRGHSLQYFTTHTDLVRRQKEAIEQRKAERKGLKSDKDWTGDGFVKETESMVSN

SEQ ID NO: 9533 - protein, 432 aa, Brassica rapa
MASMSSALTRFSGLSSKTTLSPDFDHSSRRTFLPPNRVGLKISSSSSSAAPDSEPDLSVTVNGLKMPNPFVIGSGPPGTNYTVMKRAFDEGWGGVIAKTVSLDASKVINVTPRYARLKTGSNGSAKTDVIGWQNIELISDRPLETMLKEFKQLKQEYPDRILIASIMEEYSKTGWEELIDRVEQTGVDALEINFSCPHGMPERRMGAAVGQDCALLEEVCGWINAKATVPVWAKMTPNITDITEPARVSLKSGCEGIAAINTIMSVMGIDLKTLHPEPCVEGYSTPGGYSYKAVRPIALAKVMNIAQMMKSEFGGKDYSLSGIGGVETGYDAAEFILLGSNTVQVCTGVMVHGYGHVKTLCAELQDFMKQHNFSTIEDFRGHSLQYFTTHTDLVRRQKEAIEQRKAERKGLKSDKDWTGDGFVKETESMVSN

SEQ ID NO: 9534 - protein, 424 aa, Unknown
  Sequence found in Organisms: Brassica napus, Brassica rapa
MASMSFAVTRFSGLSSKTTLSPDFDHSPRRTSLPPNRVALKISSSTDSEPDLSVTVNGLKMPNPFVIGSGPPATNYTVMKRAFDEGWGGVIAKTVSLDASKVINVTPRYARLRTGSAKTDVIGWQNIELISDRPLETMLKEFKQLKQEYPDRILIASIMEEYSKTGWEELIDRVEQTGVDALEINFSCPHGMPERRMGAAVGQDCALLEEVCGWINAKATVPVWAKMTPNITDITEPARVSLKSGCEGISAINTIMSVMGIDLKTLHPEPCVEGYSTPGGYSYKAVRPIALAKVMNIAQMMKSEFGEKDCSLSGIGGVETGYDAAEFILLGSNTVQVCTGVMVHGYGHVKTLCADLQDFMRQHNFSTIEDFRGHSLQYFTTHTDLVRRQKEAIEQRKAERRGLKSDKDWTGDGFVKETESMVSN

SEQ ID NO: 9535 - protein, 424 aa, Cucumis sativus
MASFNLTQFRTKSPITNLALNPSRTGLTRPTRLGFRVVASGGAQAEPDLSVTVNGLNMPNPFVIGSGPPGTNYTVMKRAFDEGWGAVIAKTVSLDAAKVINVTPRYARLRADSNGSAKGQIIGWENIELISDRPLEIMLKEFKQLKEEYPDRILIASIMEEYNKAAWEELIDRVEQTGVDAFEINFSCPHGMPERRMGAAVGQDCALLEEVCGWINAKATIPVWAKMTPNITDISQPARVALKSGCEGIAAINTIMSVMGIDLKTLRPEPCVEGYSTPGGYSSKAVHPIALGKVLSIAKMMKAEFNDGDYSLSGIGGVETGGDAAEFILLGANTVQVCTGVMMHGYGVVKKLCAELQDFMKLHNFSSIEDFRGASLPYFTTHTDLVRRQREAIEQRKAVKKGLQSDKDWTGDGFVKETESMVSN

SEQ ID NO: 9536 - protein, 86 aa, Cucurbita pepo
MASLNFTQIRNKNPISDLTLTRSQTGLARRTRVGFKVVAASESPVEPDLSVTVNGLHMPNPFVIGSGPPGTNYTVMKRAFDEGGGL

SEQ ID NO: 9537 - protein, 424 aa, Citrullus lanatus
MASFNLTQFRTKNPIPNLALNRSRTDLTRRTRLGFRVVAAGEAQAEPDLSVTVNGLHMPNPFVIGSGPPGTNYTVMKRAFDEGWGAVIAKTVSLDAAKVINVTPRYARLRADSNGSAKGQIIGWENIELISDRPLETMLKEFKQLKEEYPDRILIASIMEEYNKAAWEELIDRVEQTGVDAFEINFSCPHGMPERRMGAAVGQDCALLEEVCGWINAKATIPVWAKMTPNITDISQPARVALKSGCEGIAAINTIMSVMGIDLKTLRPEPCVEGYSTPGGYSSKAVHPIALGKVLSIAKMMKAEFNDGDYSLSGIGGVETGGDAAEFILLGANTVQVCTGVMMHGYGLVKKLCAELKDFMKLHNFSSIEDFRGASLPYFTTHTDLVRRQREAIEQRKAVKKGLQSDKDWTGDGFVKETESMVSN

SEQ ID NO: 9538 - protein, 424 aa, Cucumis melo
MASFNLTQFRTKNPIPNLALNPSRTGLTRPTRLGFRVVASGKPQAEPDLSVTVNGLNMPNPFVIGSGPPGTNYTVMKRAFDEGWGAVIAKTVSLDAAKVINVTPRYARLRADSNGSAKGQIIGWENIELISDRPLETMLKEFKQLKEEYPDRILIASIMEEYNKAAWEELIDRVEQTGVDAFEINFSCPHGMPERRMGAAVGQDCALLEEVCGWINAKATIPVWAKMTPNITDISQPARVALKSGCEGIAAINTIMSVMGIDLKTLRPEPCVEGYSTPGGYSSKAVHPIALGKVLSIAKMMKAEFNDGDYSLSGIGGVEAGGDAAEFILLGANTVQVCTGVMMHGYGLVKKLCAELQDFMKLHNFSSIEDFRGASLPYFTTHMDLVRRQREAIEQRKAVKKGLQSDKDWTGDGFVKETESMVSN

SEQ ID NO: 9539 - protein, 424 aa, Euonymus alatus
MASLSLTQFRGRNSVADSVRIRPSPSVNRHGRVGFLRVVASDTQAEPDLSVTVNGLHMPNPFVIGSGPPGTNYTVMKRAFDEGWGAVIAKTVSLDAAKVINVTPRYARLRAGANGSAKGQIIGWENIELISDRPFETMLKEFTQLKKEYPDRILIASIMEEYNKAAWEELIYRVEQTGIDAIEINFSCPHGMPERKMGAAVGQDCALLEEVCGWINAKATVPVWAKMTPNITDITQPARVSLKSGCEGIAAINTIMSVMGINLNTLRPEPCVEGYSTPGGYSSKAVHPIALGKVMSIAKMMKAEFNDKDYSLSGIGGVETGGDAAEFILLGANTVQVCTGVMMHGYGLVKKLCAELKDFMKMHNFTSVEDFRGASLEYFTTHMDLVQRQQEAIQQRKAIKKGLKSDKDWTGDGFVKESESMVSN

SEQ ID NO: 9540 - protein, 271 aa, Cucurbita pepo
MASLDFTQIRTRNPMSELALNRSRMRLPRRNRVGFRVVAAGEGQAEPDLSVTVNGLHMPNPFVIGSGPPGTNYTVMKRAFDEGWGAVIAKTVSLDAAKVINVTPRYARLRADSNGSAKGQIIGWENIELISDRPLETMLKEFKQLKEEYPDRILIASIMEEYNKAAWEELIDRVEQTGVDAFEINFSCPHGMPERRMGAAVGQDCALLEEVCGWINAKATIPVWAKMTPNITDISQPARVALNRVARDSGYQHDHECNGNRSQDVTPRALC

SEQ ID NO: 9541 - protein, 423 aa, Cannabis sativa
MASLSFTHVKFKNPVADFARTRPKTGLACSNRVGFRVFASETQKEPDLSVTVNGLHMPNPFVIGSGPPGTNYTVMKRAFDEGWGAVIAKTVSLDAAKVINVTPRYARLRAGANGSTKGQIIGWQNIELISDRPLETMLKEFKQLKEEYPDRILIASIMEEYNKAAWEELIDRVEQTGVDAFEINFSCPHGMPERKMGAAVGQDCALLEEVCGWINAKATIPVWAKMTPNITDITEPARISLRSGCEGVAAINTIMSVMGINLDSLRPEPCVEGYSTPGGYSSKAVHPIALAKVMNIAKMMKAEFGDKDYSLSGIGGVETGGDAAEFILLGANSVQVCTGVMMHGYGLVKKLCDELKDFMRKHNFSSIEDFRGASLPYFTTHTDLVKRQQEAIKQRKAIKKGLQSDKDWTGDGFVKETESMVSN

SEQ ID NO: 9542 - protein, 421 aa, Vitis vinifera
MASLSFSPIRAKPSGGDFRPFRRQSLARPSRVAFRVFASEGQAEPDLSVTVNGLHMPNPFVIGSGPPGTNYTVMKRAFDEGWGAVIAKTVSLDAAKVINVTPRYARLRVGANGSAKGQIIGWENIELISDRPLETMLKEFKQLKEEYPDRILIASIMEEYDKAAWEELIDRVEQTGIDALEINFSCPHGMPERKMGAAVGQDCALLEEVCGWINAKATVPVWAKMTPNITDITQPARVALSSGCEGVSAINTIMSVMGINLNTLRPEPCVEGYSTPGGYSCKAVHPIALGKVMSIAKMMKAEFGEDYSLSGIGGVETGGDAAEFILLGANTVQVCTGVMMHGYGLVKKLCSELKDFMKMHNFSSIEDFRGASLEYFTTHTDLVQRQQEAIRQRKAIRQGLQSDKDWTGDGFVKESESMVSN

SEQ ID NO: 9543 - protein, 424 aa, Fagus grandifolia
MASLNLTQVRGKNFVPAEFARTRPSWNRPSRVGFKLFASESQAEPDLSVTVNGLHMPNPFVIGSGPPGTNYTVMKRAFDEGWGAVIAKTVSLDAAKVINVTPRYARLRAEPNGSGKAKGQIIGWENIELISDRPLETMLKEFKQLKEEYPDRILIASIMEEYNKAAWEELIDRVEQTGIDAIEVNFSCPHGMPERKMGAAVGQDCALLEEVCGWVNAKATVPVWAKMTPNITDIALPARVALRSGCEGIAAINTIMSVMGINLDTLRPEPCVEGYSTPGGYSSKAVHPIALAKVMSIAKMMKSEFGDKDHSLSGIGGVETGGDAAEFILLGANSVQVCTGVMMHGYGVVKKLCSELKDFMKAHNFSSIEDFRGVSLQYFTTHTDLVRRQKEAIEQRKAVRKGLQSDKDWTGDGFVKETESMVSN

SEQ ID NO: 9544 - protein, 424 aa, Fagus grandifolia
MASLNLTQVRGKNFVPAEFARTRPSWNRPSRVGFKVFASESQAEPDLSVTVNGLHMPNPFVIGSGPPGTNYTVMKRAFDEGWGAVIAKTVSLDAAKVINVTPRYARLRAEPNGSGKARGQIIGWENIELISDRPLETMLKEFKQLKEEYPDRILIASIMEEYNKAAWEELIDRVEQTGIDAIEVNFSCPHGMPERKMGAAVGQDCALLEEVCGWVNAKATVPVWAKMTPNITDIALPARVALRSGCEGIAAINTIMSVMGINLDTLRPEPCVEGYSTPGGYSSKAVHPIALAKVMSIAKMMKSEFGDKDHSLSGIGGVETGGDAAEFILLGANTVQVCTGVMMHGYGVVKKLCSELKDFMKAHNFSSIEDFRGVSLQYFTTHTDLVRRQKEAIEQRKAVRKGLQSDKDWTGDGFVKETESMVSN

SEQ ID NO: 9545 - protein, 424 aa, Euonymus alatus
MASLSLTQFRGRNSVADIVRIRPSPSVNRHGRVGFLRVVASDTQAEPDLSVTVNGLHMPNPFVIGSGPPGTNYTVMKRAFDEGWGAVIAKTVSLDAAKVINVTPRYARLRAGANGSAKGQIIGWENIELISDRPFETMLKEFTQLKKEYPDRILIASIMEEYNKAAWEEIIDRVEQTGIDAIEINFSCPHGMPERKMGAAVGQDCALLEEVCGWINAKATVPVWAKMTPNITDITQPARVSLKSGCEGIAAINTIMSVMGINLNTLRPEPCVEGYSTPGGYSSKAVHPIALAKVMSIAKMMKTEFNNKDYSLSGIGGVETGGDAAEFILLGANTVQVCTGVMMHGYGLVKKLCAELKDFMKMHNFTCVEDFRGASLEYFTTHMDLVQRQQEAIQQRKAIRKGLQSDKDWTGDGFVKESESMVSN

SEQ ID NO: 9546 - protein, 420 aa, Unknown
  Sequence found in Organisms: Gossypium hirsutum, Gossypium raimondii
MASLKFSHSNGNPFAVTRHVTPRSTRPTRIGFKIFASDNHSEPDLSVCVNGLQMPNPFVIGSGPPGTNYTVMKRAFDEGWGAVIAKTVSLDAAKVINVTPRYARLRAGANGSAKGQIIGWENIELISDRPLETMLKEFKQLKKEYPDRILIASIMEEYNKAGWEELIDRVEQTGIDAIEVNFSCPHGMPERKMGAAVGQDCALLEEVCGWINAKATVPVWAKMTPNITDITMPARVALSSGCEGVAAINTIMSVMGISLDTLRPEPCVEGYSTPGGYSCKAVHPIALAKVMSIAKMMKSEFNDKDYSLSGIGGVETGGDAAEFILLGANTVQVCTGVMMHGYGLVKKLCEELKDFMKKHNFKSIEDFRGVSLQYFTTHTDLVRRQQEAIRERKAIKKGLQSDKEWTGDGFVKETESMVSN

SEQ ID NO: 9547 - protein, 429 aa, Ricinus communis
MASLSLTQIRGKNSVAELAALSRPCFLATQRLKNRVGVLRVASDASETKVEPDLSVTVNGLKMPNPFVIGSGPPGTNYTVMKRAFDEGWGAVIAKTVSLDAEKVINVTPRYARLRAGVNGSAKGQIIGWENIELISDRPLETMLKEFKQLKEEYPERILIASIMEEYDKAAWEELIDRVEQTGIDAIEVNFSCPHGMPERKMGAAVGQDCGLLEEICGWVNAKATVPVWAKMTPNITDITEPARAALRSGCEGISAINTIMSVMGINLKTLRPEPCVEGYSTPGGYSSKAVHPIALGKVMNIAKMMKSEFNIDQYSLSGIGGVETGSDAAEFILLGANTVQVCTGVMMHGYGLVKKLNDELKDFMKMHNFSSIEDFRGVSLDYFTTHTDLVRRQKEAIEQRKAVKRGLQSDKDWTGDGFVKESESMVSN

SEQ ID NO: 9548 - protein, 425 aa, Populus trichocarpa
MASLSLTQIRGSNSVTEFTRLRLKTQRGRSKIGFLKVVGSQGQNQGEPDLSVTVNGLHMPNPFVIGSGPPGTNYTVMKRAFDEGWGAVIAKTVSLDAAKVINVTPRYARLRAGANGSAKGQIIGWENIELISDRPLETMLKEFKQLKEEYPDRILIASIMEEYNKAAWEELIDRVEQTGIDALEINFSCPHGMPERKMGAAVGQDCALLEEVCGWINAKATVPVWAKMTPNITDITQPARVSLKSGCEGVAAINTIMSVMGINLKTLRPEPCVEGYSTPGGYSSKAVHPIALGKVMNIAKMMKSEFDLEQYSLSGIGGVETGSDAAEFILVGANTVQVCTGVMMHGYGLVKKLCDELKDFMKMHNFSSIEDFRGASLEYFTTHMDLVRRQQEAIQQRKAIKKGLQSDKDWTGDGFVKETESMVSN

SEQ ID NO: 9549 - protein, 428 aa, Tropaeolum majus
MASMTLNLSRIGSGNRNSVAEFAATRQLSSTFSRPNRVGFRVFASQDQREPDLSVTVNGMHMPNPFVIGSGPPGTNYTVMKRAFDEGWGAVIAKTVSLDAAKVVNVTPRYARLRAGANGSAKGQIIGWQNIELISDRPLETMLNEFKQLKKEYPDRILIASIMEEYNKSAWEELVDRVEQTGIDAIEVNFSCPHGMPERKMGAAVGQDCMLLEEICGWINAKATVPVWAKMTPNITDITEPARVSLRSGCEGVAAINTIMSVMGIDLKTLRPEPCVEGYSTPGGYSCKAVHPIALAKVMNIAKMMKSEFNDRDYSLSGIGGVETGSDAAEFILLGADTVQVCTGVMMHGYGLVKKLCDELKEFMKTHNFSKIEDFRGASLDYFTTHTDLVRRQQEAIQKRKAIKKGLQSDKDWTGDGFVKETESMVSN

SEQ ID NO: 9550 - protein, 778 aa, Arabidopsis thaliana
MSIASSLTSATLCGASVFPKALACSSEFPINLPSPFESSKICLTSFPASRDLKKNATLNLTRNVGPVRCHAMQAGTRELKKFELSDVIEGKQFDREMLSAIFDVAREMEKIEKSSSQSEILKGYLMATLFYEPSTRTRLSFESAMKRLGGEVLTTENAREFSSAAKGETLEDTIRTVEGYSDIIVMRHFESGAARKAAATANIPVINAGDGPGEHPTQALLDVYTIQSEIGKLDGISVALVGDLANGRTVRSLAYLLAKFKDVKIYFVSPEIVKMKDDIKDYLTSSGVEWEESSDLMEVASKCDVVYQTRIQRERFGERLDLYEAARGKYIVDKDLLGVMQKKAIIMHPLPRLDEITADVDADPRAAYFRQAKNGLFIRMALLKLLLVGCFFIEFGRMIGNPVIQVPSSLMPSSSMIACPRVSPNGVPYLPPKPRTRHLVVRAASNSDAAHGQPSSDGGKNPLTVVLDVPRNIWRQTLKPLSDFGFGKRSIWEGGVGLFIVSGATLLALSWAWLRGFQMRSKFRKYQTVFELSHASGICTGTPVRIRGVTVGTIIRVNPSLKNIEAVAEIEDDKIIIPRNSLVEVNQSGLLMETMIDIMPRNPIPEPSVGPLHPECGKEGLIVCDRQTIKGVQGVSLDELVGIFTRIGREVEAIGVANTYSLAERAASVIEEARPLLKKIQAMAEDAQPLLSEFRDSGLLKEVECLTRSLTQASDDLRKVNSSIMTPENTELIQKSIYTLVYTLKNVESISSDILGFTGDEATRKNLKLLIKSLSRLL

SEQ ID NO: 9551 - protein, 397 aa, Arabidopsis lyrata
MSIASSLSSATLCGASVFPKALGYSSEFPSNLPSPSESSKICLTSFPASRDPKKNATWNLTRNVGPIQGIRCHAMQAGTRELKKFELSDVIEGKQFDREMLSAIFDVAREMEKIEKSSSQSEILKGYLMATLFYEPSTRTRLSFESAMKRLGGEVLTTENAREFSSAAKGETLEDTIRTVEGYSDIIVMRHFESGAARKAAATANIPVINAGDGPGEHPTQALLDVYTIQSEIGKLDGISVALVGDLANGRTVRSLAYLLAKFKDVKIYFVSPEIVKMKDDIKDYLTSNGVEWEESSDLMEVASKCDVVYQTRIQRERFGERLDLYEAARGKYIVDKDLLGVMQKKAIIMHPLPRLDEITADVDADPRAAYFRHADPRAAYFRQAKNGLFIRMVHGR

SEQ ID NO: 9552 - protein, 397 aa, Eutrema halophilum
MSITSLLTSATLSGASVFPKSLACSTDFSSNLSSPFDSSKICLTSFPASRNPKKNATWNLTPNTAPIQGIRCHAMQVETRESFTAGKKFQLSDVIEGQQFDREMLSAIFDVAREMEKIEKSSSQSEILKGYLMATLFYEPSTRTRLSFESAMKRLGGEVLTTENAREFSSAAKGETLEDTIRTVEGYSDIIVMRHFESGAARKAAATANIPVINAGDGPGEHPTQALLDVYTIQSEIGKLDGISVALVGDLANGRTVRSLAYLLAKFKDVKIYFVSPEIVKMKDDIKDYLTSNGVEWEESSDLMEVASKCDVVYQTRIQRERFGERLDLYEAARGKYIVDKDLLGVMQKNAVIMHPLPRLDEITPDVDADPRAAYFRQAKNGLFIRMALLKLLLVGW

SEQ ID NO: 9553 - protein, 797 aa, Eutrema halophilum
MSITSLLTSATLSGASVFPKSLACSTDFSSNLSSPFDSSKICLTSFPASRNPKKNATWNLTPNTAPIQGIRCHAMQVETRESFTAGKKFQLSDVIEGQQFDREMLSAIFDVAREMEKIEKSSSQSEILKGYLMATLFYEPSTRTRLSFESAMKRLGGEVLTTENAREFSSAAKGETLEDTIRTVEGYSDIIVMRHFESGAARKAAATANIPVINAGDGPGEHPTQALLDVYTIQSEIGKLDGISVALVGDLANGRTVRSLAYLLAKFKDVKIYFVSPEIVKMKDDIKDYLTSNGVEWEESSDLMEVASKCDVVYQTRIQRERFGERLDLYEAARGKYIVDKDLLGVMQKNAVIMHPLPRLDEITPDVDADPRAAYFRQAKNGLFIRMALLKLLLVGCSEKLELYCIKFSFLILILEMIGNPVIQVPSSLMPSSSMIACPRASPNGLPYLPPKPRTRHLLVRAASNSDAGHTQPSSDEGKNPLTVVLDVPRNIWRQTLRPLSDFGFGKRSVWEGGVGLFIVSGATLLALSWAWLRGFQMRSKFRKYQTVFELSQASGICTGTPVRIRGVTVGTVIRVNPSLKNIEAVAEIEDDKIIIPKNSLVEVNQSGLLMETMIDITPRDPIPEPSIGPLHPDCGEEGLIVCDRQKIKGEQGVSLDALVGIFTRIGREVEEIGVANTYSLAERAASVIEEAKPLLRKIQAMAEDAQPLLSEFRDSGLLKEVEYLTRSLTQASDDLRKVHSSIITPENTELIQKSIYTLVYTLKNVESISSDILGFTGDEATRKNLKLLIKSLSRLL

SEQ ID NO: 9554 - protein, 392 aa, Eutrema parvulum
MSITSSLTSANLCGASVFPKALACSIEFPSNLASPFESSKICLTTYPKKNATWSLTRNIASIQGTRCHAMQVETRESFMAGKKFQLNDVIEGQQFDREMLSAIFDVAREMEKIEKSSSQSEILKGYLMATLFYEPSTRTRLSFESAMKRLGGEVLTTENAREFSSAAKGETLEDTIRTVEGYTDIIVMRHFESGAARKAAATANIPVINAGDGPGEHPTQALLDVYTIQREIGKLDGISVALVGDLANGRTVRSLAYLLAKFKDVKIYFVSPEIVKMKDDIKDYLTSNGVEWEESSDLMEVASKCDVVYQTRIQRERFGERLDLYEAARGKYIVDKALLGVMQKNAVIMHPLPRLDEITPDVDADPRAAYFRQAKNGLFIRMALLKLLLIGW

SEQ ID NO: 9555 - protein, 397 aa, Eutrema parvulum
MSITSSLTPATLCGASVFPKALACTTEFPSNLSSPFDSSKICFTSFLVSKESKKSATWSLTRNTAPIQGIRCHAMQVETSERFMAGKKFQLSDVIEGQQFDKEMLSAIFDVAREMEKIEKSSSQSEILKGYLMATLFYEPSTRTRLSFESAMKRLGGEVLTTENAREFSSAAKGETLEDTIRTVEGYSDIIVIRHFESGAARKVAATANIPVINAGDGPGEHPTQALLDIYTIQSEIGKLDGISVALVGDLANGRTVRSLAYLLAKFKDVRIYFVSPEIVKMKDDIKDYLTSNGVEWEESSDLMGVASKCDIVYQTRIQRERFGERLDLYEAARGKYIVDKALLGVMQKKAVIMHPLPRLDEITPDVDADPRAAYFRQAKNGLFIRMALLKLLLVGW

SEQ ID NO: 9556 - protein, 323 aa, Brassica napus
MQVETRELFTAGKKFQLSDVIEGQQFDREMLSAIFDVAREMEKIEKSSSQSELLKGYLMATLFYEPSTRTRLSFESAMKRLGGEVLTTENAREFSSAAKGETLEDTIRTVEGYSDIIVMRHFESGAAKRAAATANIPVINAGDGPGEHPTQALLDIYTIQSEIGKLDDISVALVGDLANGRTVRSLAYLLAKFKDVKIYFVSPEIVKMKDDIKDYLTANGVEWEESSDLMEVASKCDVVYQTRIQRERFGERLDLYEAARGKYIVDKALLGVMRKNAVIMHPLPRLDEITPDVDADPRAAYFRQAKNGLFIRMALLKLLLVGW

SEQ ID NO: 9557 - protein, 568 aa, Arabidopsis lyrata
MASTPKLTSTISYSPSLQILCKKLPIAIHLPSSSSSSSSSSFLSLPKTLTSLYSLRPRIAVLSNHRYYHSRRFSVRASTDNGADSERHYDFDLFTIGAGSGGVRASRISTSFGASAAVCELPFSTISSDTAGGVGGTCVLRGCVPKKLLVYASKYSHEFEDSHGFGWKYETEPSHDWTTLIANKNAELQRLTGIYKNILSKANVKLIEGRGKVIDPHTVDVDGKIYTTRNILIAVGGRPFIPDIPGKEFAIDSDAALDLPSKPKKIAIVGGGYIALEFAGIFNGLNSEVHVFIRQKKVLRGFDEDVRDFVGEQMSLRGIEFHTEESPEAIIKAGDGSLSLKTSKGTVEGFSHVMFATGRKPNTKNLGLENVGVKMAKNGAIEVDEYSQTSVPSIWAVGDVTDRINLTPVALMEGGALAKTLFQNEPTKPDYRAVPCAVFSQPPIGTVGLTEEQAIEQYGDVDVFTSNFRPLKATLSGLPDRVFMKLIVCANTNKVLGVHMCGEDSPEIIQGFGVAVKAGLTKADFDATVGVHPTAAEEFVTMRTPTRKIRKDSSEGKASPEAKTAAGV

SEQ ID NO: 9558 - protein, 565 aa, Eutrema parvulum
MASTPKLTTTISSSPSLQILCRKLPIAIHLPSSSSSSSCRSLPKTLSFFSSLRPRVALVSNNRYYPSRRFSVRAQNDNGADSERQYDFDLFTIGAGSGGVRASRFATSFGASAAVCELPFSTISSETAGGVGGTCVLRGCVPKKLLVYASKYTHEFEDSHGFGWKYDTEPSHEWSTLIANKNAELQRLTGIYKNILKNANVKLIEGRGKVIDPHTVDVDGKIYTTRNILIAVGGRPFIPDIPGSEFAIDSDAALDLPSKPKKIAIVGGGYIAVEFAGIFNGLNSEVHVFIRQKKVLRGFDEDVRDFVGEQMSLRGIEFHTEESPEAIIKSGDGSFSLKTSKGTVDGFSHVMFATGRKPKTKNLGLENAGVKMAKNGAIEVDEYSRTSVPSIWAVGDVTDRINLTPVALMEGGALAKTLFQNEPTKPDYRAVPCAVFSQPPIGTVGLTEEQAIEQYGDIDVFTSNFKPLKATLSGLPDRVFMKLIVCASTNKVLGVHMCGEDSPEIIQGFGVAVKAGLTKADFDATVGVHPTAAEEFVTMRTPTRKIRKDSSEGKASTEAKTAAGV

SEQ ID NO: 9559 - protein, 561 aa, Brassica napus
MASTPKLTTTISSSPSLQILCRKLPIAINLPSSSTSRSLPKTLSHLSSLRPRVASVSNHRYYSSSRRFSVRAQNDNGADSDRHYDFDLFTIGAGSGGVRASRFATSYGASAAVCELPFSTISSDTAGGVGGTCVLRGCVPKKLLVYASKYTHEFEDSHGFGWKYDTEPSHDWSTLIANKNAELQRLTGIYKNILNNANVKLIEGRGKVIDPHTVDVDGKIYTTRNILIAVGGRPFIPDIPGREFAIDSDAALDLPSKPKKIAIVGGGYIALEFAGIFNGLNSEVHVFIRQKKVLRGFDEDVRDFVGEQMSLRGIEFHTEESPEAIIKAGDGSFSLKTSKGTVDGFSHVMFATGRKPNTKNLGLENVGVKLAKNGAIEVDEYSRTSVPSIYAVGDVTDRINLTPVALMEGMALAKTLFQNDPTKPDYRAVPCAVFAQPPIGTVGLTEEQAIEQYGDIDVFTSNFKPLKATLSGLPDRVFMKLIVCANTNKVLGVHMCGEDSPEIIQGFGVAVKAGLTKADFDATVGVHPTAAEEFVTMRTPTRKIRKESSEGKANVEAKTAV

SEQ ID NO: 9560 - protein, 564 aa, Eutrema parvulum
MASTPKLTTTISSSPSLQILRRKLPIAIHLPSSSSSQSCRSLHKTLSYFSSLRPRVALMSNNGYNPSRRFSVSAQNDNGAESERQYDFDLFTIGAGSGGVRASRFATSYGASAAVCELPFSTISSETTGGVGGTCVLRGCVPKKLLVYASKYSHEFEDSHGFGWKYDTEPSHDWSTLIANKNAELQRLTGIYKNILKNANVKLIEGRGKVIDPHTVDVDGKIYTTRNILIAVGGRPFIPDIPGSEFAIDSDAALDLPSKPKKIAIVGGGYIAVEFAGIFNGLNSEVHVFIRQKKVLRGFDEDVRDFVGEQMSLRGIEFHTEESPEAIIKSADGSLSLKTTKGTIEGFSHVMFATGRKPNTKNLGLENAGVKMAKNGAIEVDEYSRTSVPSIWAVGDVTDRINLTPVALMEGGALAKTLFQNEPTKPDYRAVPCAVFSQPPIGTVGLTEEQAIEQYGDIDVFTSNFKPLKATLSGLPDRVFMKLIVCASTNKVLGVHMCGEDSPEIIQGFGVAVKAGLTKADFDATVGVHPTAAEEFVTMRTPTRKIRKDSEGKASTEAKTAAGV

SEQ ID NO: 9561 - protein, 562 aa, Brassica napus
MASTPKLTTTISSSPSLQILCRKLPIAINLPSSPTSRSLPKTLSYLSSLRPRVASVSNHRYYSSSSRRFSVRAQNDNGADSDRHYDFDLFTIGAGSGGVRASRFATSYGASAAVCELPFSTISSDTAGGVGGTCVLRGCVPKKLLVYASKYTHEFEDSHGFGWKYDTEPSHDWSTLIANKNAELQRLTGIYKNILNNANVKLIEGRGKVIDPHTVDVDGKIYTSRNILIAVGGRPFIPDIPGREFAIDSDAALDLPSKPEKIAIVGGGYIALEFAGIFNGLGSEVHVFIRQKKVLRGFDEDVRDFVGEQMSLRGIEFHTEESPEAIIKAGDGSFSLKTSKGTVDGFSHVMFATGRKPNTKNLGLENVGLKLAKNGAIEVDEYSRTSVPSIFAVGDVTDRINLTPVALMEGMALAKTLFQNDPTKPDYRAVPCAVFSQPPIGTVGLTEEQAIEQYGDIDVFTSNFKPLKATLSGLPDRVFMKLIVCANTNKVLGVHMCGEDSPEIIQGFGVAVKAGLTKADFDATVGVHPTAAEEFVTMRTPTRKIRKESSEGKASVEAKTAV

SEQ ID NO: 9562 - protein, 563 aa, Brassica rapa
MASTPKLTTTISSSPSLQILCRKLPIAINLPSSPTSPSLPKTLSHLSSLRLRAASVSNHRYYSSSSSRRFSVRAQNDNGADSDRHYDFDLFTIGAGSGGVRASRFATSYGASAAVCELPFSTISSETAGGVGGTCVLRGCVPKKLLVYASKYTHEFEDSQGFGWKYDTEPSHDWSTLIANKNAELQRLTGIYKNILNNANVKLIEGRGKVIDPHTVDVDGKIYTSRNILIAVGGRPFIPDIPGREFAIDSDAALDLPSKPEKIAIVGGGYIALEFAGIFNGLGSEVHVFIRQKKVLRGFDEDVRDFVGEQMSLRGIEFHTEESPEAIIKAGDGSFSLKTSKGTVDGFSHVMFATGRKPNTKNLGLENVGLKLAKNGAIEVDEYSRTSVPSIFAVGDVTDRINLTPVALMEGMALAKTLFQNDPTKPDYRAVPCAVFSQPPIGTVGLTEEQAIEQYGDIDVFTSNFKPLKATLSGLPDRVFMKLIVCANTNKVLGVHMCGEDSPEIIQGFGVAVKAGLTKADFDATVGVHPTAAEEFVTMRTPTRKIRKESSEGKASVEAKTAV

SEQ ID NO: 9563 - protein, 563 aa, Eutrema halophilum
MASTPKLTTTISSSPSLQILRRKLPIAIPLPSSSSQSSRSFHRTLSYFSSLRSRVALMSNHGYNPSRRFSVSAQNDNGAESERHYDFDLFTIGAGSGGVRASRFATSYGASAAVCELPFSTISSETTGGVGGTCVLRGCVPKKLLVYASKYSHEFEDSHGFGWKYDTEPSHDWSTLIANKNTELQRLTGIYKNILKNANVKLIEGRGKVIDPHTIDVDGKIYTSRNILIAVGGRPFIPDIPGREFAIDSDAALDLPSKPKRIAIVGGGYIALEFAGIFNGLNSEVHVFIRQKKVLRGFDEDVRDFVGEQMSLRGIEFHTEESPEAIIKSADGSLSLKTTKGTIEGFSHVMFATGRKPNTKNLGLENAGVKLAKNGAIEVDEYSRTSVPSIWAVGDVTDRINLTPVALMEGMALAKTVFQNEPTKPDYRAVPCAVFSQPPIGTVGLTEEQAIEQYGDIDVYTSNFKPLKATLSGLPDRVFMKLIVCANTNKVLGVHMCGEDSPEIIQGFGVAVKAGLTKADFDATVGVHPTASEEFVTMRTPTRKIRKDSEGKASPEAKTAAGV

SEQ ID NO: 9564 - protein, 272 aa, Brassica napus
MATTPKLTTTLSSSPSLQTLCRKLPISTHLPSSSSSSSISRYLSSLRPRLTLLSNHRYNPSRRFSLRAQNDNVADSDLRYDFDLFTIGAGSGGVRASRFATSFGASAAVCELPFSTISSDTAGGVGGTCVLRGCVPKKLLVYASKYTHEFEDSHGFGWKYDTDPSHDWRTLIANKNAELQLLTGIYKNILNNANVKLIEGRGKVIDPHTVDVDGRIYTTRNILIAVGGRPFIPDIPGREFAIDSDAALDLPSCQEDCHRWWWLHSPGVCGNL

SEQ ID NO: 9565 - protein, 544 aa, Brassica rapa
MATTPKLTTTISSSPSLQTTLCRKLPISIHLPSSSLRPRLTLLSNHRYNPSRRAQNDYGTDSDLRYDFDLFTLGAGSGGVRASRFATSFGASAAVCELPFSTISSDTAGGVGGTCVLRGCVPKKLLVYASKYTHEFEDSHGFGWKYDTDPSHDWTTLIANKNAELQRLTGIYKNILNNANVKLIEGRGKVIDPHTVDVDGRIYTTRNILIAVGGRPFIPDIPGREFAIDSDAALDLPSKPKKIAIVGGGYIALEFAGIFNGLSSEVHVFIRQKKVLRGFDEDVRDFVGEQMSLRGIEFHTEESPEAIIKSGDGSFSLKTSKGTVDGFSHVMFATGRKPNTKNLGLENVGVKLAKNGAIEVDEYSRTSVPSIWAVGDVTDRINLTPVALMEGGALAKTLFQNEPTKPDHRAVPCAVFSQPPIGTVGLTEEQAIEQYGDIDVFTSHFKPLKATLSGLPDRVFMKLIVCANTDKVLGVHMCGEDSPEIIQGFGVAVKAGLTKADFDATVGVHPTAAEEFVTMRTPTRKIRKGSSEVLFLNKQKKKAY

SEQ ID NO: 9566 - protein, 569 aa, Cleome gynandra
MASTPKLTTTISSSPSLQLLFCKKLPISLPLYSSSSSAAASSSSSSFPSLPKTLPSLYSQHRRISFISQPCRRFTVRAENENGAETGRQYDFDLFTIGAGSGGVRASRFAANFGASVAVCELPFSTISSETAGGVGGTCVLRGCVPKKLLVYASKFSHEFDESNGFGWKYETEPTHEWRTLIANKNAELQRLTGIYKNILNNANVTLIEGRGKIIDPHTVDVDGKIYTARNILIAVGGRPFIPDIPGKEYVIDSDAALDLPSKPEKIAIIGGGYIALEFAGIFNGLKSEVHVFIRQKKVLRGFDEEVRDFVGEQMSLRGIEFHVEESPQAVIKSGDGSLSLKTNKGIVEGFSHIMFATGRRANTTNLGLESVGVKMTKNGAIEVDEYSQTSVPSIWAIGDVTDRINLTPVALMEGGALAKTMFQNEPTKPDYRAVPSAVFSQPPIGQVGLTEEQAIEQYGDIDVFTANFRPLKATLSGLPDRVFMKLIVCAKTNKVLGVHMCGEDSPEIIQGFAVAVKAGLTKTDFDATVGVHPTAAEEFVTMRTPTRKIRRNSSEGKASPEIKAATGV

SEQ ID NO: 9567 - protein, 564 aa, Cleome spinosa
MASAPKLTTTITSSPSMQLLLCKKLPISIPLPSSSSFSSSRFLSLPKSLTSLSSRHRRFSFVSQPCRRLTVRANSENGADTGRQFDFDLFTIGAGSGGVRASRFAANFGASVAVCELPFSTISSETTGGVGGTCVLRGCVPKKLLVYASKFSHEFDESNGFGWKYETEPTHEWSTLIANKNAELQRLTGIYKNILNNANVTLIEGRGKVIDPHTVDVDGKIYTARNILIAVGGRPFIPEIPGREYVIDSDAALDLPSKPEKIAIIGGGYIALEFAGIFNGLKSEVHVFIRQKKVLRGFDEEIRDFVGEQMSLRGIEFHTEESPQAVVKSADGSLSLKTNKGTVEGFSQIMFATGRRANTKNLGLEDIGVKMTKNGAIEVDEYSRTSVSSIWAIGDVTDRINLTPVALMEGGALAKTLFENEPTKPDYRAVPSAVFSQPPIGQVGLTEEQAIEQYGDIDVFTANFRPLKATLSGLPDRAFMKLIVCAKTNKVLGIHMCGEDSPEIIQGFAVAVKAGLTKADFDSTVGVHPTAAEEFVTMRTPTRKIRRDSPEGKTNPEAKAAAGV

SEQ ID NO: 9568 - protein, 529 aa, Arabidopsis lyrata
MECVGARNFAAMAVSTFPSWSSRRKFPVVNRYSFRNIRFGLCSVRASGGGSSGSESCVVVREDFADEEDFVKAGGSEILFVQMQQNKDMDEQSKLVDKLPPISIGDGALDLVVIGCGPAGLALAAESAKLGLKVGLIGPDLPFTNNYGVWEDEFNDLGLQKCIEHVWRDTIVYLDDDNPITIGRAYGRVSRRLLHEELLRRCVESGVSYLSSKVDSITEASDGLRLVACDDNNVIPCRLATVASGAASGKLLQYEVGGPRVCVQTAYGVEVEVENSPYDPEQMVFMDYRDYTNEKVRSLEAEYPTFLYAMPMTKTRLFFEETCLASKDVMPFDLLKKKLMLRLDTLGIRILKTYEEEWSYIPVGGSLPNTEQKNLAFGAAASMVHPATGYSVVRSLSEAPKYASVIAEILEQETQTTSFTKQINSNISRQAWDTLWPPERKRQRAFFLFGLALIVQFDTEGIRSFFRTFFRLPKWMWQGFLGSTLTSGDLVLFALYMFIISPNNLRKGLINHLISDPTGATMIKTYLKV

SEQ ID NO: 9569 - protein, 528 aa, Eutrema parvulum
MECVGARNFAAMAVTAFPSWSSRRRFPVVKRYSFRNFRCGLCRVRASGGGAGSGSESCVAVREDFADEEDFVKAGGSEILFVQMQQNKDMDEQSKLADKLPPISLGDGALDLVVIGCGPAGLALAAESAKLGLKVGLIGPDLPFTNNYGVWEDEFNDLGLQKCIEHVWRDTLVYLDDDNPITIGRAYGRVSRRLLHEELLRRCVESGVSYLCSKVESITEASDGLRLVACEQNTVIPCRLATVASGAASGKLLLYEVGGPRVSVQTAYGVEVEVENSPYDPEQMVFMDYRDYTNQKVRSLEAEYPTFLYAMPMTKTRVFFEETCLASKDVMPFDLLKKKLMLRLETLGIRILKIYEEEWSYIPVGGSLPNTEQKNLAFGAAASMVHPATGYSVVRSLSEAPKYASVIADILKQETTSFAKHINSNISRQAWDTLWPQERKRQRAFFLFGLALILQLDIEGIRSFFHTFFRLPKWMWQGFLGSTLTSGDLVLFAFYMFIIAPNNLRKGLINHLVSDPTGATMIRTYLRV

SEQ ID NO: 9570 - protein, 528 aa, Eutrema halophilum
MECVGARNFAAMAVTAFPSRSSRRNFPVVKRYSFRNFRCGLCRVRAKGGGAGSGSESCVAVREDFADDEDFVKAGGSEILFVQMQQNKDMDEQSKLVDKLPPISVGDGALDLVVIGCGPAGLALAAESAKLGLKVGLIGPDLPFTNNYGVWEDEFNDLGLQKCIEHVWRDTIVYLDDDNPITIGRAYGRVSRRLLHEELLRRCVESGVSYLSSKVESITEASNGLRLVACEENTVVPCRLATVASGAASGKLLQYEVGGPRVSVQTAYGVEVEVENSPYDPEQMVFMDYRDYTNQEVRSLEAEYPTFLYAMPMTKTRVFFEETCLASKDVMPFDLLKKKLMLRLDTLGIRVLKTYEEEWSYIPVGGSLPNTEQKNLAFGAAASMVHPATGYSVVRSLSEAPSYASVIADILKQETTSYTKHINSNISRQAWDTLWPQERKRQRAFFLFGLALILQLDIEGIRSFFHTFFRLPKWMWRGFLGSTLTSGDLVLFAFYMFIIAPNNLRKGLINHLVSDPTGATMIRTYLRV

SEQ ID NO: 9571 - protein, 531 aa, Brassica napus
MECVGARNFAAMAVTAFPSRSSRRRFPAVKRYSFKNLRCGLCSRVVRASVGGGGGGSGGESCVAVREDYADEEDFVKAGGSEIMFVQMQQNKDMDEQSKLVDKLPPISVGDGGALDLVVIGCGPAGLALAAESAKLGLKVGLIGPDLPFTNNYGVWEDEFNDLGLQKCIEHVWRDTIVYLDDDNPITIGRAYGRVNRRLLHEELLRRCAESGVSYLSSKVESITEAPNGLRLVSCERNTVVPCRLATVASGAASGKLLQYELGGPRVCVQTAYGVEVEVENSPYDPEQMVFMDYRDYTNQKVRSLEAEYPTFLYAMPMTKTRVFFEETCLASKDVMPFDLLKKKLMLRLETLGIRILKTYEEEWSYIPVGGSLPNTEQKNLAFGAAASMVHPATGYSVVRSLSEAPNYASVIADILKHDTTSFTKHINISRQAWDTLWPSERKRQRAFFLFGLALIVQLDIGGIRSFFHTFFRLPKWMWQGFLGSTLTSGDLVLFAFYMFIIAPNNLRKGLINHLVSDPTGATMIKTYLRV

SEQ ID NO: 9572 - protein, 531 aa, Brassica rapa
MECVGARNFAAMAVTAFPSRTSRRGFPVVKRYSFKNLRCGLCSRVVRASVGGGGGGSGSESCVAVREDYADEEDFVKAGGSEIMFVQMQQNKDMDEQSKLVDKLPPISVGDGGALDLVVIGCGPAGLALAAESAKLGLKVGLIGPDLPFTNNYGVWEDEFNDLGLQKCIEHVWRDTIVYLDDNNPISIGRAYGRVNRRLLHEELLRRCAESGVSYLSSKVESITEAPNGLRLVSCERNTVVPCRLATVASGAASGKLLQYELGGPRVCVQTAYGVEVEVENSPYDPEQMVFMDYRDYTNQKVRSLEAEYPTFLYAMPMTKTRVFFEETCLASKDVMPFDLLKRKLMLRLETLGIRILKTYEEEWSYIPVGGSLPNTEQKNLAFGAAASMVHPATGYSVVRSLSEAPNYASVIADILKHDTTSFTKHINISRQAWDTLWPSERKRQRAFFLFGLALIVQLDIGGIRSFFHTFFRLPKWMWQGFLGSTLTSGDLVLFAFYMFIIAPNNLRKGLINHLVSDPTGATMIKTYLRV

SEQ ID NO: 9573 - protein, 532 aa, Brassica napus
MECVGARNLAATAVTDFPSWSSSRKNYPVVNRYSFSNLRCGLCRVKASGGGAGSGIESCVAVREDFADKEDFVKAGGSEILYVQMQQNKDMDEQSKLVDKLPPISTGEGGGALDLVVIGCGPAGLALAAESAKLGLKVGLIGPDLPFTNNYGVWEDEFNDLGLQKCIEHVWRDTLVYLDDDNPITIGRAYGRVSRRLLHEEFLRRCVESGVSYLSSKVESITEAPDGLRLVSCEQNTLVPCRLATVASGAASGKLLQYEVGGPRVCVQTAYGLEVEVEKSPYDPEQMVFMDYRDYTNEKIRSLEAEYPTFLYAMPMTKTRVFFEETCLASKDVMPFDLLKKKLLLRLETLGIRILKTYEEEWSYIPVGGSLPNTEQKNLAFGAAASMVHPATGYSVVRSLSEAPKYASVIANILKHETTTSFTRHINTNISRQAWDTLWPPERKRQRAFFLFGLALIVQLDIEGIRCFFHTFFRLPKWMWRGFLGSTLTSGDLVLFAFYMFIIAPNNLRKGLINHLISDPTGATMIKTYLKV

SEQ ID NO: 9574 - protein, 534 aa, Brassica napus
MECVGARNLAATAVTAFPSWSSSRKNYPVDNRYSFSNLRCGLCRVKASGGGAGSGIESCVAVREDFADEEDFVKAGGSEILYVQMQQNKDMDEHEQSKLVDKLPPISTGEGGGALDLVVIGCGPAGLALAAESAKLGLKVGLIGPDLPFTNNYGVWEDEFNDLGLQKCIEHVWRDTLVYLDDDNPITIGRAYGRVSRRLLHEELLRRCVESGVSYLSSKVESITEAPDGLRLVSCEQNTLVPCRLATVASGAASGKLLQYEVGGPRVCVQTAYGLEVEVEKSPYDPEQMVFMDYRDYTKEKIRSLEAEYPTFLYAMPMTKTRVFFEETCLASKDVMPFDLLKKKLMLRLETLGIRILKTYEEEWSYIPVGGSLPNTEQKNLAFGAAASMVHPATGYSVVRSLSEAPKYASVIANILKHETTTSFTRHINTNISRQAWDTLWPPERKRQRAFFLFGLALIVQLDIEGIRCFFHTFFRLPKWMWRGFLGSTLTSGDLVLFAFYMFIIAPNNLRKGLINHLISDPTGATMIKTYLKV

SEQ ID NO: 9575 - protein, 526 aa, Brassica napus
MECVGARNFAATAVTSFPSWSSSRKNFPVANRYSFSNLRCGFVKVRASGGGAGSGCVAVREDYADEEDFVKAGGSEILYVQMQQNKDMDEQSKLVDKLPPISTGGEGGGALDLVVIGCGPAGLALAAESAKLGLKVGLIGPDLPFTNNYGVWEDEFNDLGLQKCIEHVWRDTLVYLDDDNPITIGRAYGRVSRRLLHEELLRRCVESGVSYLSSKVESITEAPDGLRLVSCEQNTLVPCRLATVASGAASGKLLQYEVGGPRVCVQTAYGLEVEVENSPYDPEQMVFMDYRDYTNEKIRSLEAEYPTFLYAMPMTKTRETCLASKDVMPFDLLKKKLMLRLDTLGIRILKTYEEEWSYIPVGGSLPNTEQKNLAFGAAASMVHPATGYSVVRSLSEAPKYASVIANILKHETTTSFTRHINTNISRQAWDTLWPPERKRQRAFFLFGLALIVQLDIEGIRCFFHTFFRLPKWMWRGFLGSTLTSGDLVLFAFYMFIIAPNTLRKGLINHLISDPTGATMIKTYLKV

SEQ ID NO: 9576 - protein, 525 aa, Raphanus sativus
  misc_feature (34)..(34): Xaa can be any naturally occurring amino acid
  misc_feature (178)..(178): Xaa can be any naturally occurring amino acid
  misc_feature (234)..(234): Xaa can be any naturally occurring amino acid
  misc_feature (312)..(312): Xaa can be any naturally occurring amino acid
MECVNFAATAVTAFPSWSSSRRIFPVVNRCSFSXLRLCTVRASGGGAGSGCVAVREDYADEEDFVKAGGSEILYVQMQQNKDMDEQQSKLVDKLPPISIGDGGGTLDLVVIGCGPAGLALAAESAKLGLKVGLIGPDLPFTNNYGVWEDEFNDLGLQKCIEHVWRDTIVYLDDGNPIXIGRAYGRVSRRLLHEELLRRCVESGVSYLSSKVESITEAPDGLRLVSCEHNTVVPXRLATVASGAASGKLLQYEVGGPRVCVQTAYGVEVEVENSPYDPEQMVFMDYRDYTNEKVRSLEAEYPTFLYAMPMTKXRVFFEETCLASKDVMPFDLLKNKLMLRLDTLGIRILKTYEEEWSYIPVGGSLPDTEQKNLAFGAAASMVHPATGYSVVRSLSEAPKYASVIADILNQESTTSFTRHINTNISRQAWDTLWPPERKRQRAFFLFGLALIVQLDIEGIRCFFHTFFRLPKWMWRGFLGSTLTSGDLVMFAFYMFIIAPNALRKGLINHLISDPTGATMIKTYLRV

SEQ ID NO: 9577 - protein, 530 aa, Brassica rapa
MECVGARNFAATAVIAFPSWSSSRKNYPVVNRYSFSNLRCGFVKVRASGGGAGSGCVAVREDYADEEDFVKAGGSEILYVQMQQNKDMDEQSKLVDKLPPISTGGEGGGALDLVVIGCGPAGLALAAESARLGLKVGLIGPDLPFTNNYGVWEDEFNDLGLQKCIEHVWRDTLVYLDDDNPITIGRAYGRVSRRLLHEELLRRCVESGVSYLSSKVESITEAPDGLRLVSCEQNTLVPCRLATVASGAASGKLLQYEVGGPRVCVQTAYGLEVEVENSPYDPEQMVFMDYRDYTNEKIRSLEAEYPTFLYAMPMTKTRVFFEETCLASKDVMPFDLLKKKLLLRLETLGIRILKTYEEEWSYIPVGGSLPNTEQKNLAFGAAASMVHPATGYSVVRSLSEAPKYASVISDILKQESTTSFTRHINTNISRQAWDTLWPPERKRQRAFFLFGLALIVQLDIQGIRCFFHTFFRLPKWMWRGFLGSTLTSGDLVLFAFYMFIIAPNNLRKGLINHLISDPTGATMIKTYLRV

SEQ ID NO: 9578 - protein, 528 aa, Brassica napus
MECVGARNLAATAVTAFPSWSSSRKNYPVDNRYSFSNLRCGFVKVRASGGGAGSGCVAVREDYADEEDFVKAGGSEILYVQMQQNKDMDEHEQSKLVDKLPPISTGEGGGALDLVVIGCGPAGLALAAESAKLGLKVGLIGPDLPFTNNYGVWEDEFNDLGLQKCIEHVWRDTLVYLDDDNPITIGRAYGRVSRRLLHEELLRRCVESGVSYLSSKVESITEAPNGLRLVSCERNTVVPCRLATVASGAASGKLLQYELGGPRVCVQTAYGVEVEVENSPYDPEQMVFMDYRDYTNQKVRSLEAEYPTFLYAMPMTKTRVFFEETCLASKDVMPFDLLKKKLMLRLETLGIRILKTYEEEWSYIPVGGSLPNTEQKNLAFGAAASMVHPATGYSVVRSLSEAPNYASVIADILKHDTTSFTKHINISRQAWDTLWPSERKRQRAFFLFGLALIVQLDIGGIRSFFHTFFRLPKWMWQGFLGSTLTSGDLVLFAFYMFIIAPNNLRKGLINHLVSDPTGATMIKTYLRV

SEQ ID NO: 9579 - protein, 367 aa, Brassica napus
MATALNAAVSLTSSKSSSLPATSCAIAPDRIRFGKGAFYYKSNSVVTSRRVVSVRAEVTTDTPPAVKKVEKESKKNEEGVITNKYRPKEPYTGKVLLNTKITADDAPGETWHMVFSHQGEIPYREGQSVGVIADGIDKNGKPHKVRLYSIASSALGDLGNSETVSLCVKRLVYTNDAGEVVKGVCSNFLCDLKPGSDVKLTGPVGKEMLMPKDPNATVIMLATGTGIAPFRSFLWKMFFEKHDDYKFNGLAWLFLGVPTTSSLLYTEEFDKMKAKAPENFRVDYAISREETNDKGEKMYIQTRMAQYAPELWELLKKDNTFVYMCGLKGMEKGIDDIMVSLAANDGIDWFDYKKQLKKAEQWNVEVY

SEQ ID NO: 9580 - protein, 367 aa, Brassica rapa
MATALNAAVSLTSSKSSSLPATSCAIAPERIRFGKGGFSYKSNNVATSRRVFSVRAEVTTDTPPAVKKVEKESKKNEEGVITNKYRPKEPYTGKVLLNTKITADDAPGETWHMVFSHQGEIPYREGQSVGVIADGIDKNGKPHKVRLYSIASSALGDLGNSETVSLCVKRLVYTNDAGEVVKGVCSNFLCDLKPGSDVKLTGPVGKEMLMPKDPNATVIMLATGTGIAPFRSFLWKMFFEKHDDYKFNGLAWLFLGVPTTSSLLYTEEFDKMKAKAPENFRVDYAISREETNDKGEKMYIQTRMAQYAPELWELLKKDNTFVYMCGLKGMEKGIDDIMVSLAANDGIDWFDYKKQLKKAEQWNVEVY

SEQ ID NO: 9581 - protein, 366 aa, Brassica juncea
MASTLNAAVSLTSSKSSSLPATSCAIAPERIRFGKGAFYYKSNNVATSRRVVSVRAEVTTDTPPVKKVEKESKKNEEGVITNKYRPKEPYTGKVLLNSKITADDAPGETWHMVFSHEGEIPYREGQSVGVIADGIDKNGKPNKVRLYSIASSALGDLGNSETVSLCVKRLVYTNDAGEVVKGVCSNFLCDLKPGSDVKLTGPVGKEMLMPKDPNATVIMLATGTGIAPFRSFLWKMFFEKHDDYKFNGLAWLFLGVPTTSSLLYTEEFDKMKAKAPENFRVDYAISREETNDKGEKMYIQTRMAQYAPELWELLKKDNTFVYMCGLKGMEKGIDDIMVSLAAKDGIDWLDYKKQLKKAEQWNVEVY

SEQ ID NO: 9582 - protein, 367 aa, Raphanus sativus
MATTLNAAVSLTCSKSSSLPATSCAIAPERVRFGKGAFYYKSNNVVTSRRVVSVRAEVTTDTPPPVKKVEKESKKNEEGVITNKYRPKEPYTGKVLLNTKITADDAPGETWHMVFSHQGEIPYREGQSVGVIADGVDKNGKPNKVRLYSIASSALGDFGNSETVSLCVKRLVYTNDAGEVVKGVCSNFLCDLKPGSDVKLTGPVGKEMLMPKDPNATVIMLATGTGIAPFRSFLWKMFFEKHDDYKFNGLAWLFLGVPTTSSLLYTEEFGKMKAKAPENFRVDYAISREETNDKGEKMYIQTRMAQYAPELWELLKKDNTFVYMCGLKGMEKGIDDIMVSLAANDGIDWFDYKKQLKKAEQWNVEVY

SEQ ID NO: 9583 - protein, 367 aa, Brassica oleracea
MASTLNAAVSLTASKSSSLPATSCAIAPDRIRFAKGAFYYKSNNVVTSRRVVSVRAEVTTTDTPPVKKVGKESKKNEEGVITNKYRPKEPYTGKVLLNTKITADDAPGETWHMVFSHQGEIPYREGQSVGVIADGIDKNGKPHKVRLYSIASSALGDLGNSETVSLCVKRLVYTNDAGEVVKGVCSNFLCDLKPGSDVKLTGPVGKEMLMPKDPNATVIMLATGTGIAPFRSFLWKMFFEKHDDYKFNGLAWLFLGVPTTSSLLYTEEFDKMKAKAPENFRVDYAISREQANDKGEKMYIQTRMAQYAPELWELLKKDNTFVYMCGLKGMEKGIDDIMVSLAANDGIDWFDYKKQLKKAEQWNVEVY

SEQ ID NO: 9584 - protein, 367 aa, Brassica napus
MASTLNAAVSLTASKSSSLPATSCAIAPDRIRFAKGAFYYKSNNVVTSRRVVSVRAEVTTTDTPPVKKVEKESKKNEEGVITNKYRPKEPYTGKVLLNTKITADDAPGETWHMVFSHQGEIPYREGQSVGVIADGIDKNGKPHKVRLYSIASSALGDLGNSETVSLCVKRLVYTNDAGEVVKGVCSNFLCDLKPGSDVKLTGPVGKEMLMPKDPNATVIMLATGTGIAPFRSFLWKMFFEKHDDYKFNGLAWLFLGVPTTSSLLYTEEFDKMKAKAPENFRVDYAISREQANDKGEKMYIQTRMAQYAPELWELLKKDNTYVYMCGLKGMEKGIDDIMVSLAANDGIDWFDYKKQLKKAEQWNVEVY

SEQ ID NO: 9585 - protein, 226 aa, Brassica napus
MASTLNAAVSLTSSKSSSLPATSCAIAPDRIRFAKGAFNYKSNNVVTSRRMVSVRAEVTTTDTPPVKKVEKESKKNEEGVITNKYRPKEPYTGKVLLNTKITADDAPGETWHMVFSHQGEIPYREGQSVGVIADGIDKNGKPNKVRLYSIASSALGDLGNSETVSLCVKRLVYTNDAGEVVKGVCSNFLCDLKPGSDVKLTGPVGKECLCLRIQTLLLLCLPQGQE

SEQ ID NO: 9586 - protein, 367 aa, Brassica rapa
MASTLNAAVSLTSSKSSSLPATSYAIAPDRIRFAKGAFNYKSNNVVTSRRLVSVRAEVTTTDTPPVKKVKKESKKNEEGVITNKYRPKEPYTGKVLLNTKITADDAPGETWHMVFSHQGEIPYREGQSVGVIADGIDKNGKPNKVRLYSIASSALGDLGNSETVSLCVKRLVYTNDAGEVVKGVCSNFLCDLKPGSDVKLTGPVGKEMLMPKDPNATVIMLATGTGIAPFRSFLWKMFFEKHDDYKFNGLAWLFLGVPTTSSLLYTDEFDKMKAKAPENFRVDYAISREQANDKGEKMYIQTRMAQYAPELWELLKKDNTFVYMCGLKGMEKGIDDIMVSLAANDGIDWFDYKKQLKKAEQWNVEVY

SEQ ID NO: 9587 - protein, 364 aa, Raphanus sativus
MASTLNAAVSLTSSKSSSFPATSCAIAPERIRFGKGAFNYKSNSVVTSRRVVSVRAEVTTDAPPVKKVEKESKKNEEGVITNKYRPKEPYTGKVLLNTKITADDAPGETWHMVFSHAGEIPYREGQSVGVIADGVDKNGKPNKVRLYSIASSALGDLGNSETVSLCVKRLVYTNDAGEVVKGVCSNFLCDLKPGSDVKLTGPVGKEMLMPKDPNATVIMLATGTGIAPFRSFLWKMFFEKHDDYKFNGLAWLFLGVPTTSSLLYTEEFDKMKAKAPENFRVDYAISREQANDKGEKMYIQTRMAQYAPELWELLKKDNTFVYMCGLKGMEKGIDDIMVSLAANDGIDWFDYKKQLKKAEQWNVE

SEQ ID NO: 9588 - protein, 365 aa, Eutrema parvulum
MATTLNAAFSLTSSKSSSLPATSCAIAPERIRFGKGAFYYKSNNVVTGKRVVSVRAEITTDAPVKKVEKVSKKNEEGVITNTYRPKEPYTGKVLLNTKITADDAPGETWHMVFSHEGKIPYREGQSVGVIADGVDKNGKPNKVRLYSIASSALGDLGNSETVSLCVKRLVYTNDAGEVVKGVCSNFLCDLTPGSDVKLTGPVGKEMLMPKDPNATVIMLATGTGIAPFRSFLWKMFFEKHDDYKFNGLAWLFLGVPTTSSLLYTEEFDKMKAKAPENFRVDYAISREQANDKGEKMYIQTRMAQYAPELWELLKKDNTFVYMCGLKGMEKGIDDIMVSLAAKDGIDWFDYKKQLKKAEQWNVEVY

SEQ ID NO: 9589 - protein, 136 aa, Brassica napus
MASTLNAAVSLTSSKSSSLPATSCAIAPDRIRFAKGAFNYKSNNVVTSRRMVSVRAEVTTTDTPPVKKVEKESKKNEEGVITNKYRPKEPYTGKVLLNTKITADDAPGETWHMVFSHQGEIPYREGTICWCDCRWY

SEQ ID NO: 9590 - protein, 365 aa, Eutrema halophilum
MATTLNAAVSLTSSKSSSLPATSCAIAPEWIRFGKGAFQYKSNNAVTGKRLVSVRAEATTDTPVKKVEKVSKKNEEGVVTNKYRPKEPYTGKVLLNTKITADDAPGETWHMLFSHEGEIPYREGQSVGVIADGIDKNGKPHKVRLYSIASSALGDLGNSETVSLCVKRLVYTNDAGETVKGVCSNFLCDLKPGSEVKLTGPVGKEMLMPKDPNATVIMLATGTGIAPFRSFLWKMFFEKHDDYKFNGLAWLFLGVPTTSSLLYQEEFAKMKAKAPENFRVDYAISREQANEKGEKMYIQTRMAQYAAELWELLKKDNTFVYMCGLKGMEKGIDDIMVSLAAKDGIDWFDYKKQLKKAEQWNVEVY

SEQ ID NO: 9591 - protein, 350 aa, Brassica juncea
SLPATSYAIAPDRIRFAKGAFNYKSNNVVTSRRMVSVRAEVTTTDTPPVKKVEKESKKNEEGVITNKYRPKEPYTGKVLLNTKITADDAPGETWHMVFSHQGEIPYREGQSVGVIADGIDKNGKPNKVRLYSIASSALGDLGNSETVSLCVKRLVYTNDAGEVVKGVCSNFLCDLKPGSDVKLTGPVGKEMLMPKDPNATVIMLATGTGIAPFRSFLWKMFFEKHDDYKFNGLAWLFLGVPTTSSLLYTEEFDKMKAKAPENFRVDYAISREQANDKGEKMYIQTRMAQYAPELWELLKKDNTFVYMCGLKGMEKGIDDIMVSLAANDGIDWFDYKKQLKKAEQWNVEVY

SEQ ID NO: 9592 - protein, 369 aa, Arabidopsis thaliana
MATTMNAAVSLTSSNSSSFPATSCAIAPERIRFTKGAFYYKSNNVVTGKRVFSIKAQITTETDTPTPAKKVEKVSKKNEEGVIVNRYRPKEPYTGKCLLNTKITADDAPGETWHMVFSHQGEIPYREGQSVGVIADGIDKNGKPHKVRLYSIASSALGDLGNSETVSLCVKRLVYTNDQGETVKGVCSNFLCDLAPGSDVKLTGPVGKEMLMPKDPNATVIMLATGTGIAPFRSFLWKMFFEKHDDYKFNGLAWLFLGVPTTSSLLYQEEFDKMKAKAPENFRVDYAISREQANDKGEKMYIQTRMAQYAAELWELLKKDNTFVYMCGLKGMEKGIDDIMVSLAANDGIDWFDYKKQLKKAEQWNVEVY

SEQ ID NO: 9593 - protein, 369 aa, Arabidopsis lyrata
MTTTMNAAVSLTSSNSSSFPATSCAIAPERIRFSKGAFYYKSNNVVTSKRVFSIRAQITTETDTPTPAKKVEKVSKKNEEGVIVNRYRPKEPYIGKCLLNTKITADDAPGETWHMVLSHEGEIPYREGQSVGVIADGIDKNGKPHKVRLYSIASSALGDLGNSETVSLCVKRLVYTNDQGETVKGVCSNFLCDLAPGSDVKLTGPVGKEMLMPKDPNATVIMLATGTGIAPFRSFLWKMFFEKHDDYKFNGLAWLFLGVPTTSSLLYQEEFDKMKAKAPENFRVDYAISREQANDKGEKMYIQTRMAQYAAELWELLKKDNTFVYMCGLKGMEKGIDDIMVSLAANDGIDWFDYKKQLKKAEQWNVEVY

SEQ ID NO: 9594 - protein, 339 aa, Brassica napus
KSSSLPATSCAIAPERIRFGKGGFSYKSNNVATSRRVVSVRAEVTTDTPPAVKKVEKESKKNEEGVITNKYRPKEPYTGKVLLNTKITADDAPGETWHMVFSHQGEIPYREGQSVGVIADGIDKNGKPHKVRLYSIASSALGDLGNSETVSLCVKRLVYTNDAGEVVKGVCSNFLCDLKPGSDVKLTGPVGKEMLMPKDPNATVIMLATGTGIAPFRSFLWKMFFEKHDDYKFNGLAWLFLGVPTTSSLLYTEEFDKMKAKAPENFRVDYAISREETNDKGEKMYIQTRMAQYAPELWELLKKDNTFVYMCGLKGMEKGIDDIMVSLAANDGIDWFDYK

SEQ ID NO: 9595 - protein, 326 aa, Brassica juncea
AVSLTSSKSSSLPATSCAIAPDRIRFGKGAFYYKNNNVVTSRRVVSVRAEVTTDTPPVKKVEKESKKNEEGVITNKYRPKEPYTGKVLLNTKITADDAPGETWHMVFSHQGEIPYREGQSVGVIADGIDKNGKPHKVRLYSIASSALGDLGNSETVSLCVKRLVYTNDAGEVVKGVCSNFLCDLKPGSNVKLTGPVGKEMLMPKDPNATVIMLATGTGIAPFRSFLWKMFFEKHDDYKFNGLAWLFLGVPTTSSLLYTEEFDKMKAKAPENFRVDYAISREETNDKGEKMYIQTRMAQYAPELWELLKKDNTFVYMCGLKGMEKGI

SEQ ID NO: 9596 - protein, 184 aa, Brassica napus
AAVSLTSSKSSSLPATSCAIAPDRIRFAKGAFNYKSNNVVTSRRMVSVRAEVTTTDTPPVKKVEKESKKNEEGVITNKYRPKEPYTGKVLLNTKITADDAPGETWHMVFSHQGEIPYREGQSVGVIADGIDKTEPNRSGFTPLQAALLEISATLKLVSLCVKRLVYTNDAGSRLLKESATNFLV

SEQ ID NO: 9597 - protein, 363 aa, Cleome spinosa
MAATLYSSVSLTSSNSSSLPATSFSIAPEIIRFGKGACYNRSNASTGKRLVSIRAQVAAEAPAKAEKVSKKNEEGVVVNKYRPKEPYTGKCLLNTKITADDAPGETWHMVFTTEGEIPYREGQSIGVIPDGIDKNGKPHKVRLYSIASSAIGDLGDSKSVSLCVKRLVYTNEQGEIVKGVCSNFLCDLKPGADVKITGPLGKEMLMPKDPNATVIMLATGTGIAPFRSFLWKMFFEKHSDYEFNGLAWLFLGVPTTSSLLYQEEFDKMKAKAPENFRVDYAISREQTNEKGEKMYIQTRMAEYADELWELLKKDNTYIYMCGLKGMEKGIDDIMVSLAARDGIDWIEYKKQMKKAEQWNVEVY

SEQ ID NO: 9598 - protein, 362 aa, Cleome gynandra
MAATLNASVSLTSSNSSLPATRFSIAPERIRIGKGALYYRSNVSASKGVVPIRAQVASEAPAKAEKVSKKDEEGIVVNKYRPKEPFTGKCLLNTKITGDDAPGETWHMVFTTEGEIPYREGQSIGVIADGVDKNGKPHKVRLYSIASSAIGDLGDSKTVSLCVKRLVYTNEQGEIVKGVCSNFLCDLKPGADVKITGPLGKEMLMPKDPNATVIMLATGTGIAPFRSFLWKMFFEKHENYKFNGLAWLFLGVPTTSSLLYKEEFDKMKTRAPENLRVDYAISREQTNEKGEKMYIQTRMAEYADELWELLKKDNTYVYMCGLKGMEKGIDDIMVNLAARDGIDWLEYKKQMKKAEQWNVEVY

SEQ ID NO: 9599 - protein, 365 aa, Catharanthus roseus
MATAVSAAVSLPSSKSSASLSSSRTSLISSERVNFNKVPLYYKNVSVGGKLVSVRAQVTTEAPAVKVEKHSKKQEEGVVVNKYRPKEPYIGRCLLNTKITGDDAPGETWHMVFSTEGEIPYREGQSIGVIADGVDKNGKPHKLRLYSIASSALGDFGDSKTVSLCVKRLVYTNDKGELVKGVCSNFLCDLKPGAEVKITGPVGKEMLMPKDPNATVVMLATGTGIAPFRAFLWKMFFEKHDDYKFNGLAWLFLGVPTSSSLLYKEEFEKMKEKNPDNFRVDFAVSREQTNEKGEKMYIQTRMAQYAEELWELLKKDNTFVYMCGLKGMEKGIDDIMVSLAERDGIDWFDYKKQLKKAEQWNVEVY

SEQ ID NO: 9600 - protein, 363 aa, Juglans hindsii x Juglans regia
MATAVTSTVSFPSSKSASLPSRTSIISPERISFKKVPLHYRDVSVGGRVVSVRAQVTIEAPAKKVEKESKKMEEGVVVNKYKPKEPYVGRCLLNTKITADDAPGETWHMVFSTDGEVPYREGQSIGVIADGIDKNGKPHKLRLYSIASSALGDFGDSKTVSLCVKRLVYTNDKGEVVKGVCSNFLCDLKPGYEVKITGPVGKEMLMPKDPTATIIMLATGTGIAPFRSFLWKMFFEKHDDYKFNGLAWLFLGVPTSSSLLYKEEFEKMKEKAPENFRLDFAVSREQTNEKGEKMYIQTRMAQYAEELWELLKKDNTYVYMCGLKGMEKGIDEIMLSLAARDGIDWLDYKKKLKKAEQWNVEVY

SEQ ID NO: 9601 - protein, 363 aa, Malus domestica
MAAAVTAAVSFPSSKSSALPTRTSIISPDRITLKKVPLYNSNAGGRVVSIRAQVTTTEPAPPAKVVKESKKQEEGVVVNKFKPKNPYTGRVLLNTKITADDAPGETWHMVFSTEGEVPYREGQSIGVIPDGIDKNGKPHKLRLYSIASSALGDFGDSKTVSLCVKRLVYTNDAGEIVKGVCSNFLCDLKPASEVTITGPVGKEMLMPKDPNATVIMLATGTGIAPFRAFLWKMFFEKHEDYKFNGLAWLFLGVPTSSSLLYKEEFEKMKEKAPENFRLDFAVSREQTNEKGEKMYIQTRMAQYAEELWELLKKDNTYVYMCGLKGMEKGIDDIMVSLAAKDGIDWMDYKKQLKKAEQWNVEVY

SEQ ID NO: 9602 - protein, 362 aa, Castanea mollissima
MATAVTATVSFPSSKSSSLSSRTSIILPERIPFKKVPLQYRDVSVGGRVVSIRAQVTTEAPAKVAKESKKMEEGVVVNKYKPKNPYTGRCLLNTKITGDDAPGETWHMVFSTEGEIPYREGQSVGVIPDGIDKNGKPHKLRLYSIASSAIGDFGDSKTVSLCVKRLVYTNDAGEIVKGVCSNFLCDLKPGAEVKMTGPVGKEMLMPKDPNATIIMLATGTGIAPFRSFLWKMFFEKHDDYKFNGLAWLFLGVPTSSSLLYKEEFEKMKEKAPENFRLDFAVSREQKNEKGEKMYIQTRMAQYAEELWQLLKKDNTFVYMCGLKGMEKGIDDIMISLAARDGIDWLDYKKQLKRAEQWNVEVY

SEQ ID NO: 9603 - protein, 362 aa, Quercus alba
MATAVTATVSFPSSKSSSLSSRTSIISPERISFKKVPLQYRDVSVGGRVVSIRAQVTTEAPAKVAKESKKMEEGVVVNKYKPKNPYTGRCLLNTKITGDDAPGETWHMVFSTEGEIPYREGQSVGVIPDGIDKNGKPHKLRLYSIASSAIGDFGDSKTVSLCVKRLVYTNDAGEIVKGVCSNFLCDLKAGAEVKMTGPVGKEMLMPKDPNATIIMLATGTGIAPFRSFLWKMFFEKHDDYKFNGLAWLFLGVPTSSSLLYKEEFEKMKEKAPENFRLDFAVSREQKNEKGEKMYIQTRMAQYAEELWQLLKKDNTFVYMCGLKGMEKGIDDIMVSLAARDGIDWADYKKQLKRAEQWNVEVY

SEQ ID NO: 9604 - protein, 363 aa, Vitis vinifera
MATAVNAAVSLPSSKSSSLPIRNHIIVSPERINFNKCFLYSRNVCVGRKVVTIKAQVTTEAPAKVEKVSKKNDEGVVVNKFRPKNPYIGKCLLNTKITGDDAPGETWHMVFTTEGEVPYREGQSIGVIPDGIDKNGKPHKLRLYSIASSALGDFGDTKTVSLCVKRLVYTNDQGEIVKGVCSNFLCDLKPGADVKITGPVGKEMLMPKDPNATVIMLATGTGIAPFRSFLWKMFFEKYEDYKFKGLGWLFLGVPTTSSLLYKDEFEKMKEKAPENFRVDYAVSREQTNEKGEKMYIQTRMAQYAEELWELLKKDNTYVYMCGLKGMEKGIDDIMVSLAARDGIDWTEYKRQLKKSEQWNVEVY

SEQ ID NO: 9605 - protein, 292 aa, Primula obconica
MEEGVIVNKYRPKDPYIGKCLLNSKITADDAPGETWHMVFSTEGEVPYREGQSIGVIADGIDKNGKPHKLRLYSIASSALGDLGDSKTVSLCVKRLVYTNDQGEIVKGVCSNFLCDLKPGADVKITGPVGKEMLMPKDPNATIIMLATGTGIAPFRSFLWKMFFEKHEDYEFKGLAWLFLGVPTSSSLLYKDEFTKMKEKAPENFKVDYAVSREESNEKGEKMYIQTRMAQYAEELWELLKKDNTYVYMCGLKGMEKGIDDIMISLAAKDGIDWIEYRKQLKKAEQWNVEVY

SEQ ID NO: 9606 - protein, 362 aa, Vigna unguiculata
MATAVTAAVSFPASKSTSLPTRTSITAPDRIFFKKVSLQYRDVSVSGRVVSVRAQVTTEAPAKVEKESKKQDEGVVVNKFRPKDPYVGRCLLNTKITGDDAPGETWHMVFSTEGEVPYREGQSIGVIADGVDKNGKPHKLRLYSIASSALGDFGDSKTVSLCVKRLVYTDEKGEIVKGVCSNFLCDLKPGAEVKITGPVGKEMLMPKDPNATVIMLATGTGIAPFRSFLWKMFFEKHDDYKFNGLAWLFLGVPTSSSLLYKEEFEKMKEKAPENFRLDFAVSREQTNEKGEKMYIQTRMAEYAEELWELLKKDNTFVYMCGLKGMEQGIDEIMVSLAAKDGIDWFDYKKQLKKAEQWNVEVY

SEQ ID NO: 9607 - protein, 362 aa, Quercus alba
MATAVTATGSFPSSKSSSLSSRTSIISPERISFKKVPLQYRDVSVGGRVVSIRAQVTTEAPAKVAKESKKMEEGVVVNKYKPKNPYTGRCLLNTKITGDDAPGETWHMVFSTEGEIPYREGQSVGVIPDGIDKNGKPHKLRLYSIASSAIGDFGDSKTVSLCVKRLVYTNDAGEIVKGVCSNFLCDLKAGAEVKMTGPVGKEMLMPKDPNATIIMLATGTGIAPFRSFLWKMFFEKHDDYKFNGLAWLFLGVPTSSSLLYKEEFEKMKEKAPENFRLDFAVSREQKNEKGEKMYIQTRMAQYAEELWQLLKKDNTFVYMCGLKGMEKGIDDIMVSLAARDGIDWADYKKQLKRAEQWNVEVY

SEQ ID NO: 9608 - protein, 365 aa, Mesembryanthemum crystallinum
MAAAVTAAVSFPSTKSTPLSTRTSSVITHEKINFNKVPLYYRNVSVGGKVGTIRAVASDVEAPVAKVEKHSKKMEEGVIVNKYKPKNPYTGRCLLNTKITGDDAPGETWHMVFSHEGEIPYREGQSVGVIPEGIDKNGKPHKLRLYSIASSALGDFGDSKTVSLCVKRLIYTNDNGEIVKGVCSNFLCDLKPGSEVVLTGPVGKEMLMPKDPNATIIMLATGTGIAPFRSFLWKMFFEKHDDYKFNGLAWLFLGVPTSSSLLYKEEFEKMKEKAPENFRLDFAVSREQTNEKGEKMYIQTRMAQYDRELWELLKKDNTYVYMCGLKGMEKGIDDIMVSLAAEDGIDWFDYKKQLKKAEQWNVEVY

SEQ ID NO: 9609 - protein, 364 aa, Tabernaemontana elegans
MATAVSAAVSLPSSKSSASLPTTRTSIISTERVNFNKVPLYYRNVSAGGKVVSIRAQVTTEAPVKVEKVSKKNEEGVIVNKFKPKNPYIGRCLLNTKITGDDAPGETWHMVFSTEGEIPYREGQSVGVIADGIDKNGKPHKLRLYSIASSAIGDFGDSKTVSLCVKRLVYTNENGEIVKGVCSNFLCDLKPGAEVKLTGPVGKEMLMPKDPNATIIMLATGTGIAPFRGFLWKMFFEKHDDYKFNGLAWLFLGVPTSSSLLYKEEFEKMKEKNPDNFRLDFAVSREQTNEKGEKMYIQTRMAQYAEELWELLKKDNTFVYMCGLKGMEKGIDDIMLSLAAKDGIDWLEYKRQLKKEEQWNVEVY

SEQ ID NO: 9610 - protein, 361 aa, Citrus clementina
MAAVSAAVSLPTSKSTSLPTRTSIISPDRITFRKVPFYYKDVSTGGRVVSVRAQVTTEAPAKVEKESKKMEEGVIVNKFKPKTPYIGRCLLNTKITGDDAPGETWHMVFSTEGEVPYKEGQSIGVIADGVDKNAKPHKLRLYSIASSALGDFGDSKTVSLCVKRLVYTNENGEIVKGVCSNFLCDLKPGAEVKITGPVGKEMLMPRDPNATVIMLATGTGIAPFRGFLWKMFFEKHEDYKFNGLAWLFLGVPTSSSLLYKEEFEKMKEKAPENFRLDFAVSREQKNEKGEKMYIQTRMAEYANELWELLKKDNTYVYMCGLRGMEKGIDDIMVSLAANDGIDWLDYKKQLKKAEQWNVEVY

SEQ ID NO: 9611 - protein, 362 aa, Capsicum annuum
MATAVSAAVSLPSSKSTSFPTRTSIISPEKINFNKVPLYYRNVSGGSRLVTIRAQVTTEAPAKVEKISKKQDEGVVVNKFRPKEPYIGRCLLNTKITGDDAPGETWHMVFSTEGEIPYREGQSIGVIADGVDANGKPHKLRLYSIASSALGDFGDSKTVSLCVKRLVYTNDKGEEVKGVCSNFLCDLKPGADVKITGPVGKEMLMPKDPNATVIMLGTGTGIAPFRSFLWKMFFEKHDDYKFNGLAWLFLGVPTSSSLLYKEEFEKMKEKAPENFRLDFAVSREQTNEKGEKMYIQTRMAQYAEELWTLLKKDNTFVYMCGLKGMEQGIDDIMSSLAAKEGIDWADYKKQLKKAEQWNVEVY

SEQ ID NO: 9612 - protein, 266 aa, Castanea mollissima
MASAVNASVSLPSSTSSSLTTRTSTVYSERVSFSKNIFYSRNVYVGKKMVQIRAQVTTETPAKVQKVSKKDDEGVIVNKFKPKEPYIGKCLLNSKITADDAPGETWHMVFTTEGEVPYREGQSIGIIADGIDKNGKPHKLRLYSIASSALGDFGNSKTVSLCVKRLVYTNDKGEIVKGVCSNFLCDLKPGADVKITGPVGKEMLMPKDPNATVIMLATGTGIAPFRSFLWKMFFEKHENYKFNGLAWLFWVFQQLAHCSTRRSLRR

SEQ ID NO: 9613 - protein, 443 aa, Secale cereale
MLASRVWSRSASQSSPASPRALASAAASAARSLLLRSGMPLSRDPPGLAERPCAGIAEAGVRTADAPPPCSSSGDSRGEHACRRRTYQRNPVSSRAKPVGGNHHVLYASYLSQNQQNYRCFSAYSDQDRIEAANRIIHGLPRCVKIVEVGPRDGLQNEKNTVPTPVKIELIKRLATSGLSVVEATSFVSPKWVPQLADAKDVMEVVRNITGVSFPVLTPNLKGFEAAAAAGAKEVAIFASASEAFSKSNINCSIKESFVRYNDVALAAKKQEIPVRGYVSCVVGCPVEGSVPPSNVAYVAKELYDMGCYEVSLGDTIGVGTPGTVIPMLEAVMSVVPVEKLAVHFHDTYGQSLSNIIVSLQMGVSVVDSSVAGLGGCPYAKGASGNVATEDVVYMLNGLGVKTGVDLGKVMAAGEFICKHLGRQSGSKAATALSKVTASASKL

SEQ ID NO: 9614 - protein, 435 aa, Lolium multiflorum
MLAASRVWSRSASPSSPVSPHSAAAAASSLLQRSVMQVSPKSQAPPGLAGTGDRAADAPPPPCSSSDDFREEHASSRRTNQRHPLPNRGKLIGGNHHVLYGSYLPQNQQRCRYYSFSSDQERMIVNRIIHDLPRFVKIVEVGPRDGLQNEKDTVPTPVKIELIKRLATSGLSVVEATSFVSPKWVPQLADAKDVMEVVWNITGVNFPVLTPNLKGFQAAAAAGAKEVAIFASASEAFSKSNINCSIKESLARYNDVALAAKKQEIPVRGYVSCVVGCPVEGSVPPSNVAYVAKELYDMGCYEVSLGDTIGVGTPGTVVPMLEAVMSVVPVEKLAVHFHDTYGQSLSNILVSLQMGVSVVDSSVAGLGGCPYAKGASGNVATEDVVYMLNGLGIKTGVNLGKVMAAGEFICKHLGRQSGSKAATALSKVTASASKL

SEQ ID NO: 9615 - protein, 401 aa, Triticum aestivum
GMQLSQAPPGLAERPCARIAEADAPPLCSSSGDSRGEHACRRRTYQRHPVSNRATPVGGNRHVLYASYLSQNQQNYRSFSASSDQERIEAANRIIHGLPRCVKIVEVGPRDGLQNEKNTVPTPVKIELIKRLATSGLSVVEATSFVSPKWVPQLADAKDVMEVVRNITGVSFPVLTPNLKGFEAAAAAGAKEVAIFASASEAFSKSNINCSIKESLVRYNDVALAAKKREIPVRGYVSCVVGCPVEGSVPPSNVAYVAKELYDMGCYEVSLGDTIGVGTPGTVVPMLEAVMSVVPVEKLAVHFHDTYGQSLSNILVSLQMGISVVDSSVAGLGGCPYAKGASGNVATEDVVYMLNGLGIKTGVDLSKVISAGEFICKHLGRQSGSKAATALSKVTASVSKL

SEQ ID NO: 9616 - protein, 443 aa, Brachypodium distachyon
MLRVWSRSASPCSPTSPHALSSAAAAATRSLLLRSRMQTPQAPPDGGHEPPCARFAETGDRAADALPPCSPSGDAREEYTCRRPAFQRQQVPNWGNSSVGGNRHVLYASYLSQNKQNYRCFSSSSDQEWIGIGSRMIHNLPRFVKIVEVGPRDGLQNEKSTVPTHVKIKLIQRLATSGLSVVEATSFVSPKWVPQLADAKDVMEVVRNIAGVHFPVLTPNLKGFEAAAAAGAKEVAIFASASEAFSKSNINCSIKESLARYNDVACAAKKHEIPVRGYVSCVVGCPVEGSVPPSNVAYVAKELYDMGCYEVSLGDTIGVGTPGTVVPMLEAVMSVVPVEKLAVHFHDTYGQSLSNILISLQMGVNVVDSSVAGLGGCPYAKGASGNVATEDVVYMLHGLGIKTGVDLGKVMSAGEFICKHLGRQSGSKAAIALSNVTANASKL

SEQ ID NO: 9617 - protein, 412 aa, Festuca arundinacea
ARGSSLLQRSGMQVSQKSQAPPGLAGTGDRTADAPPPPCSSSGDFREEYASRRRTNQRHPVPNLGKSIGGNHHVLYGSYLSRNQQRYRYFSSSSDQERIGIVNRMIHDLPRFVKIVEVGPRDGLQNEKNTVPTPVKIELIKRLATSGLSVVEATSFVSPKWVPQLADAKDVMEVVRNITGVNFPVLTPNLKGFQAAAAAGAKEVAIFASASEAFSKSNINCSIKESLARYNDVAPAAKKQEIPVRGYVSCVVGCPVEGSVPPSNVAYVAKELYDMGCYEVSLGDTIGVGTPGTVVPMLQAVMSVVPVEKLAVHFHDTYGQSLSNILVSLQMGVSVVDSSVAGLGGCPYAKGASGNVATEDVVYMLNGLGIKTGVNLGKVMAAGEFICKHLGRQSGSKAATALSKVTASASKL

SEQ ID NO: 9618 - protein, 552 aa, Triticum aestivum
MATTAALPFSCATTLQTLTRTLSPRRSLLIHRHRLRSLAAAASPRLPDRARPRLRRPVSASAAPNGSSSAGEYDYDLFTIGAGSGGVRASRFASTLYGARAAICEMPFSTISADDLGGLGGTCVLRGCVPKKLLVYASKFSHEFEESHGFGWTYDTDPKHDWSTLIANKNTELQRLVGIYKNILKNANVDLIEGRGKVVDPHTVSVDGKLYTAKNILIAVGGRPSMPDIPGIEHVIDSDAALDLPSKPEKIAIVGGGYIALEFAGIFNGLKSDVHVFIRQPKVLRGFDEEVRDFVAEQMSLRGITFHTEHSPQAITKSNDGLLSLKTNKETIGGFSHVMFATGRKPNTKNLGLEEVGVKMDKKGAIVVDGYSRTSVDSIWAVGDVTDRINLTPVALMEGGAFAKTLFGDEPTKPEYRAVPAAVFSQPPIGQVGLTEEQAIEEYGDVDVYLSNFRPLRATLSGLPDRVLMKLIVCATTNKVVGVHMCGDDAPEIIQGIAIGVKAGLTKQDFDVTVGVHPTSAEEFVTMRSPTRKVRRKTAAEAESKDEVVTQK

SEQ ID NO: 9619 - protein, 551 aa, Brachypodium distachyon
MATTAALPFSCSATLQTLTRTLSPRHRLLVHRRRFHRLPSLAAFPSPPDPPRLRRPVSASAAPNGSSSAGEYDYDLFTIGAGSGGVRASRFASTLYGARAAICEMPFATIATDDLGGLGGTCVLRGCVPKKLLVYASKFSHEFEESHGFGWTYETDPKHDWSTLIANKNTELQRLVGIYKNILNNAGVDLIEGRGKVVDPHTVSVDGKLYTAKNILIAVGGRPSMPTIPGIDHVIDSDAALDLPSKPEKIAIVGGGYIALEFAGIFNGLKSDVHVFIRQPKVLRGFDEEVRDFLAEQMSLRGITFHTEQSPQAVTKSSDGLLSLKTNKETIGGFSHVMFATGRKPNTKNLGLEEVGVKMDRNGAIVVDEYSRTSVDSIWAVGDVTDRINLTPVALMEGGAFAKTLFGDEPTKPDYRAVPAAVFSQPPIGQVGLTEEQAIEEYGDVDVFLSNFRPLRATLSGLPDRVLMKVIVSAATNKVVGVHMCGDDAPEIIQGIAIAVKAGLTKQDFDATVGVHPTSAEEFVTMRNATRKIRRSTAAEVESKDEIVTQQ

SEQ ID NO: 9620 - protein, 551 aa, Avena sativa
MATTAALPFSCSTTLQTLTRTLYPRHPLLIPRRRFHHLRSLVAAPGRPNPPRLRSPISASAAPNGSSSAGEYDYDLFTIGAGSGGVRASRFASTLFGARAAICEMPFATISADDLGGVGGTCVLRGCVPKKLLVYASKFSHEFEESHGFGWNYETDPKHDWSTLIANKNTELQRLVGIYKNILNNAGVDLIEGRGKLIDPHTVSVDGKLYTAKNILIAVGGRPSMPNIPGIEHVIDSDAALDLPSKPEKIAIVGGGYIALEFAGIFNGLKSDVHVFIRQPKVLRGFDEEVRDFIAEQMSLRGITFHTEQSPQAITKSNDGLLSLKTNKETIGGFSHVMFATGRKPNTKNLGLEEVGVKMDNKGAIVVDEYSRTSVDSIWAVGDVTDRINLTPVALMEGGAFAKTAFGDEPTKPDHRAVPAAVFSQPPIGQVGLTEEQAIEEYGDVDVFISNFRPLRATLSGLPDHVLMKLIVCATTNKVVGVHMCGDDAPEIIQGIAIAVKAGLTKQDFDVTVGVHPTSAEEFVTMRSPTRKVRRKTAAEVESKDEVVTRQ

SEQ ID NO: 9621 - protein, 548 aa, Lolium multiflorum
MATTAALPFSCSTTFQTLTRNLYPRHPLLIPRRRLHHLRSLAAVPTRPRLRRPVSASAAPNGSSSTSEYDYDLFTIGAGSGGVRASRFASTLFGARAAVCEMPFATISADDLGGVGGTCVLRGCVPKKLLVYASKFSHEFEESHGFGWTYETDPKHDWSTLIANKNTELQRLVGIYKNILSNAGVDLIEGRGKVVDPHTVSVDGKLYTAKNILIAVGGRPSMPNIPGIEHVIDSDAALDLPSKPEKIAIVGGGYIALEFAGIFNGLKSEVHVFIRQPKVLRGFDEEVRDFIAEQMSLRGITFHTEESPQAITKSNDGLLSLKTNKETVGGFSHIMFATGRKPNTKNLGLEEVGVKMDNKGAIVVDEYSRTSVDSIWAVGDVTDRINLTPVALMEGGAFAKTAFGDEPTKPDHSAVPAAVFSQPPIGQVGLTEEQAIEEYGDVDVYISNFRPLRATLSGLPDRVLMKLIVCATTNKVVGVHMCGDDAPEIIQGIAIAVKAGLTKQDFDATVGVHPTSAEEFVTMRSPTRKVRREAAAEVESKDEVVTKQ

SEQ ID NO: 9622 - protein, 540 aa, Secale cereale
RHPPDPDPDPLPAPLPPHPPPPPPLPRRLPAAPGPPRPCLRRPVSASASAAPNGSSSAGEYDYDLFTIGAGSGGVRASRFASTLYGARAAICEMPFSTISADDLGGLGGTCVLRGCVPKKLLVYASKFSHEFEESHGFGWTYDTDPKHDWSTLIANKNTELQRLVGIYKNILKNANVDLIEGRGKVVDPHTVSVDGKLYTAKNILIAVGGRPSMPDIPGIEHVIDSDAALDLPSKPEKIAIVGGGYIALEFAGIFNGLKSDVHVFIRQPKVLRGFDEEVRDFVTEQMSLRGITFHTEHSPQAITKSNDGLLSLKTNKETIGGFSHVMFATGRKPNTKNLGLEEVGVKMDKKGAIVVDEYSRTSVDSIWAVGDVTDRINLTPVALMEGGAFAKTLFGDEPTKPEYRAVPAAVFSQPPIGQVGLTEEQAIEEYGDVDVYLSNFRPLRATLSGLPDRVLMKLIVCATTNKVVGVHMCGDDAPEIIQGIAIGVKAGLTKQDFDVTVGVHPTSAEEFVTMRSPTRKVRRKTAAEAESKDEVVTQK

SEQ ID NO: 9623 - protein, 555 aa, Oryza sativa
MATTATLPFSCSSTLQTLTRTIPLRLRLHRRRFLHHLPSLAALPRLPLPRPPLLPHARRHVSASAAPNGASSEGEYDYDLFTIGAGSGGVRASRFASTLYGARAAVCEMPFATVASDDLGGVGGTCVLRGCVPKKLLVYGSKYSHEFEESHGFGWVYETDPKHDWNTLIANKNTELQRLVGIYKNILNNSGVTLIEGRGKIVDPHTVSVDGKLYTARNILIAVGGRPSMPNIPGIEHVIDSDAALDLPSKPEKIAIVGGGYIALEFAGIFNGLKSEVHVFIRQKKVLRGFDEEVRDFIAEQMSLRGITFHTEQSPQAITKSNDGLLSLKTNKETIGGFSHVMFATGRKPNTKNLGLEEVGVKLDKNGAIMVDEYSRTSVDSIWAVGDVTDRVNLTPVALMEGGAFAKTVFGDEPTKPDYRAVPSAVFSQPPIGQVGLTEEQAIEEYGDVDIYTANFRPLRATLSGLPDRIFMKLIVCATTNKVVGVHMCGEDAPEIIQGVAIAVKAGLTKQDFDATIGIHPTSAEEFVTMRNATRKVRRSTTDEVESKDKVVTQN

SEQ ID NO: 9624 - protein, 550 aa, Sorghum bicolor
MAAHATLPFSCSSTLQTLTRTLSPRGTHQLRRGFLRLPSLAALPRLARPCRRHVSASAAAAPNGASAEGEYDYDLFTIGAGSGGVRASRFASTLHGARVAICEMPFATIASDELGGLGGTCVLRGCVPKKLLVYGSKYSHEFEESRGFGWTYETDPKHDWNTLIANKNTELQRLVGIYRNILNNAGVTLIEGRGKIVDAHTVSVNGKLYTAKHILVGVGGRPSMPDIPGIEHVIDSDAALDLPSKPEKIAIVGGGYIALEFAGIFNGLKSEVHVFIRQKKVLRGFDEEVRDFVAEQMSLRGITFHTEESPQAITKSNDGLLSLKTNKETFGGFSHVMFATGRRPNTKNLGLEEVGVEMDKNGAIVVDEYSRTSVDSIWAVGDVTNRVNLTPVALMEGGAFAKTVFGNEPTKPDYRTIPSAVFSQPPIGQVGLTEEQAIEEYGDVDVFVANFRPLKATLSGLPDRVLMKILVCATSNKVVGVHMCGDDAPEIIQGIAIAVKAGLTKQDFDATIGIHPTSAEEFVTMRSATRKIRKKSADQVESKDEVVSKQ

SEQ ID NO: 9625 - protein, 551 aa, Panicum virgatum
MAAHATIPFSCSSTLQTLSRSLSSRGALHHRRGFLRLPSLAALPRLARAPRPCRRHVSASAAASPNGASAEGEYDYDLFTIGAGSGGVRASRFASTLYGARVAICEMPFATIASDEHGGLGGTCVLRGCVPKKLLVYGSKYSHVFEESHGFGWTYDTDPKHDWSTLIANKNTELQRLVGIYKNILNNAGVTLIEGRGKIVDPHTVSVNGKLYTAKNILIGVGGRPSMPDIPGIEYAIDSDAALDLPSKPEKIAIVGGGYIALEFAGIFNGLKSDVHVFIRQKKVLRGFDEEVRDFIAEQMSLRGITFHTEQTPQAVTKSNDLLSLKTNKETIGGFSHVMFATGRRPNTKNLGLEEVGVEMDKNGAIVVDEYSHTSVDSIWAVGDVTNRINLTPIALMEGGAFAKTCFGNEPTKPDYRAVPSAVFSQPPIGQVGLSEEQAIEEYGDVDVFVANFRPLRATLSGLPDRVLMKIIVCATTDKVVGVHMCGDDAPEIIQGIAIAVKAGLTKQDFDATIGIHPTSAEEFVTMRNATRKIRRSSADQVESKDEVATK

SEQ ID NO: 9626 - protein, 553 aa, Panicum virgatum
MAAHATIPFSCSSTLQTLSRSLSARGVLHLRGGFLRLPSLAALPRLARDPRPCRCHVSASAAASPNGASAEGEYDYDLFTIGAGSGGVRASRFASTLYGARVAICEMPFATVASDEHGGLGGTCVLRGCVPKKLLVYGSKYSHEFEESHGFGWTYETDPKHDWSTLIANKNTELQRLVGIYKNILNNAGVTLIEGRGKIVDPHTVSVNGKLYTAKNILIGVGGRPSMPDIPGIEYAIDSDAALDLPSKPEKIAIVGGGYIALEFAGIFNGLKSDVHVFIRQKKVLRGFDEEVRDFIAEQMSLRGITFHTEQTPLAVTKSNDDLLSLKTNKETIGGFSHVMFATGRRPNTKNLGLEEVGVEMDKNGAIVVDEYSRTSVDSIWAVGDVTNRINLTPVALMEGGAFAKTCFGNEPTKPDYRVVPSAVFSQPPLGQVGLTEEQAIEEYGDVDVFVANFRPLKATLSGLPDRVLMKIIVCATTNKVVGVHMCGDDAPEIIQGIAIAVKAGLTKQDFDGTIGIHPTSAEEFVTMRNATRKIRRSSADQVESKDEIATKQ

SEQ ID NO: 9627 - protein, 550 aa, Zea mays
MAAHATLPFSCSSTLQTLTRTLSSRGAHQLRGGFLRLPSLAALPRLAHPCRRHVSASAAAAPNGASVEGEYDYDLFTIGAGSGGVRASRFASALYGSRVAICEMPFATIASDELGGLGGTCVLRGCVPKKLLVYASKYSHEFEESRGFGWTYETDPKHDWSTLIANKNTELQRLVGIYRNILNNAGVTLIEGRGKIVDPHTVSVNGKLYTAKHILVSVGGRPSMPDIPGIEHVIDSDAALDLPSKPEKIAIVGGGYIALEFAGIFNGLKSEVHVFIRQKKVLRGFDEEVRDFVAEQMSLRGITFHTEQSPQAITKSNDGLLSLKTNKENFGGFSHVMFATGRRPNSKNLGLEAVGVEMDKNGAIVVDEYSRTSVDSIWAVGDVTNRVNLTPVALMEGGAFAKTVFGNEPTKPDYRAIPSAVFSQPPIGQVGLTEEQAIEEYGDVDVFVANFRPLKATLSGLPDRVLMKILVCATSNKVVGVHMCGDDAPEIIQGIAIAVKAGLTKQDFDATIGIHPTSAEEFVTMRSPTRKIRKSSTDQVESKDEVVSKQ

SEQ ID NO: 9628 - protein, 551 aa, Pennisetum glaucum
MAAHATLPFSCSSTLQTLTRSLSSRGALQLRRGFHHRRRSLPSLAALPRLPRRHVSASAAASPNGASPEGEYDYDLFTIGAGSGGVRASRFASTLYGTRVAICEMPFATVATDELGGLGGTCVLRGCVPKKLLVYGSKYSHEFEESHGFGWSYETEPKHDWSTLIANKNTELQRLVGIYKNILNNAGVTLIEGRGKIVDPHTVSVNGKLYTAKNILIGVGGRPSMPDIPGIEHAIDSDAALDLPSKPEKIAIVGGGYIALEFAGIFNGLKSEVHVFIRQKKVLRGFDEEVRDFVAEQMSLRGITFHTEQTPQAVTKSDDGLLSLKTNKETIGGFSHVMFATGRRPNTKNLGLEEVGVKMDKNGAIVVDEYSRTSVDSIWAVGDVTNRINLTPVALMEGGAFVKTVFGNEPTKPDYRAVPSAVFSQPPIGQVGLSEEQAIEEYGDVDVFVANFRPLKATLSGLPDRVFMKIIVCATTNKVVGVHMCGDDAPEIIQGIAIAVKAGLTKQDFDVTIGIHPTSAEEFVTMRNPTRKIRRSSADQVESKNEVATKQ

SEQ ID NO: 9629 - protein, 470 aa, Secale cereale
SGGVRASRFASTLYGARAAICEMPFSTISADDLGGLGGTCVLRGCVPKKLLVYASKFSHEFEESHGFGWTYDTDPKHDWSTLIANKNTELQRLVGIYKNILSNANVDLIEGRGKVVDPHTVSVDGKLYTAKNILIAVGGRPSMPDIPGIEHVIDSDAALDLPSKPEKIAIVGGGYIALEFAGIFNGLKSDVHVFIRQPKVLRGFDEEVRDFVTEQMSLRGITFHTEHSPQAITKSNDGLLSLKTNKETIGGFSHVMFATGRKPNTKNLGLEEVGVKMDKKGAIVVDEYSRTSVDSIWAVGDVTDRINLTPVALMEGGAFAKTLFGDEPTKPEYRAVPAAVFSQPPIGQVGLTEEQAIEEYGDVDVYLSNFRPLRATLSGLPDRVLMKLIVCATTNKVVGVHMCGDDAPEIIQGIAIGVKAGLTKQDFDVTVGVHPTSAEEFVTMRSPTRKVREKLQLRQSRRTRSSLRSR

SEQ ID NO: 9630 - protein, 452 aa, Triticum aestivum
AAICEMPFSTISADDLGGLGGTCVLRGCVPKKLLVYASKFSHEFEESHGFGWAYDTDPKHDWSTLIANKNTELQRLVGIYKNILKNANVDLIEGRGKVVDPHTVSVDGKLYTAKNILIAVGGRPSMPDIPGIEHVIDSDAALDLPSKPEKIAIVGGGYIALEFAGIFNGLKSDVHVFIRQPKVLRGFDEEVRDFVAEQMSLRGIAFHTEHSPQAITKSNDGLLSLKTNKETIGGFSHVMFATGRKPNTKNLGLEEVGVKMDKKGAIVVDEYSRTSVDSIWAVGDVTDRINLTPVALMEGGAFAKTLFGDEPTKPEYRAVPAAVFSQPPIGQVGLTEEQAIEEYGDVDVYLSNFRPLRATLSGLPDRVLMKLIVCATTNKVVGVHMCGDDAPEIIQGIAIGVKAGLTKQDFDVTVGVHPTSAEEFVTMRSPTRKVRRKTAAEAESKDEVVAQK

SEQ ID NO: 9631 - protein, 537 aa, Tragopogon dubius
MECFGARNMSTTMAVFTCPRFMKCNIKHEFSLLQHRRFTSLSASSSVRQIKCSAKSDRCVVEKQGISKEEEEDYVKAGGSELLFVQMQQNKSMESQSSISEKLPQIPIGDCVLDLVVIGCGPAGLALAAESAKLGLNVGLIGPDLPFTNNYGVWEDEFIGLGLEGCIERVWRDTLVYLDGNDPNPIRIGRAYGRVNRDLLHEELLRRCVESGVTYLSSKVERITEAPNGYSLIECEGNITIPCRLATVASGAASGKLLEYELGGPRVCVQTAYGVEVEVENNPYDPNLMVFMDYRDYTKHQTPSLEAKYPTFLYVMPMSPTKIFFEETCLASKEAMPFNLLKTKLMSRLKTLGVRITRTYEEEWSYIPVGGSLPNTEQKNLAFGAAASMVHPATGYSVVRSLSEAPNYAAIIAKILRQGHSKDTLALGKYSTNISKQAWETLWPQERKRQRAFFLFGLSFIVQMDIEGTRTFFRTFFRLPTWMWWGFLGSSLSSTDLVLFAFYMFIIAPHSLRMGLVRHLLSDPTGATMVRAYITTT

SEQ ID NO: 9632 - protein, 535 aa, Arnica chamissonis
MACFGARHMTATMAVFTCPRFMNYNIRHEFSLLQHCRFTSLSLSSSSLKQIKCSAKSDRLVVVKEAISEADEEDYVKAGGSELLFVQMQQKKSMDTQSRLSEKLPRIPIGDCILDLVVIGCGPAGLALAAESAKLGLNVGLIGPDLPFTNNYGVWEDEFIGLGLEGCIEHVWRDTVVYLDDNDPILIGRAYGRVSRDLLHEELLRRCVESGVSYLSSKVERITEAPNGHSLIECEGNITIPCRLATVASGAASGKLLQYELGGPRVCVQTAYGVEVEVESIPYDPSLMVFMDYRDYTKHKSQSVEAQYPTFLYVMPMSPTKVFFEETCLASKEAMPFELLKTKLMSRLKTMGIRITKTYEEEWSYIPVGGSLPNTKQKNLAFGAAASMVHPATGYSVVRSLSEAPNYAAVIAKILGQGNSKQMLDLGRYTSNISKQAWETLWPLERKRQRAFFLFGLALIVQMDIEGTRTFFRTFFRLPTWMWWGFLGSSLSSTDLLVFAFYMFIIAPHSLRMGLVRHLLSDPTGAIMVKAYLTI

SEQ ID NO: 9633 - protein, 536 aa, Centaurea maculosa
MECVGARNMTATMAVFTCPRFMNYNIRHGFSLLKRRSFTSLSLSSSSLQKIKCSARTDGCVVVKEGISEEDEEDYVKAGGSELLFVQMQQNKAMDSQSRLSEKLPRIPIGDCVLDLVVIGCGPAGLALAAESAKLGLNVGLIGPDLPFTNNYGVWEDEFIGLGLEGCIEHVWRDTLVYLEDNDPILIGRAYGRVNRDLLHEELLRRCVESGVSYLSSKVERITEAPNGHSLIECEGNVTVPCRLATVASGAASGKLLQYELGGPRVCVQTAYGVEVEVENNPYDPSLMVFMDYRDYTKNTTQSSLEAKYPTFLYAMPMSPTKIFFEETCLASREAMPFDLLKTKLMSRLKTLGIRITKTYEEEWSYIPVGGSLPNTEQKNLAFGAAASMVHPATGYSVVRSLSEAPNYAAVIAKILRQGHSKEMLVQGRQTMNISKQAWETLWPLERKRQRAFFLFGLALIVQLDIEGTRTFFRTFFRLPTWMWWGFLGSSLSSTDLVLFAFYMFIIAPQSLRMALVRHLLSDPTGGTMVKAYLTI

SEQ ID NO: 9634 - protein, 529 aa, Flaveria ramosissima
MECFRAPHMTPTMAPFTCPRFMSYNTRHGFSLLRHCRFTSFSSSLKQIKCSAKSVVVKEGISEADEEDYVKAGGSELLFVQMQQNKPMDTQSRLSEKLPRIPIGDCLLDLVVIGCGPAGLALAAESAKRGLNVGLIGPDLPFTNNYGVWEDEFIGLGLEGCIEHVWRDTVVYLDNNDPILIGRAYGRVSRDLLHEELLRRCVESGVSYLSSKVERITEAPNGQSLIECEGNITIPCRLATVASGAASGKLLQYELGGPRVCVQTAYGVEVEVESLPYDPSLMVFMDYRDYTKHKSQSLEAKYPTFLYVMPMSPTKVFFEETCLASKEAMPFELLKTKLMSRLKTLGIRITKTYEEEWSYIPVGGSLPNTEQKNLAFGAAASMVHPATGYSVVRSLSEAPNYAAVIAKILGKGNPKQMLDLGRNSTNISKQAWETLWPLERKRQRAFFLFGLALIVQMDIEGTRTFFRTFFRLPTWMWWGFLGSSLSSTDLIVFAFYMFIIAPHSLRMGLVRHLLSDPTGATIVKAYLTI

SEQ ID NO: 9635 - protein, 539 aa, Cirsium arvense
MECVGARSITTATMAVFTCPRFMNYNIRHGFSLLKRRNFSSLSLSLSSSSLKQIKCSGRTDGCVVVKEGISEEDEEDYVKAGGSELLFVQMQQNKAMDSQSRLSEKLPRIPIGDCVLDLVIIGCGPAGLALAAESAKLGLNVGLIGPDLPFTNNYGVWEDEFIGLGLEGCIEHVWRDTLVYLEDNDPILIGRAYGRVNRDLLHEELLRRCVESGVSYLSSKVERITEAPNGHSLIECEGNVTVPCRLATVASGAASGKLLQYELGGPRVCVQTAYGVEVEVENNPYDPSLMVFMDYRDYTKNTTQSSLEAKYPTFLYAMPMSPTKIFFEETCLASREAMPFDLLKTKLMSRLKTLGIRITKTYEEEWSYIPVGGSLPNTEQKNLAFGAAASMVHPATGYSVVRSLSEAPNYAAVIAKILRQGHSKEMLVQGRQTMNISKQAWETLWPLERKRQRAFFLFGLALIVQLDIEGTRTFFRTFFRLPTWMWWGFLGSSLSSTDLVLFAFYMFIIAPQSLRMALVRHLLSDPTGGTMVKAYLTI

SEQ ID NO: 9636 - protein, 535 aa, Helianthus annuus
MECFGAPHMTATMAAFTSPRFMNYSIRRQFSLLKHCRFTTLSSPSSLLKRIRCSAKSDNCVAVKEGVSEAEKEDYVKAGGSELVFVQMQQNKCMETQSRLSQKLPRIPIGECVLDLVVIGCGPAGLALAAESAKRGLNVGLIGPDLPFTNNYGVWEDEFIGLGLEGCIEHVWRDTVVYLDDNEPILIGRAYGRVSRDLLHEELLRRCVESGVSYLSSKVERITEAPNGQSLIECEGNITIPCRLATVASGAASGKLLQYELGGPRVCVQTAYGVEVEVESIPYDPSLMVFMDYRDYTKNKSQSLEAQYPTFLYVMPMSPTKVFFEETCLASKEAMPFELLKTKLMSRLKTMGIRITKTYEEEWSYIPVGGSLPNTEQKNLAFGAAASMVHPATGYSVVRSLSEAPNYAAVIAKILGQGNSKQMVDLGRYTTNISKQAWETLWPLERKRQRAFFLFGLALIVQMDIEGTRTFFRTFFRLPTWMWWGFLGSSLSSTDLIVFAFYMFIIAPHSLRMGLVRHLLSDPTGATMVKAYLTI

SEQ ID NO: 9637 - protein, 489 aa, Flaveria ramosissima
MECFRAPHMTPTMAPFTCPRFMTYNTRNGFSLLRHCRFTSLSSSLKQIKCSAKSVVVKEGVSEADEEDYVKAGGSELLFVQMQQNKPMDTQSRLSEKLPRIPIGDCLLDLVVIGCGPAGLALAAESAKLGLNVGLIGPDLPFTNNYGVWEDEFIGLGLEGCIEHVWRDTVVYLDNNDPILIGRAYGRVSRDLLHEELLRRCVESGVSYLSSKVERITEAPNGQSIIECEGNITIPCRLATVASGAASGKLLQYELGGPRVCVQTAYGVEVEVESLPYDPSLMVFMDYRDYTKHKSQSLEAKYPTFLYVMPMSPTKVFFEETCLASKEAMPFELLKTKLMSRLKTLGIRITKTYEEEWSYIPVGGSLPNTEQKNLAFGAAASMVHPATGYSVVRSLSEAPNYAAVIAKILGKGNPKQMLDLGRHSTNISKQAWETLWPLERKRQRAFFLFGLALIVQMDIEGTRTFFRTFFRLPTWMWWGFLDLRYPQPT

SEQ ID NO: 9638 - protein, 534 aa, Centaurea maculosa
MECVGARSITTATMAVFTCPRFMNYNISHGFSLLKRRSFSSLSLSLKQIKCSGRRDGCVVVKEGISEEDEEDYVKAGGSELLFVQMQQNKAMDSQSRLSEKLPRIPIGDCVLDLVVIGCGPAGLALAAESAKLGLNVGLIGPDLPFTNNYGVWEDEFIGLGLEGCIEHVWRDTLVYLEDNDPILIGRAYGRVNRDLLHEELLRRCVESGVSYLSSKVERITEALNGHSLIECEGNVTVPCRLATVASGAASGKLLQYELGGPRVCVQTAYGVEVEVENNPYDPSLMVFMDYRDYTKNTTQSSLEAKYPTFLYAMPMSPTKIFFEETCLASREAMPFDLLKTKLMSRLKTLGIRITKTYEEEWSYIPVGGSLPNTEQKNLAFGAAASMVHPATGYSVVRSLSEAPNYAAVIAKILRQGHSKEMLVQGRQTMNISKQAWETLWPLERKRQRAFFLFGLALIVQLDIEGTRTFFRTFFRLPTWMWWGFLGSSLSSTDLVLFAFYMFIIAPQSLRMALVRHLLSDPTGGTMVKAYLTM

SEQ ID NO: 9639 - protein, 529 aa, Flaveria ramosissima
MECFRAPHMTPTMAPFTCPRFMTYSTRNGFSLLRHCRFTSLSSSLKQIKCSAKSVVVKEGVSEAEEEDCVKAGGSELLFVQMQQNKPMDTQSRLSEKLPRIPIGDCLLDLVVIGCGPAGLALAAESAKRGLNVGLIGPDLPFTNNYGVWEDEFIGLGLERCIEHVWRDTVVYLDNNDPILIGRAYGRVSRDLLHEELLRRCVESGVSYLSSKVERITEAPNGQSLIECEGNITIPCRLATVASGAASGKLLQYELGGPRVCVQTAYGVEVEVESLPYDPSLMVFMDYRDYTKHKSQSLEAKYPTFLYVMPMSPTKVFFEETCLASKEAMPFELLKSKLMSRLKTLGIRITKTYEEEWSYIPVGGSLPNTEQKNLAFGAAASMVHPATGYSVVRSLSEAPNYAAVIAKILGKGNPKQMLDLGRHSTNISKQAWETLWPLERKRQRAFFLFGLALIVQMDIEGTRTFFRTFFRLPTWMWWGFLGSSLSSTDLIVFAFYMFIIAPHSLRMGLVRHLLSDPTGATMVKAYLTI

SEQ ID NO: 9640 - protein, 522 aa, Ambrosia trifida
MECFGGRHMSATMTAFRLMNYTSRREVSLLQQYRFTRKQQIKCSAKSVVVKEGVSEAEEEDYVKAGGSELLFVQMQQNKSMETQSRLSDKLPRIPIGECVLDLVVIGCGPAGLALAAESAKRGLNVGLIGPDLPFTNNYGVWEDEFIGLGLEGCIEHVWRDTVVYLDDNDPILIGRAYGRVSRDLLHEELLRRCVESGVSYLSSKVERITEAPNGQSLIECEGNITIPCRLATVASGAASGKLLQYELGGPRVCVQTAYGVEVEVESIPYDPSLMVFMDYRDYTKHKSQSLEAQYPTFLYVMPMSPTKVFFEETCLASKEAMPFELLKSKLMSRLKTMGIRITKTYEEEWSYIPVGGSLPNTEQKNLAFGAAASMVHPATGYSVVRSLSEAPNYAAVIAKILGQGNSKQMLVPGRYTTNISKQAWETLWPLERKRQRAFFLFGLALIVQMDIEGTRTFFRTFFRLPTWMWWGFLGSSLSSTDLIAFAFYMFVIAPHSLRMGLVRHLLSDPTGATMVKAYLTI

SEQ ID NO: 9641 - protein, 531 aa, Helianthus annuus
MECFGAPHMTATMAAFTSPRFMNYSIRRQFSLLKHCRFTSLSSPSSLLKRIRCSAKSDNCVAVKEGVSEAEKEDYVKAGGSELVFVQMQQNKCMETQSRLSQKLPRIPIGECVLDLVVIGCGPAGLALAAESAKRGLNVGLIGPDLPFTNNYGVWEDEFIGLGLEGCIEHVWRDTVVYLDDNDPILIGRAYGRVSRDLLHEELLRRCVESGVSYLSSKVERITEAPNGQSLIECEGNITIPCRLATVASGAASGKLLQYELGGPRVCVQTAYGVEVEVESIPYDPSLMVFMDYRDYTKHKSQSLEAQYPTFLYVMPMSPTKVFFEETCLASKEAMPFELLKTKLMSRLKTMGIRITKTYEEEWSYIPVGGSLPNTEQKKLAFGAAASMVHPATGYSVVRSLSEAPNYAAVIAKILGQGNSKQMVDLGRYTTNISKQAWETLWPLERKRQRAFFLFGLALIVQMDIEGTRTFFRLPTWMWWGFLGSSLSSTDLIVFEFYMFIIAPHSLIMGLVRHLRSDPTGATMVKAYLTI

SEQ ID NO: 9642 - protein, 290 aa, Sorghum bicolor
MPSAAAAAAAPLHRIACARQRLPQTSLFFLPPRALPNSGRLTVPAPLPVHALRLPPTATRAASHDAATGARSPTSGGQMLVFVPPHPLIKHWVSVLRNEQTPCAIFKSAMAELGRLLIYEASRDWLPTITGEIETPVAVASVEFIDPREPVLVVPILRAGLALAELASSVLPATKTYHLGLRRDEETLQPSIYLNNLPDKIPEGTRVLVVDPMLATGGTMVAAIDLLIERGVTSKQIKVVSAVASPPALQKLNNKFPGLHVYTGIIDPEVNEKGFIVPGLGDAGDRSFAT

SEQ ID NO: 9643 - protein, 290 aa, Saccharum officinarum
MPSPAATAAAPLHRIACARQRLPQTSLFFLPPRALLNSGRLTVPAPLPVHALRLPPTATRAASHDATTGARSPTSGGQMLVFVPPHPLIKHWVSVLRNEQTPCAIFKSAMAELGRLLIYEASRDWLPTITGEIETPIAVASVEFIDPREPVLVIPILRAGLALAELASSVLPATKTYHLGLRRDEETLQPSIYLNNLPDKIPEGTRVLVIDPMLATGGTMVAAIDLLIERGVTSKQIKVVSAVASPPALQKLNNKFPGLHVYTGIIDPEVNEKGFIVPGLGDAGDRSFAT

SEQ ID NO: 9644 - protein, 290 aa, Panicum virgatum
MPSLATAAAAPLHRRACARQHLPPASRCFLPSRALLNSARLFTAPVPLPVHAPRVPPTAARAASPDAAAARSPTSGGQMLVFVPPHPLIKHWVSVLRNEQTPCSIFKSAMAELGRLLIYEASRDWLPTITGEIETPVAVASVEFIDPREPVLVIPILRAGLALAELASSVLPATKTYHIGLRRDEETLQPSIYLNNLPDNIPEGSRVLVVDPMLATGGTIVAAIDLLIECGVTSKQIKVVSAVAAPPALQKLNNKFPGLHVYTGTIDPEVNEKGFIIPGLGDAGDRSFAT

SEQ ID NO: 9645 - protein, 291 aa, Setaria italica
MPSPTTATAASAPLHLRSCARQHLPPASRCFLPSRVLLNSARLTAPAPLPVRVPSLPPTAARAAGPDATSTRSPTSGGQMLVFVPPHPLIKHWVSVLRNEQTPCAIFKSAMSELGRLLIYEASRDWLPTITGEIETPVAVASVEFIDPREPVLVIPILRAGLALAEQASSVLPATKTYHLGLRRDEETLEPSIYLNNLPDKIPEGTRVLVVDPMLATGGTIVAAIDLLIERGVTSKQIKVVSAVAAPPALQKLNNKFPGLHVYTGIIDPEVNEKGFIVPGLGDAGDRSFAT

SEQ ID NO: 9646 - protein, 533 aa, Sorghum bicolor
MGLSGATISAPLGCRGLRRGAVGGGKARKAEAERWRRAGWSRRVGGPKVTCVATEKHDETAAVGVEFADEEDYRKGGGGELLYVQMQATKPMESQSRIASKLLPISDENTVLDLVIIGCGPAGLSLASESAKKGLTVGLIGPDLPFTNNYGVWEDEFKDLGLASCIEHVWKDTIVYLDNNKPILIGRSYGRVHRDLLHEELLRRCYEAGVTYLNSKVDKIIESPDGHRVVCCDKGREIICRLAIVASGAASGRLLEYEVGGPRVCVQTAYGVEVEVENNPYDPSLMVFMDYRDCFKEEFSHTEQENPTFLYAMPMSSTRVFFEETCLASKDAMSFDLLKKRLMYRLNAMGVRILKIYEEEWSYIPVGGSLPNTDQKNLAFGAAASMVHPATGYSVVRSLSEAPRYASVISDILNNRVPAEYLLGNSQNYSPSMLAWRTLWPQERKRQRSFFLFGLALIIQLNNEGIQTFFEAFFRVPKWMWRGFLGSTLSSVDLILFSFYMFAIAPNQLRMNLVRHLLSDPTGSTMIKTYLTL

SEQ ID NO: 9647 - protein, 431 aa, Solanum tuberosum
MAGQTVIVSGLNPAAILQSTIGGVPVAAAAENGHTRKVVPLSKDALQDFMVSIITQKLQDDKQPFYVLDLGEVVSLMEQWNSALPNIRPFYAVKCNPEPSFLSMLSAMGSNFDCASRAEIEYVLSLGISPDRIVFANPCKPESDIIFAEKIGVNLTTYDSEDEVYKIRKHHPKCELLLRIKPMNDGNARCPMGPKYGALPEEIEPLLRTAQAARLTVSGVSFHIGSGDADSNAYLGAIAAAKHVFETATQLGMPKMTVLDIGGGFTSGHQFTSAAPAVKSALETHFQNSPELTIIAEPGRFFAETAFTLATTIIGKRVRGELKEYWINDGLYGSMNCVLYDHATVTATPLACMSNRNNLNCGGSKTFPSTVFGPTCDALDTVLRDYQLPELQVNDWLVFPNMGAYTKAAGSNFNGFNTSAIVTHLAYAYPS

SEQ ID NO: 9648 - protein, 430 aa, Solanum phureja
MAGQTVIVSGLNPAAILQSTIGGVPVAAAKQLHTRKVVPLSKDALQDFMVSIITQKLQDDKQPFYVLDLGEVVSLMEQWNSALPNIRPFYAVKCNPEPSFLSMLSAMGSNFDCASRAEIEYVLSLGISPDRIVFANPCKPESDIIFAEKIGVNLTTYDSEDEVYKIRKHHPKCELLLRIKPMNDGNARCPMGPKYGALPEEIEPLLRTAQAARLTVSGVSFHIGSGDADSNAYLGAIAAAKQVFETATQLGMPKMTVLDIGGGFTSGHQFTSAAPAVKSALETHFQNSPELTIIAEPGRFFAETAFTLATTIIGKRVRGELKEYWINDGLYGSMNCVLYDHATVTATPLACMSNRNNLNCGGSKTFPSTVFGPTCDALDTVLRDYQLPELQVNDWLVFPNMGAYTKAAGSNFNGFNTSAIGTHLAYAYPS

SEQ ID NO: 9649 - protein, 435 aa, Capsicum annuum
MAGQTVIVSGLNPAAILQSTIGGAPPSTAAAAAENGDTTRKVVPLSKDALQDFMVSIITQKLQGEKKPFYVLDLGEVVSLMDQWNVALPNVRPFYAVKCNPEPSFLSMLAAMGSNFDCASRAEIEYVLSLGISPERIVFANPCKPESDIIFAEKVGVNLTTYDSEDEVYKIKKHHPKCELLLRIKPMNDGNARCPMGPKYGALPEEIEPLLRIAQASRLTVSGVSFHIGSGDADSNAYLGAIAAAKQVFETAAKFGMSKMNVLDIGGGFTSGHQFTTAATAVKSALQQHFSNEPELTIIAEPGRFFAETAFTLATTIIGKRVRGDLREYWINDGLYGSMNCVLYDHATVTATPLACMSNRVNLNCSGSKMFPSTIFGPTCDALDTVLRDYQLPELQVNDWLIFPNMGAYTKAAGSNFNGFNTSAIVTHLAYAYPS

SEQ ID NO: 9650 - protein, 433 aa, Nicotiana tabacum
MAGQTIIVSGLNPAAILQSTIGGGASPTAAAAAENGTRKVIPLSRDALQDFMLSIITQKLQDEKQPFYVLDLGEVVSLMDQWKSALPNIRPFYAVKCNPEPSFLSILSAMGSNFDCASRAEIEYVLSLGISPDRIVFANPCKPESDIIFAAKVGVNLTTYDSEDEVYKIRKHHPKSELLLRIKPMLDGNARCPMGPKYGALPEEVDPLLRAAQAARLTVSGVSFHIGSGDADSNAYLGAIAAAKEVFETAAKLGMSKMTVLDVGGGFTSGHQFTTAAVAVKSALKQHFDDEPELTIIAEPGRFFAETAFTLATTIIGKRVRGELREYWINDGLYGSMNCVLYDHATVNATPLAVLSNRSNVTCGGSKTFPTTVFGPTCDALDTVLRDYQLPELQVNDWLVFPNMGAYTKAAGSNFNGFNTSAIVTHLAYSYPS

SEQ ID NO: 9651 - protein, 434 aa, Nicotiana benthamiana
MAGQTIIVSGLNPAAILQSTIGGGAFPTAAEAAAENGTRKVIPLSRDALQDFMLSIITQKLQDEKQPFYVLDLGEVVSLMDQWKSALPNIRPFYAVKCNPEPSFLSILSAMGSNFDCASRAEIEYVLSLGISPDRIVFANPCKPESDIIFAAKVGVNLTTYDSEDEVYKIRKHHPKSELLLRIKPMLDGNARCPMGPKYGALPEEVDPLLRAAQTARLTVSVVSFHIGSGDADSNAYLGAIAAAKEVFETAAKLGMSKMTVLDVGGGFTSGHQFTTAAVAVKSALKQHFDDEPELAIIAEPGRFFAETAFTLATTIIGKRVRGELREYWINDGLYGSMNCVLYDHATVNATPLAVLSNRSNVTCGRSKTFPTTVFGPTCDALDTVLRDYQLPELQVNDWLVFPNMGAYTKAAGSNFNGFNTSAIVTHLAYAYSS

SEQ ID NO: 9652 - protein, 433 aa, Nicotiana benthamiana
MAGQTIIVSGLNPAAILHSTIGGGASPTAAAAAENGTRKVIPLSRDALQDFMLSIITQKLQDEKQPFYVLDLGEVVSLMNQWKSALPNIRPFYAVKCNPEPSFLSILSAMGSNFDCASRAEIEYVLALGISPDRIVFANPCKPESDIIYAAKVGVNLTTYDSEDEVYKIRKHHPKSELLLRIKPMFDGNARCPMGPKYGALPEEVEPLLRAAQAARLTVSGVSFHIGSGDADSNAYLGAIGAVKEVFETAAKLGMSKMTVLDVGGGFTSGHQFTTATIAVKSALKQHFDDEPELAIIAEPGRFFAETAFTLATTIIGKRVRGELREYWINDGLYGSMNCVLYDHATVNATPLAVLSNRSNVTCGRSKTFPTTVFGPTCDALDTVLRDYQLPELQVNDWLVFPNMGAYTKAAGSNFNGFNTSAIVTHLAWQRQL

SEQ ID NO: 9653 - protein, 266 aa, Solanum phureja
MASMIESAWAFLLANFSDFQLTSLGGFIVHESAFFLSGIPFILFERAGWFGKYKIQKKTNTPEAQQKCITRLLMFHFCVNLPILIVTYPLFKFMGMRSTLPLPSWKVVSTQVLFYFILEDFVFYWGHRVLHTKWLYKHVHSVHHEYATPFGLTSEYAHPAEILFLGFATVIGPAITGPHLITLYLWISLRILETVEAHSGYHFPWSPSNFLPLYGGSDFHDYHHRLLYTKSGNYSSTFVYMDWLFGTDKGYRKLKMLKEQECNKAM

SEQ ID NO: 9654 - protein, 269 aa, Solanum tuberosum
MASMIESAWAFLLANFSDFQLTSLGGFIVHESAFFLSGIPFILFERAGWFGKYKIQKKTNTPEAQQKCITRLLMFHFCVNLPILIVTYPLFKFMGMRSTLPLPSWKVVSTQVLFYFILEDFVFYWGHRVLHTKWLYKHVHSVHHEYATPFGLTSEYAHPAEILFLGFATVIGPAITGPHLITLYLWISLRILETVEAHSGYHFPWSPSNFLPLYGGSDFHDYHHRLLYTKSGNYSSTFVYMDWLFGTDKGYRKLKMLKEQECKAEGKAM

SEQ ID NO: 9655 - protein, 269 aa, Solanum melongena
MASMIESAWTYLLTNFSDFQLTCLGGFIVHESAFFLSGLPFILFERAGWFGKYKIQKKNNTPEAQEKCITRLLLYHFCVNLPILIVTYPLFKFMGMRASLPLPSWKVISAQILFYFILEDFVFYWGHRILHTKWLYKHVHSVHHEYATPFGLTSEYAHPAEILFLGFATIIGPAITGPHLITLYLWVSLRVLETVEAHSGYHFPWSPSNFLPLYGGSDFHDYHHRLLYTKSGNYSSTFVYMDWIFGTDKGYRRLKMLKEQEHEAEGKVM

SEQ ID NO: 9656 - protein, 266 aa, Capsicum annuum
LIESAWTYLITNFSDFQLTCLGGFIVHESVFFLSGLPFILFERAGWFGKYKIQKKNNTPEAQTKCITRLVMYHLCVNLPILLVTYPVFKFMGTRSTLPLPSWKVVATQILFYFIIEDFVFYWGHRILHTKWLYKHVHSVHHEYATPFGLTSEYAHPAEILFLGAATIVGPALTGPHLITIYLWVSLRILETVEAHSGYHFPWSPSNFLPLYGGSDFHDYHHRLLYTKSGNYSSTFVYMDWIFGTDKGYRKLKSLKESEREAEGKVM

SEQ ID NO: 9657 - protein, 270 aa, Nicotiana benthamiana
MASIIESAWTYLISNFSDFQLTCLGGFVLHESIFFLSGLPFILFERAGWFGKYKIQKKNNSPEAQEKCITRLLMYHLCVNLPILLGSYPVFKFMGTRSSLPLPSWKVISTQIIFYFILEDFVFYWGHRILHTKWLYKHVHSVHHEYATPFGLTSEYAHPAEILFLGFATIIGPAITGPHLITLYLWVSLRVLETVEAHSGYHFPWSPSNFLPLYGGADFHDYHHRLLYTKSGNYSSTFVYMDWIFGTDKGYRKLKSLKENERFEAEGKEM

SEQ ID NO: 9658 - protein, 270 aa, Nicotiana tabacum
MASIIESAWTYLISNFSDFQLTCLGGFVLHESVFFLSGLPFILFERAGWFGKYKIQKKNNSPEAQEKCITRLLMYHLCVNLPILLGSYPVFKFMGTRSSLPLPSWKVISTQIIFYFILEDFVFYWGHRILHTKWLYKHVHSVHHEYATPFGLTSEYAHPAEILFLGFATIIGPAITGPHLITLYLWVSLRVLETVEAHSGYHFPWSPSNFLPLYGGADFHDYHHRLLYTKSGNYSSTFVYMDWIFGTDKGYRKLKSLKENERFEAVGKEM

SEQ ID NO: 9659 - protein, 262 aa, Petunia hybrida
MASMIESAWTYLIKNFSDFQLTCLGGFILHESVFFLSGLPFILFERAGWFGKYKIQKKNNTSEAQEKCIARLLLYHFCVNLPLLLASYPVFKFMGTRSSLPLPSWKVVSTQIIFYFILEDFVFYWGHRILHTKWLYKHVHSVHHEYATPFGLTSEYAHPVEILFLGFATVIGPAITGPHLITLWLWISLRVLETVEAHCGYHFPWSPSNFLPLYGGSDYHDYHHRLLYTKSGNYSSTFVYMDWIFGTDRGYRTLKAVKSNEM

SEQ ID NO: 9660 - protein, 269 aa, Solanum phureja
MASVIESAWTYLITNFNDFQLACLGSFFLHESVFFLSGLPFILLERAGWLSKYKIQTKNNTPAAQEKCITRLLLYHFCVNLPLMMASYPVFKLMGMRNTLPLPSWKVISTQVLFYFILEDFVFYWGHRILHTKWLYKHVHSVHHEYATPFGLTSEYAHPAEILFLGFATIVGPIITGPHLITLWLWMILRVLETVEAHCGYHFPWSLSNFLPLYGGADFHDYHHRLLYTKSGNYSSTFVYMDWLFGTDKGYRRLKVLKSDACEAEGKEM

SEQ ID NO: 9661 - protein, 269 aa, Solanum lycopersicum
MASMIESAWTYLITNFNDFQLACLGSFFLHESVFFLSGLPFILLERAGWLSKYKIQTKNNTPAAQEKCITRLLLYHFCVNLPLMMASYPVFKLMGMRNTLPLPSWKVISTQVLFYFILEDFVFYWGHRILHTKWLYKHVHSVHHEYATPFGLTSEYAHPAEILFLGFATIVGPIITGPHLITLWLWMIVRVLETVEAHCGYHFPWSLSNFLPLYGGADFHDYHHRLLYTKSGNYSSTFVYMDWLFGTDKGYRRLKVLKSDACEAEGKEM

SEQ ID NO: 9662 - protein, 268 aa, Echinacea purpurea
MTSIIESGWTYLITNFSDFQLACLGSFLLHESVFFLSGLPFIYFERAGWLSKYKIQTKHNTTEAQDKCITRLLLYHFCVNLPVMIASYPVFRFMGMRSSLPLPSWKVMSTQILFYFIVEDFIFYWGHRILHTKWLYKHVHSVHHEYATPFGLTSEYAHPAEILFLGFATIFGPAITGPHLITLWLWMVVRVLETVEAHCGYHFPWSPSNFLPLYGGSDFHDYHHRLIYTKSGNYSSTFVYMDWLFGTDTGYRKLKALKSEEEDKYKEH

SEQ ID NO: 9663 - protein, 268 aa, Cichorium intybus
MASIIESGWTYLITNFSDFQLACLGSFLLHESVFFLSGLPFIYLERAGWFSKYKIQVKNNTTEAQNKCITRLLLYHFCVNLPVMIASYPVFRFMGMRSSLPLPSWKVISTQILFYFIVEDFIFYWGHRILHTKWLYKHVHSIHHEYATPFGLTSEYAHPAEILFLGFATIFGPAITGPHLITLWLWMVVRVLETVEAHCGYHFPWSPSNFLPLYGGSDFHDYHHRLIYTKSGNYSSTFVYMDWLFGTDSGYRKLKALKSEGEVTYKEN

SEQ ID NO: 9664 - protein, 130 aa, Nicotiana tabacum
MASMIESAWTYLITNFSDFQLACLGSFFLHESVFFLSGLPFILLERAGWLSKYKIQTKNNSPAAQEKCITRLLLYHFCVNLPLMMASYPVFRLMGMRSTLPLPSWYFQESDLNTSILLLYPRGFCILLGT

SEQ ID NO: 9665 - protein, 268 aa, Ambrosia trifida
MTSFIESGWTYLITNFSDFQLACLGSFLLHESVFFLSGLPFIYLERAGWLSKYKIQTKHNTTEAQDKCITRLLLYHFCVNLPVMIASYPVFRFMGMRSSLPLPSWKVMSTQILFYFIVEDFIFYWGHRILHTKWLYKHVHSVHHEYATPFGLTSEYAHPAEILFLGFATIFGPAITGPHLITLWLWMVVRVLETVEAHCGYHFPWSPSNFLPLYGGSDFHDYHHRLIYTKSGNYSSTFVYMDWLFGTDTGYRKLKALKSEEEDKYKEN

SEQ ID NO: 9666 - protein, 527 aa, Solanum lycopersicum
MECVGAQNVGAMAVFTRPRFKPLVGRRVMPRKKQSFWRMSSMKVKCNSSSGSDSCVVDKEDFADEEDYIKAGGSQLVFVQMQQKKDMDQQSKLSDELRQISAGQTVLDLVVIGCGPAGLALAAESAKLGLNVGLVGPDLPFTNNYGVWEDEFKDLGLQACIEHVWRDTIVYLDDDEPILIGRAYGRVSRHFLHEELLKRCVEAGVLYLNSKVDRIVEATNGQSLVECEGDVVIPCRFVTVASGAASGKFLQYELGGPRVSVQTAYGVEVEVDNNPFDPSLMVFMDYRDYVRHDAQSLEAKYPTFLYAMPMSPTRVFFEETCLASKDAMPFDLLKKKLMLRLNTLGVRIKEIYEEEWSYIPVGGSLPNTEQKTLAFGAAASMVHPATGYSVVRSLSEAPKCASVLANILRQNYSKNMLTSSSIPSISTQAWNTLWPQERKRQRSFFLFGLALILQLDIEGIRSFFRAFFRVPKWMWQGFLGSSLSSADLMLFAFYMFIIAPNDMRKGLIRHLLSDPTGATLIRTYLTF

SEQ ID NO: 9667 - protein, 527 aa, Solanum phureja
MECVGAQNVGAMAVFTRPRLKPLVGRRIMPRKKQSFWPMSSMKVKCNSSSGSESCVVDKEDFADEEDYIKAGGSQLVFVQMQQKKDMDQQSKLSDELQQISAGQTVLDLVVIGCGPAGLALAAESAKLGLNVGLVGPDLPFTNNYGVWEDEFKDLGLQACIEHVWRDTIVYLDDDDPILIGRAYGRVSRHLLHEELLKRCVEAGVLYLNSKVDRIVEATNGHSLVECEGDVVIPCRFVTVASGAASGKFLQYELGGPRVSVQTAYGVEVEVDNNPFDPSLMVFMDYRDYVRHDAQSLEAKYPTFLYAMPMSPTRVFFEETCLASKDAMPFDLLKKKLMLRLNTLGVRIKEIYEEEWSYIPVGGSLPNTEQKTLAFGAAASMVHPATGYSVVRSLSEAPKCAFVLANILRQNHSKNMLTSSSTPSISTQAWNTLWPQERKRQRSFFLFGLALILQLDIEGIRSFFRAFFRVPKWMWQGFLGSSLSSADLMLFAFYMFIIAPNDMRRGLIRHLLSDPTGATLIRTYLTF

SEQ ID NO: 9668 - protein, 523 aa, Nicotiana benthamiana
MECVGARNFATMAVFTCPRFNSLERRRIIPRKKQPFWPIHMKVKCSGSDSCVVVKEDFADEEDYIKAGGSELVFVQMQQNKDMDLQSKLSNKLRQISAGQTILDLVVIGCGPAGLALAAESAKLGLNVGLVGPDLPFTNNYGVWEDEFKDLGLQACIEHVWRDTIVYLDDSDPILIGRAYGRVSRHLLHEELLKRCVEAGVLYLNSKVDRIVESTSGHSLVECEGDIVIPCRFVTVASGAASGKFLQYELGGPRVSVQTAYGVEVEVDNNPFDPSVMVFMDYRDYVRHDAQSLEAKYPTFLYAMPMTKTRVFFEETCLASKDAMPFDLLKKKLMLRLNTLGIKIKKIYEEEWSYIPVGGSLPNTEQKTLAFGAAASMVHPATGYSVVRSLSEAPKCASVLANILRQNHVKDMLISSSTTSISTQAWNTLWPQERKRQRSFFLFGLALILQLDIEGIRSFFRAFFLVPKWMWQGFLGSSLSSADLMLFAFYMFIIAPNDMRKGLIRHLLSDPTGATMIRTYLTF

SEQ ID NO: 9669 - protein, 524 aa, Nicotiana benthamiana
MECIGGQNFATMAVFACPRFKSLGKRRIMPIKKQLFWPIHMKVKCRGSDSCVVVKEDFADEEDYIKAGGSELVFVQMQQNKDMELQSKLSNKLRQISSAGQTILDLVVIGCGPAGLALAAESAKLGLNVGLVGPDLPFTNNYGVWEDEFKDLGLQACIEHVWRDTIVYLDDADPILIGRAYGRVSRHLLHEELLKRCVEAGVLYLNSKVDRIVESTSGHSLVECEGDIVIPCRFVTVASGAASGKFLQYELGGPRVSVQTAYGVEVEVDNNPFDPSVMVFMDYRDYVRHDAQSLEAKYPTFLYVMPMTKTRVFFEETCLASKDAMPFDLLKKKLMLRLNTLGIKIKKIYEEEWSYIPVGGSLPNTEQKTLAFGAAASMVHPATGYSVVRSLSEAPKCASVLANILRQNHAKNMVTSSSTISISTQAWNTLWPQERKRQRSFFLFGLALILQLDIEGIRSFFRTFFRVPKWMWQGFLGSSLSSADLMLFAFYMFIIAPNDMRKGLIRHLLSDPTGATMIRTYLTF

SEQ ID NO: 9670 - protein, 319 aa, Arabidopsis lyrata
MDGTTYQRFPKINIRELKDDYAKFELRETDVSMANALRRVMISEVPTIAIDLVNIEVNSSVLNDEFIAQRLGLIPLTSERAMSMRFCQDCDACDGEGQCEFCSVEFPLSAKCVTDQTLDVTSRDLYSADPTVTPVDFTIDSSASDSSEQKGITIVKLRRGQELKLKAIARKGIGKDHAKWSPAATVTFMYEPDIIINEDLMDTLTDEEKIDLIESSPTKVFGIDPVTRQVVVVDPEAYTYDEEVIKKAEAMGKPGLIEIYPKHDSFVFTVESTGALKASQLVLNAIDILKQKLDAICLSDDTVEADDQFGELSAHMRGG

SEQ ID NO: 9671 - protein, 319 aa, Arabidopsis lyrata
MDGATYQRFPKITIRELKDDYAKFELRETDVSMANALRRVMISEVPTVAIDLVEIEVNSSVLNDEFIAHRLGLIPLTSERAMSMRFSRDCDACDGDGQCEFCSVEFRLSAKCVTDQTLDVTSRDLYSADPTVTPVDFTIDSSASDSSEQKGIIIVKLRRGQELKLRAIARKGIGKDHAKWSPAATVTFMYEPDIIINEDMMDTLSDEEKIDLIESSPTKVFGIDPVTRQVVVVDPEAYTYDEEVIKKAEAMGKPGLIEIHPKDDSFIFTVESTGAVKASQLVLNAIDILKQKLDAVRLSDDTVEADDQFGELGAHMRGG

SEQ ID NO: 9672 - protein, 320 aa, Eutrema parvulum
MDTGATYQRFPKVKIRELKDDYAKFELRDTDVSMANALRRVMISEVPTVAIDLVEIEVNSSVLNDEFIAHRLGLIPLTSERAMSMRFSRDCDACDGDGQCEFCSVEFRLSAKCVTDQTLDVTSRDLYSADPTVTPVDFGIDSSGTDSTEQRGIIIVKLRRGQELKLRAIARKGIGKDHAKWSPAATVTFMYEPDININEDMMDTLTDEEKIDLIESSPTKVFGFDSATRQVVVVDPEAYTYDEEVVKKAEAMGKPGLIEIHPKDDSFIFTVESTGAVKASQLVLNAIDILKQKLDAVRLSDDTVEADDQFGELGAHMRGG

SEQ ID NO: 9673 - protein, 320 aa, Eutrema parvulum
MDTGASYQRFPKVKIRELKDDYAKFELRDTDVSMANALRRVMISEVPTVAIDLVEIEVNSSVLNDEFIAHRLGLIPLTSERAMSMRFSRDCDACDGDGQCEFCSVEFRLSAKCVTDQTLDVTSRDLYSADPTVTPVDFGIDSSGTDSTEQRGIIIVKLRRGQELKLRAIARKGIGKDHAKWSPAATVTFMYEPDININEDMMDTLTDEEKIDLIESSPTKVFGFDSATRQVVVVDPEAYTYDEEVVKKAEAMGKPGLIEIHPKDDSFIFTVESTGAVKASQLVLNAIDILKQKLDAVRLSDDTVEADDQFGELGAHMRGG

SEQ ID NO: 9674 - protein, 319 aa, Brassica juncea
MDSGATYQRFPKVKIRELKDDYAKFELRDTDVSMANALRRVMISEVPTVAIDLVEIEVNSSVLNDEFIAHRLGLIPLTSERAMSMRFSRDCDACDGDGQCEFCSVEFRLSAKCVTDQTLDVTSRDLYSADPTVTPVDFGDSSGADSSEQRGIIIVKLRRGQELKLRAIARKGIGKDHAKWSPAATVTFMYEPDIVINEDMMDTLTDEEKIDLIESSPTKVFDFDAVTRQVVVVDPEAYTYDEEVIKKAEAMGKEGLIEIRPKDDSFIFTVESTGAVKASQLVLNAIDLLKQKLDAVRLSDDTVEADDQFGELGAHMRGG

SEQ ID NO: 9675 - protein, 319 aa, Brassica oleracea
  misc_feature (225)..(225): Xaa can be any naturally occurring amino acid
  misc_feature (254)..(254): Xaa can be any naturally occurring amino acid
MDSGATYQRFPKVKIRELKDDYAKFELRDTDVSMANALRRVMISEVPTVAIDLVEIEVNSSVLNDEFIAHRLGLIPLTSERAMSMRFSRDCDACDGDGQCEFCSVEFRLSAKCVTDQTLDVTSKDLYSADPTVTPVDFGDSSGADSSEQRGIIIVKLRRGQELKLRAIARKGIGKDHAKWSPAATVTFMYEPDIIINEDMMDTLTDDEKIDLIESSPTKVFDFDXVTRQVVVVDPEAYTYDEEVIKKAEAMGKXGLIEIRPKDDSFIFTVESTGAVKASQLVLNAIDLLKQKLDAVRLSDDTVEADDQFGELGAHMRGG

SEQ ID NO: 9676 - protein, 319 aa, Unknown
  Sequence found in Organisms: Brassica napus, Brassica rapa
MDSGATYQRFPKVKIRELKDDYAKFELRDTDVSMANALRRVMISEVPTVAIDLVEIEVNSSVLNDEFIAHRLGLIPLTSERAMSMRFSRDCDACDGDGQCEFCSVEFRLSAKCVTDQTLDVTSKDLYSADPTVTPVDFGDSSGADSSEQRGIIIVKLRRGQELKLRAIARKGIGKDHAKWSPAATVTFMYEPDIIINEDMMDTLTDDEKIDLIESSPTKVFDFDAVTRQVVVVDPEAYTYDEEVIKKAEAMGKQGLIEIRPKDDSFIFTVESTGAVKASQLVLNAIDLLKQKLDAVRLSDDTVEADDQFGELGAHMRGG

SEQ ID NO: 9677 - protein, 349 aa, Raphanus sativus
DLQGRRKVKKLSLSLSASPSFENPKKLREMDSGATYQRFPKVKIRELKDDYAKFELRDTDVSMANALRRVMISEVPTVAIDLVEIEVNSSVLNDEFIAHRLGLIPLTSERAMSMRFSRDCDACDGDGQCEFCSVEFHLRAKCITDQTLDVTSRDLYSADPTVTTVDFGLDSSGADSSEQRGIIIVKLRRGQELKLRAIARKGIGKDHAKWSPAATVTFMYEPDIVINEDMMDTLTDEEKIDLIESSPTKVFDFDAVTRQVVVVDPEAYTYDEEVIKKAEAMGKPGLIEIRPKDDSFIFTVESTGAVKASQLVLNAIDLLKQKLDAVRLSDDTVEADDQFGELGAHMRGG

SEQ ID NO: 9678 - protein, 320 aa, Eutrema halophilum
MDTGASYQRFPKVKIRELKDDYAKFELRETDVSMANALRRVMISEVPTVAIDLVEIDINSSVLNDEFIAHRLGLIPLTSERAMSMRLSRDCDSCDGDGQCEFCSVEFRLQAKCVTDQTLDVTSRDLYSTDPTVTPVDFTLDSSGTDSSEQRGIIIVKLRRGQELKLRAIARKGIGKDHAKWSPASTVTFMYEPDININEDMMDTLTEDEKIDLIESSPTKVFGIDPVTRQVVVVDPEAYTYDEEVIKKAEAMGKPGLIEIHPKDDSFIFTVESTGAVKASQLVLNAIDILKQKLDAVRLSDDTVEADDQFGELGAHLRGG

SEQ ID NO: 9679 - protein, 320 aa, Eutrema halophilum
MDTGASYQRFPKVKIRELKDDYAKFELRETDVSMANALRRVMISEVPTVAIDLVEIMINSSVLNDEFIAHRLGLIPLTSERAMSMRFSRDCDACDGDGQCEFCSVEFQLGAKCVTDQTLDVTSRDLYSADPTVTPVDFATDPSATDSSEQRGIIIVKLRRGQELKLRAIARKGIGKDHAKWSPAATVTFMYEPDININEDMVDTLTDEEKFDLIESSPTKVFGIDPVTRQVVVVDPEAYTYDEEVIKKAEALGKPGLIEIHPKDDSFIFTVETTGAVKASQLVLNAIDILKQKLDAVRLSDDTVEADDQFGELGAHMRGG

SEQ ID NO: 9680 - protein, 321 aa, Brassica rapa
MDTGATYQRFPKVKIRELKDDYAKFELRDTDVSMANALRRVMISEVPTVAIDLVEIEVNSSVLNDEFIAHRLGLIPLTSERAMNMRFSRDCDACDGDGQCEFCSVEFHLSAKCVTDQTLDVTSRDLYSADATVTPVDFGVDSSGVADSGEQRGIIIVKLRRGQELKLRAIARKGIGKDHAKWSPAATVTFMYEPDIIINEDMMDTLTDEEKIDLIESSPTKVFDFDSVTRQVVVVDPEAYTYDEEVIKKAEAMGKVGLVEIRPKDDSFIFTVESTGAVKASQLVLNAIVLLKQKLDAVRLSDDTVEADDQFGELGAHMRGG

SEQ ID NO: 9681 - protein, 310 aa, Brassica napus
GTRKVKIRELKDDYAKFELRDTDVSMANALRRVMISEVPTVAIDLVEIEVNSSVLNDEFIAHRLGLIPLTSERAMSMRFSRDCDACDGDGQCEFCSVEFHLRAKCVTDQTLDVTSRDLYSADATVTPVDFGVDSSDSGEQRGIIIVKLRRGQELKLRAIARKGIGKDHAKWSPAATVTFMYEPDIIINEDMMDTLTDEEKIDLIESSPTKVFDFDSVTRQVVVVDPEAYTYDEEVIKKAEAMGKVGLIEIRPKDDSFIFTVESTGAVKASQLVLNAIDLLKQKLDAVRLSDDTVEADDQFGELGAHMRGG

SEQ ID NO: 9682 - protein, 318 aa, Theobroma cacao
MEGVSYQRFPKVKIRELKDDYAKFELRDTDASMANALRRVMIAEVPTIAIDLVEIEVNSSVLNDEFIAHRLGLIPLTSERAMSMRFSRDCDACDGDGQCEFCSVEFHLRAKCMTDQTLDVTSKDLYSSDHTVVPVDFTDSAGYDSSEQRGIIIVKLRRGQELRLRAIARKGIGKDHAKWSPAATVTFMYEPEIHINEDMMETLTLEEKQSFVESSPTRVFDIDPNTQQVVVVDPEAYTYDDEVLKKAEAMGKPGLVEIYAKEDSFIFTVESTGAIKASQLVLNAIEVLKQKLDAVRLSEDTVEADDQFGELGAHMRGG

SEQ ID NO: 9683 - protein, 318 aa, Ricinus communis
MEGASYQRFPRIKIRELKDDYCKFELRDTDASMANALRRVMIAEVPTVAIDLVEIEVNSSVLNDEFIAHRLGLIPLTSERAMSMRFSRDCDACDGDGQCDYCSVEFHLRAKCITDQTLDVTSKDLYSSDHTVVPVDFSDSSGYDSSEQRGIIIVKLRRGQELRLRAIARKGIGKDHAKWSPAATVTFMYEPDIHINEDLMESLSLEEKQSWVESSPTKVFDIDPNTQQVVVVDPEAYTYDEEVIKKAESMGKPGLVNIQAKEDSFIFTVESTGAIKASQLVLNAIEILKQKLDAVRLSEDTVEADDQFGELGAHMRGG

SEQ ID NO: 9684 - protein, 318 aa, Unknown
  Sequence found in Organisms: Gossypium hirsutum, Gossypium raimondii
MEGISYQRFPKVKIRELKDDYAKFELRDTDASMANALRRVMISEVPTIAIDLVEIEVNSSVLNDEFIAHRLGLIPLTSERAMSMRFSRDCDACDGDGQCEFCSVEFHLRAKCISDQTLDVTSKDLYSSDHTVVPVDFTDNAGYDSTEPRGIIIVKLRRGQELRLRAIARKGIGKDHAKWSPAATVTFMYEPEIHINEDLMESLTLEEKLSFVESSPTKVFDIDPNTQQVVVVDPEAYTYDDEVLKKAEAMGKPGLVEIYAKEDSFIFTVESTGAIKASQLVLNAIEILKQKLDAVRLSEDTVEADDQFGELGAHMRGG

SEQ ID NO: 9685 - protein, 318 aa, Gossypium raimondii
MEGASYQRFPRVKIRELKDDYAKFELHDTDASMANALRRVMIAEVPTIAIDLVEIEVNSSVLNDEFIAHRLGLIPLTSQRAMSMRFSRDCDACDGDGQCEFCSVEFHLRAKCISDQTLDVTSKDLYSSDHTVVPVDFTDSAGYESSEQRGIIIVKLRRGQELRLRAIARKGIGKDHAKWSPAATVTFMYEPEIHINEDMMDTLTLEEKQSFVDSSPTRVFDIDPNTQQVVVVDPEAYTYDDEVLKKAEAMGKPGLVEIYAKEDSFIFTIESTGAVKASQLVLNAIEILKQKLDAVRLSEDTVEADDQFGELGAHMRGG

SEQ ID NO: 9686 - protein, 318 aa, Manihot esculenta
MEGVSYQRFPRVKIRELKDDYAKFELRDTDASIANALRRVMIAEVPTIAIDLVEIEVNSSVLNDEFIAHRLGLIPLTSERAMSMRFSRDCDACDGDGQCEYCSVEFHLRAKCITDQTLDVTSKDLYSSDHTVVPVDFSDPAGYDSPDQKGIIIVKLRRGQELRLRAIARKGIGKDHAKWSPAATVTFMYEPDIHINEDLMETLTLEEKQSWVESSPTKVFDIDPVTQQVVVVDPEAYTYDDEVIKKAEAMGKLGLVDISAKEDSFIFTVESTGAIKASQLVLNAIEVLKQKLDAVRLSEDTVEADDQFGELGAHMRGG

SEQ ID NO: 9687 - protein, 319 aa, Sarracenia psittacina
MEGASYQRFPKVKIRELKDDYCKFELRDTDASMANALRRVMIAEVPTIAIDLVEIEVNSSVLNDEFIAHRLGLIPLTSDRAMSMRFSRDCDACDGDGQCEFCSVEFHLRAKCINDQTLDVTSKDLYSSDHTVVPVDFSDSGSGIDTPEQRGIIIVKLRRGQELRLRAIARKGIGKDHAKWSPAATVTFMYEPDIHINEDMMETLTLEEKISWVESSPTKVFDIDPTTQQVVIVDPEAYTYDDEVIKKAEAMGKPGLVEIYAKEDSFIFTVESSGAVKASQLVLNAIEILKQKLDAVRLSEDTVEADEQFGELGAHMRGG

SEQ ID NO: 9688 - protein, 318 aa, Vitis vinifera
MEGVSYQRFPKIKIREVKDDYAKFELRETDASMANALRRVMIAEVPTVAIDLVEIEVNSSVLNDEFIAHRLGLIPLTSERAMSMRFSRDCDACDGDGQCEFCSVEFHLRAKCMTDETLDVTSKDLISSDHTVVPVDFSDSSGYDSADKKGIIIVKLRRGQELRLRAIARKGIGKDHAKWSPAATVTFMYEPEIHINEDLMESLTLEEKTSWVESSPTKVFDIDASSQQVVVADAEAYTYDDEVLKKAEAMGKPGLVEIYAKEDSFIFTVESTGAIKASQLVLNAIDVLKQKLDAVRLSEDTVEADDQFGELGAHMRGG

SEQ ID NO: 9689 - protein, 318 aa, Unknown
  Sequence found in Organisms: Gossypium hirsutum, Gossypium raimondii
MEGASYQRFPRVKIRELKDDYAKFELHDTDASMANALRRVMIAEVPTIAIDLVEIEVNSSVLNDEFIAHRLGLIPLTSQRAMSMRFSRDCDACDGDGQCEFCSVEFHLRAKCISDQTLDVTSKDLYSSDHTVVPVDFTDYAGYESSEQRGIIIVKLRRGQELRLRAIARKGIGKDHAKWSPAATVTFMYEPEIHINEDMMDTLTLEEKQSFVDSSPTRVFDIDPNTQQVVVVDPEAYTYDDEVLKKAEAMGKPGLVEIYAKEDSFIFTIESTGAVKASQLVLNAIEILKQKLDAVRLSEDTVEADDQFGELGAHMRGG

SEQ ID NO: 9690 - protein, 319 aa, Unknown
  Sequence found in Organisms: Citrus clementina, Citrus sinensis
MDGASYQRFPKVKIRELKDDYAKFELRDTDASMANALRRVMIAEVPTIAIDLVEIEVNSSVLNDEFIAHRLGLIPLTSERAMSMRFSRDCDACDGDGQCEFCSVEFHLRAKCHSDQTLDVTSKDLYSSDHSVVPVDFVDPAGYDSTDQQRGIIIVKLRRGQELRLRAIARKGIGKDHAKWSPAATVTFMYEPEIHINEDLMESLSLEEKQSWVESSPTKVFDIDPNTGQVYVVDAEAYTYDDEVIKKAEAMGKPGLVEIYAKEDSFIFTVESTGAIKASQLVLNAIEVLKQKLDAVRLSEDTVEADDQFGELGAHMRGG

SEQ ID NO: 9691 - protein, 318 aa, Gossypium hirsutum
MEGASYQRFPRVKIRELKDEYAKFELHDTDASMANALRRVMIAEVPTIAIDLVEIEVNSSVLNDEFIAHRLGLIPLTSQRAMSMRFSRDCDACDGDGQCEFCSVEFHLRAKCISDQTLDVTSKDLYSSDHTVVPVDFTDSAGYESSEQRGIIIVKLRRGQELRLRAIARKGIGKDHAKWSPAATVTFMYEPEIHINEDMMDTLTLEEKQSFVDSSPTRVFDIDPNTQQVVVVDPEAYTYDDEVLKKAEAMGKPGLVEIYAKEDSFIFTIESTGAVKAFQLVLNAIEILKQKLDAVRLSEDTVEADDQFGELGAHMRGG

SEQ ID NO: 9692 - protein, 318 aa, Vitis vinifera
MEGVSYQRFPKIKIREVKDDYAKFELRETDASMANALRRVMIAEVPTVAIDLVEIEVNSSVLNDEFIAHRLGLIPLTSERAMAMRFSRDCDACDGDGQCEFCSVEFHLRAKCMTDETLDVTSKDLISSDHTVVPVDFSDSSGYDSADKKGIIIVKLRRGQELRLRAIARKGIGKDHAKWSPAATVTFMYEPEIHINEDLMESLTLEEKTSWVESSPTKVFDIDASSQQVVVADAEAYTYDDEVLKKAEAMGKPGLVEIYAKEDSFIFTVESTGAIKASQLVLNAIDVLKQKLDAVRLSEDTVEADDQFGELGAHMRGG

SEQ ID NO: 9693 - protein, 319 aa, Panax ginseng
MEGGASYQRFPTVKIRELKDDYAKFELRDTDASIANALRRVMIAEVPTVAIDLVEIEVNSTVLNDEFLAHRLGLIPLTSERAMSMRFSRDCDACDGDGQCEFCSVEFHLRAKCINDQTLDVTSKDLYSSDHTVVPVDFSDSSGYENSEQRGIIIVKLRRGQELKLRAIARKGIGKDHAKWSPAATVTFMYEPAIHINEDMMESLTLQEKQSFIDSSPTKVFDIDPETQQVKVVDAEAYTYDDEVLKKAEAMGKPGLVEIYAKEDSFIFTVESTGAIKASQLVLNAIDILKQKLDAVRLSDDTVEADEQFGELGAHMRGG

SEQ ID NO: 9694 - protein, 319 aa, Vaccinium corymbosum
MEGASYQRFPRVKIREMKDDYCKFELHSTDASMANALRRVMIAEVPTVAIDLVEIEVNSSVLNDEFIAHRLGLIPLTSDRAMSMRFSRDCDACDGDGQCEFCSVEFHLRAKCINDQTLDVTSKDLYSSDHTVVPVDFSDSGSGIENSEQRGIIIVKLRRGQELRLRAIARKGIGKDHAKWSPAATVTFMYEPEIHINEDMMDTLTLDEKKSWVESSPTKVFDIDPNTQQVVVVDPEAYTYDDEVIKKAEAMGKSGLVEIYAKEDSFIFTVESTGAIKASQLVLNAIDILKQKLDAVRLSEDTVEADEQFGELGAHMRGG

SEQ ID NO: 9695 - protein, 320 aa, Lactuca sativa
MEGASYQRFPKVKIRELKDDYAKFELRETDASVANALRRVMIAEVPTIAIDLVEIEVNSSVLNDEFIAHRLGLIPLTSERAMSMRFSRDCDACDGDGQCEFCSVEFHLRAKCINDQTLDVTSKDLYSSDHTVVPVDFSDTSSGFENPEDQRGITIVKLRKGQELRLRAIARKGIGKDHAKWSPAATVTFMYEPEIHINEEMMETLSLEEKTSVVESSPTKVFGINPHTQQVEVVDPEAYTYDDEVLKKVEAMGKPGLVEIYAKEDSFIFTVESTGAVKASQLVLNAIEVLKQKLDAVRLSEDTVEADDQFGELGAHMRGG

SEQ ID NO: 9696 - protein, 320 aa, Tragopogon dubius
MEGASYQRFPKVKIRELKDDYAKFELRETDASMANALRRVMIAEVPTIAIDLVEIEVNSSVLNDEFIAHRLGLIPLTSERAMSMRFSRDCDACDGDGQCEFCSVEFHLRAKCINDQTLDVTSKDLYSSDHTVVPVDFSDTSSGFENPEDQRGITIVKLRKGQELRLRAIARKGIGKDHAKWSPAATVTFMYEPEIHINEEMMESLSLEEKTSVVESSPTKVFGINPHTHQVDVVDPEAYTYDDEVLKKVEAMGKPGLVEIYAKEDSFIFTVESTGAVKASQLVLNAIEVLKQKLDAVRLSEDTVEADDQFGELGAHMRGG

SEQ ID NO: 9697 - protein, 320 aa, Cucurbita pepo
MEGASYQRFPKVKIRELRDDYAKFELHDTDVSMANALRRVMIAEVPTIAIDLVEIEVNSSVLNDEFIAHRLGLIPLTSERAMSMRFSRDCDACDGDGQCEFCSVEFHLRAKCHSDQTLDVSSKDLYSSDHTVVPVDFSDSAAAAGEALDTKGIIIVKLRRGQELRLRAIARKGIGKDHAKWSPAATVTFMYEPSIHINEDLMETLTLEEKTSWVESSPTKVFELDPVTHQVLVVDPEAYTYDDEVIKKAEAMGKAGLVDITAKEDSFIFTVESTGAIKASQLILNAIDILKQKLDAVRLSDDTVEADDQFGELGAHMRGG

SEQ ID NO: 9698 - protein, 317 aa, Castanea mollissima
MDGGMSYQRFPKVKIREMKDDMVKFELRETDASVANALRRVMIAEVPTVAIDLVEIEVNSSVLNDEFIAHRLGLIPLTSDRAMSMRFSRDCDACDGDGQCEFCSVEFHLRAKCLTDQTLDVTSKDLYSSDHTVVPVEFSDPNDPGEQRGIIIVKLRRGQELRLRAIARKGIGKDHAKWSPAATVTFMYEPTIRINEDLMETLSLEEKRTWIDSSPTKVFDIDPVTQQVVVVEPEAYTYDDEVIKKADAMGKSGLVEIEAKEDSFIFTVESTGAIKASQLVLNAIEILKQKLDAVRLSDDTVEADDQFGELGAHLRGG

SEQ ID NO: 9699 - protein, 317 aa, Tropaeolum majus
GGRIVSAIPKVKIREMKDDMCKFELRDTDASVANALRRVMISEVPTVAIDLVEIEVNSSVLGDEFIAHRLGLIPLTSERAMSMRFSRDCDACDGDGQCEFCSVEFHLRAKCLTDQTLDVTSKDLYSSDHTVVPVDFTDNAGYDSSEQRGIIIVKLRRGQELRLRAIARKGIGKDHAKWSPAATVTFMYEPDIHINEDLMQTLTLEEKLAWIESSPTKVFHLDPNTHQVVVADAEAYTYDDEVIKKAEAMGKPGLVEVYAKEDSFIFTVESTGAIKASQLVLNAIDILKQKLDAVRLSEDTVEADDQFGELGAHMRGG

SEQ ID NO: 9700 - protein, 319 aa, Glycine max
MEGGVSYARMPRVKIRELKDDYAKFELRDTDASIANALRRVMIAEVPTVAIDLVEIEVNSSVLNDEFIAHRLGLIPLTSERAMSMRFSRDCDACDGDGQCEFCSVEFHLRVKCMTDQTLDVTSKDLYSSDPTVSPVDFSDPSATDSDNNRGIIIVKLRRGQELKLRAIARKGIGKDHAKWSPAATVTFMYEPEIHINEDLMETLTLEEKREWVDSSPTRVFEIDPVTQQVMVVDAEAYTYDDEVLKKAEAMGKPGLVEIIARQDSFIFTVESTGAVKASQLVLNAIEILKQKLDAVRLSEDTVEADDQFGELGAHMRGG

SEQ ID NO: 9701 - protein, 320 aa, Helianthus annuus
MDGASYQRFPKVKIRELKDDYVKFELRETDASMANALRRVMIAEVPTIAIDLVEIEVNSSVLNDEFIAHRLGLIPLTSERAMSMRFSRDCDACDGDGQCEFCSVEFHLRAKCINDQTLDVTSKDLYSSDHTVVPVDFSDPGSGFENPEDQRGITIVKLRKGQELRLRAIARKGIGKDHAKWSPAATVTFMYEPEIHINEEMMETLSLEEKTSVVESSPTKVFALNPQTQQVEVVDPEAYTYDDEVLKKVEAMGKPGLIEIYAKEDSFIFTVESTGAVKASQLVINAIDVLKQKLDAVRLLEDTVEADDQFGELGAHMRGG

SEQ ID NO: 9702 - protein, 320 aa, Glycine max
MEGGVSYARMPRVKIRELKDDYAKFELRDTDASIANALRRVMIAEVPTVAIDLVEIEVNSSVLNDEFIAHRLGLIPLTSERAMSMRFSRDCDACDGDGQCEFCSVEFHLRVKCMTDQTLDVTSKDLYSSDPTVSPVDFSDPSATDSPDNNRGIIIVKLRRGQELKLRAIARKGIGKDHAKWSPAATVTFMYEPEIHINEDLMETLTLEEKREWVDSSPTRVFEIDPVTQQVMVVDAEAYTYDDEVLKKAEAMGKPGLVEIIARQDSFIFTVESTGAVKASQLVLNAIEILKQKLDAVRLSEDTVEADDQFGELGAHMRGG

SEQ ID NO: 9703 - protein, 317 aa, Quercus alba
MDGGMSYQRFPKVKIREMKDDMVKFELRETDASVANALRRVMIAEVPTVAIDLVEIEVNSSVLNDEFIAHRLGLIPLTSDRAMSMRFSRDCDACDGDGQCEFCSVEFHLRAKCLTDQTLDVTSKDLYSSDHTVVPVEFSDPNDPGEQRGIIIVKLRRGQELRLRAIARKGIGKDHAKWSPAATVTFMYEPTIRINEDLMETLSLEEKRTWIDSSPTKVFDIDPVTQQVVVVEPELYTYDDEVIKKADAMGKSGLVEIEAKEDSFIFTVESTGAIKASQLVLNAIEILKQKLDAVRLSDDTVEADDQFGELGAHLRGG

SEQ ID NO: 9704 - protein, 319 aa, Solanum melongena
MEGVTYQRFPKVKIREVKDDYMKFELRDTDASIANALRRVMIAEVPTIAIDLVEIEVNSSVLNDEFISHRLGLIPLTSERAMSMRFSRDCDACDGDGQCEFCSVEFYLRVKCLSDQTLDVTSKDLLSSDHTVVPVDYSGASSGFDNTPNKGIIIVKLRRGQELRLRAIARKGIGKDHAKWSPAATVTFMYEPDIYINEDMMESLTLEEKTELVESSPTKVFAIDPESKQVIVVDPEAYTYDDEVLKKVEAMGKPGLVEIHAKEDSFIFTVETTGAVKASQLVLNAIEVLKQKLDAVRLSDDTVEADDQFGELGAHMRGG

SEQ ID NO: 9705 - protein, 321 aa, Centaurea maculosa
MEGAASYQRFPKVKIRELKDDYAKFELRETDASMANALRRVMIAEVPTIAIDLVEIEVNSSVLNDEFIAHRLGLIPLTSERAMSMRFSRDCDACDGDGQCEFCSVEFHLRAKCINDQTLDVTSKDLYSSDHTVVPVDFSDSGSGFENNEDQRGITIVKLRKGQELRLRAIARKGIGKDHAKWSPAATVTFMYEPEIHINEEMMETLSLEEKTSVVDSSPTKVFGINPHTQQVEVVDREAYTYDDEVLKKVEAMGKPGLVEIYAKEDSFIFTVESTGAVKASQLVLNAIEVLKQKLDAVRLSEDTVEADDQFGELGAHMRGG

SEQ ID NO: 9706 - protein, 320 aa, Cichorium intybus
MEGASYQRFPKVKIRELKDDYAKFELRETDASVANALRRVMIAEVPTIAIDLVEIEVNSSVLNDEFIAHRLGLIPLTSERAMSMRFSRDCDACDGDGQCEFCSVEFHLRAKCINDQTLDVTSKDLYSSDHTVVPVDFSDTGSGFDNPEDQRGITIVKLRKGQELRLRAIARKGIGKDHAKWSPAATVTFMYEPEIHINEEMMETLSLEEKTSVVDSSPTKVFGINPHTLQVEVVDPEAYTYDDEVLKKVKAMNKPGLVEIYAKEDSFIFTVESTGAVKASQLVLNAIEVLKQKLDAVRLSEDTVEADDQFGELGAHMRGG

SEQ ID NO: 9707 - protein, 320 aa, Nicotiana benthamiana
MEGVSYQRFPRIKIREVKDDYMKFELLDTDASIANALRRVMIAEVPTIAIDLVEIEVNSSVLNDEFISHRLGLIPLTSERAMSMRFSRDCDACDGDGQCEYCSVEFYLRVKCLSDQTLDVTSKDLLSSDHTVVPVDYSDASSGFDNSTNKGIIIVKLRRGQELRLRAIARKGIAKDHAKWSPAATVTFMYEPDIYINEDMMETLSLEEKRELVDSSPTKVFGIDPETENKVIVVDPEAYTYDDEVLKKCEAMGKPGLIEIHAKEDSFIFTVETTGAVKASQLVLNAIEVLKQKLDAVRLSDDTVEADDQFGELGAHMRGG

SEQ ID NO: 9708 - protein, 320 aa, Citrullus lanatus
MEGSSYQRFPKVKIRELRDDYAKFELRDTDASMANALRRVMIAEVPTIAIDLVEIEVNSSVLNDEFIAHRLGLIPLTSERAMSMRFSRDCDACDGDGQCEFCSVEFHLRAKCHSDQTLDVTSKDLYSSDHTVVPVDFSDSAAASGEALDTKGIIIVKLRRGQELRLRAIARKGIGKDHAKWSPAATVTFMYEPNIHINEDLMETLTLEEKRTWVESCPTRVFELDPVTHQVMVVDPEAYTYDDEVIKKAEAMGKAGLVDITAKEDSFIFTVESTGAIKASQLILNAIDILKQKLDAVRLSDDTVEADDQFGELGAHMRGG

SEQ ID NO: 9709 - protein, 172 aa, Fagus grandifolia
MDGGMSYQRFPKVKIREVKDDIMKFELRETDASLANALRRVMIAEVPTIAIDLVEIEVNSSVLNDEFIAHRLGLIPLTSERAMSMRFSRDCDACDGDGQCEFCSVEFHLRAKCLTDQTLDVTSKDLYSSDHTVVPVDFLRSQRAWRAKGNYHSEVASWTRTEAEGYSEKRDW

SEQ ID NO: 9710 - protein, 76 aa, Taraxacum officinale
MEGASYQRFPKVKIRELKDDYAKFAQRNRRQHGQCTPSRHDSRGSDHRHRSRRNRSQLICSRRRVHCTSSWPYSSH

SEQ ID NO: 9711 - protein, 319 aa, Cicer arietinum
MEGASYARMPRVKIRELKDDYMKFELRDTDASVANALRRVMISEVPTIAIDLVEIEVNSSVLNDEFIAHRLGLIPLTSERAMAMRFSRDCDACDGDGQCEYCSVEFHLRVKCITDQTLDVTSKDLYSSDHTVVPVDFSADPSSLESSDGRGIIIVKLRRGQELRLRAIARKGIGKDHAKWSPAATVTFMYEPDIHINEDLMESLTLEEKREWVDSSPTRVFDIDPVTQQVMVVDPEAYSYDDEVIKKAEAMGKPGLVEITAKQDSFIFTVESTGAVKASQLLLNAIEILKQKLDAVRLSEDTVEADDQFGELGAHMRGG

SEQ ID NO: 9712 - protein, 320 aa, Echinacea purpurea
MEGASYQRFPKVKIRELKDDYVKFELRETDASMANALRRVMIAEVPTIAIDLVEIEVNSSVLNDEFIAHRLGLIPLTSERAMSMRFSRDCDACDGDGQCEFCSVEFHLRAKCINDQTLDVTSKDLYSSDHTVVPVDFSDSGSGFENPEDQRGITIVKLRKGQELRLRAIARKGIGKDHAKWSPAATVTFMYEPEIHINEEMMETLSLEDKISVVESSPTKVFALNPQTQQVEVVDPEAYTYDDEVLKKVEAMGKPGLIEIYAKEDSFIFTVESTGAIKASQLVINAIEVLKQKLDAVRLLEDTVEADDQFGELGAHMRGG

SEQ ID NO: 9713 - protein, 321 aa, Centaurea maculosa
  misc_feature (255)..(255): Xaa can be any naturally occurring amino acid
MEGAASYQRFPKVKIRELKDDYAKFELRETDASMANALRRVMIAEVPTIAIDLVEIEVNSSVLNDEFIAHRLGLIPLTSERAMSMRFSRDCDACDGDGQCEFCSVEFHLRAKCINDQTLDVTSKDLYSSDHTVVPVDFSDSGSGFENNEDQRGITIVKLRKGQELRLRAIARKGIGKDHAKWSPAATVTFMYEPEIHINEEMMETLSLEEKTSVVDSSPTKVFGINPHTQQVEVVDREAYTYDDEVLKKVEAMGXPGLVEIYAKEDSFIFTVESTGAVKASQLVLNAIEVLKQKLDAVRLSEDTVEADDQFGELGAHMRGG

SEQ ID NO: 9714 - protein, 320 aa, Flaveria ramosissima
MEGASYQRFPKVKIRELKDDYVKFELRETDASMANALRRVMISEVPTIAIDLVEIEVNSSVLNDEFIAHRLGLIPLTSERAMSMRFSRDCDACDGDGQCEFCSVEFHLRAKCISDQTLDVTSKDLYSSDHTVVPVDFSDSGAGYENPEDQRGITIVKLRKGQELRLRAIARKGIGKDHAKWSPAATVTFMYEPEIHINEEMMETLSLEEKTSVVESSPTKVFALNPHTHQVEVVDPEAYTYDDEVLKKVEAMGKPGLIEIYAKEDSFIFTVESTGAIKASQLVINAIEVLKQKLDAVRLLEDTVEADDQFGELGAHMRGG

SEQ ID NO: 9715 - protein, 318 aa, Catharanthus roseus
MDGVSYQRFPRVKIRELKDDFAKFELRDTDASIANALRRVMIAEVPTVAIDLVEIEVNSSVLNDEFIAHRLGLIPLTSGRAMSMRFSRDCDACDGDGQCDYCSVEFHLRAKCINDQTLDVTSKDLISADPSVVPVDFSDSSGFDNSENRGIIIVKLRRGQELHLRAIARKGIGKDHAKWSPAATVTFMYEPDIYINEEMMERLSLEQKRSIVDSSPTRVFDVDEKTGQFVVVDAEAYTYDDEVLKKCESMNLPGLIEIRPKEDSFIFTVETTGAVKASQLVLNAIDILKQKLDAVRLSDDTVEADDQFGELGAHMRGG

SEQ ID NO: 9716 - protein, 321 aa, Eucalyptus grandis
MEGGGGASYQRFPVVKVRETKDDYLKFELRGTDASVANALRRVMIAEVPTIAIDLVEIEVNSSVLNDEFIAHRLGLVPLTSDRAMSMRFSRDCDACDGDGQCEFCSVEFHLRAKCMTDQTLDVTSKDLISSDHTVVPVDFSDALADDSAEQKGITIVKLRRGQELRLRAIARKGIGKDHAKWSPAATVTFMYEPEIHINEDLVETLSLEEKQSWVESSPTKVFDIDPNTEQVLVVDPEAYTYDEEVIKKAEAMGKPGLVEIYAKEDSFIFTVESTGAIKASQLVLNAIDVLKQKLDAVRLSEDTVEADDQFGELGAHMRGG

SEQ ID NO: 9717 - protein, 320 aa, Artemisia annua
MDGQKSYQRYPTIKIRELKHDYAKFELRNTDASVANALRRVMISEVPTIAIDLVEIEVNSSVLNDEFIAHRLGLIPLTSERAMSMRFSRDCDACDGDGQCEFCSVEFHLRAKCINDNTLDVTSKDLYSSDHTVVPVDFSGDVGFDSGEEQRGITIVKLRKGQELRLRAIARKGIGKDHAKWSPAATVTFMYEPEIHINEEMMETLSLEEKTSVVESSPTKVFGINPHTQQVEVVDPEAYTYDDEVLKKVEAMGKPGLVEIYAKEDSFIFTVESTGAVKASQLVINAIDVLKQKLDAVRLSDETVETDDQFGELGAHMRGG

SEQ ID NO: 9718 - protein, 320 aa, Cucumis sativus
MEGSSYQRFPKVKIRELRDDYAKFELRDTDASMANALRRVMIAEVPTIAIDLVEIEVNSSVLNDEFIAHRLGLIPLTSERAMSMRFSRDCDACDGDGQCEFCSVEFHLRAKCHSDQTLDVTSKDLYSSDHTVVPVDFSDSAAATGEALDTKGIIIVKLRRGQELRLRAIARKGIGKDHAKWSPAATVTFMYEPSIHINEDLMETLTLEEKRTWVESCPTRVFELDTVTHQVMVVDPEAYTYDDEVIKKAEAMGKAGLVDITAREDSFIFTVESTGAIKASQLILNAIDILKQKLDAVRLSDDTVEADDQFGELGAHMRGG

SEQ ID NO: 9719 - protein, 317 aa, Euonymus alatus
MDGGISYQRFPRVKIREIKDDYLKFELRDTDASMANALRRVMIAEVPTIAIDLVEIEVNSSVLNDEFLAHRLGLIPLISERAMSMRFSRDCDACDGDGQCEFCSVEFHLRTKCHSDQTLDVTSKDLISSDHSVVPVDFSDLAGYDSSEQRGIIIVKLRRGQELRLRAIARKGIGKDHAKWSPAATVTFMYEPEIHINEEMMQTLTLEEKIALVESSPTKVLGMENQQVVVVDPEAYTYDDEVLKKAESMGKPGLIEINAREDSFIFTVESTGAIKASQLLLNAIEILKQKLDAVRLSEDTVEADDQFGELGAHMRGG

SEQ ID NO: 9720 - protein, 318 aa, Panax ginseng
MEGASYQRFPTVKIRELKDDYAKFELRDTDASIANALRRVMIAEVPIVAIDLVEIEVNSTVLNDEFIAHRLGLIPLTSERAMSMRFSRDCDACDGDGQCEFCSVEFHLRAKCINDQTLDVTSKDLYSSDHTVVPVDFSDSSGYENSEQRGIIIVKLSRGQELKLRAIARKGIGKDHAKWSSAATVTFMYEPAIHMNEDMIESLTLQDKQSFVNSSPTKVFEIDPETQQVKVVDPEAYTYDDEVLKKAEAMGKPGLVEIYAKEDSFIFTVESTGAIKASQLVLNAIDILKQKLDAVCLSDDTVEADEQFGELGAHMRGG

SEQ ID NO: 9721 - protein, 318 aa, Vigna unguiculata
MEGASYARMPRVKIRELKDDYAKFELRDTDASIANALRRVMIAEVPTIAIDLVEIEVNSSVLNDEFIAHRLGLIPLTSERAMSMRFSRDCDACDGDGQCEFCSVEFHLRVKCMTDQTLDVSSKDLYSSDPSVVPVDFSDPASSDSSESRGVIIVKLRRGQELRLRAIARKGIGKDHAKWSPAATVTFMYEPEIHINEDLMETLTLEEKREWVDSSPTRVFEIDPVTQQVMVVDAEAYSYDDEVLKKAEAMGKPGLVEIIARQDSFIFTVESTGAIKTSQLVLNAIEILKQKLDAVRLSEDTVEADDQFGELGAHMRGG

SEQ ID NO: 9722 - protein, 318 aa, Nicotiana benthamiana
MEGVSYQRFPRIKIREVKDDYMKFELRDTDASIANALRRVMIAEVPTIAIDLVEIEVNSSVLNDEFISHRLGLIPLTSERAMSMRFSRDCDACDGDGQCEYCSVEFYLRVKCLSDQTLDVTSKDLLSSDHTVVPVDYSDASSGFDNSTNKGIIIVKLRRGQELRLRAIARKGIAKDHAKWSPAATVTFMYEPDIYINEDMMETLTLEEKRELVDSSPTEVFGIDPENKVIVVDPEAYTYDDEVLKKCEAMGKPGLIEIHAREDSFIFTVETTGAVKASQLVLNAIEVLKQKLDAVRLSDDTVEADDQFGELGAHMRGG

SEQ ID NO: 9723 - protein, 193 aa, Prunus mume
MEGKSYQRLPRVKIREMRDDYMKFELRDTDASVANALRRVMIAEVPTVAIDLVEIEINSSVLNDEFIAHRLGLIPLTSARAMSMRFSRDCDACDGDGQCEFCSVEFHLRAKCHSDQTLDVTSKDLLSSDHTVVPVDFSDSAGMESSEQKGIIIVKLRRGQELRLRAIARKGIGKDHAKWSPAATVTFMYEPDI

SEQ ID NO: 9724 - protein, 319 aa, Solanum phureja
MEGVSYQRFPKIKIREVKDDFMKFELRETDASIANALRRIMIAEVPTIAIDLVEIEVNSSVLNDEFISHRLGLVPLTSERAMSMRFSRDCDACDGDGQCEYCSVEFYLRVKCLSDQTLDVTSKDLLSSDHTVVPVDYSDTSSSFDNTPNKGIIIVKLRRGQELRLRAIARKGIGKDHAKWSPAATVTFMYEPEIYINEDMMESLTLEEKTELVESSPTKVFGIDPENKQVIVVDPEAYTYDDEVLKKAEAMGKPGVVEIHAKEDSFIFTVETTGAVKASQLVLNAIEVLKQKLDAVRLSDDTVEADDQFGELGAHMRGG

SEQ ID NO: 9725 - protein, 318 aa, Nicotiana tabacum
  misc_feature (207)..(207): Xaa can be any naturally occurring amino acid
  misc_feature (234)..(234): Xaa can be any naturally occurring amino acid
MEGVSYQRFPRIKIREVKDDYMKFELRDTDASIANALRRVMIAEVPTIAIDLVEIEVNSSVLNDEFISHRLGLIPLTSERAMSMRFSRDCDACDGDGQCEYCSVEFYLRVKCLSDQTLDVTSKDLLSSDHTVVPVDYSDASSGFDNSTNKGIIIVKLRRGQELRLRAIARKGIAKDHAKWSPAATVTFMYEPDIYINEDMMETLTLXEKRELVDSSPTKVFGIDPENKVIVVDXEAYTYDDEVLKKCEAMGKPGLIEIHAKEDSFIFTVETTGAVKASQLVLNAIEVLKQKLDAVRLSDDTVEADDQFGELGAHMRGG

SEQ ID NO: 9726 - protein, 320 aa, Ambrosia trifida
METATYQRFPKVKIRELKDDYVKFELKQTDASMANALRRVMIAEVPTIAIDLVEIEVNSSVLNDEFIAHRLGLIPLTSERAMSMRFSRDCDACDGDGQCEFCSVEFHLRAKCIGDQTLDVTSKDLYSSDHTVVPVDFSDSGAGFENAEDQRGITIVKLRKGQELRLRAIARKGIGKDHAKWSPAATVTFMYEPEIHINEEMMETLSLEEKTSVVESSPTKVFALNPHTQQVEVVDPEAYTYDDEVLKKVEAMGKPGLIEIYAKEDSFIFTVESTGAIKASQLVINAIDVLKQKLDAVRLLEDTVEADDQFGELGAHMRGG

SEQ ID NO: 9727 - protein, 320 aa, Arnica chamissonis
MEGASYQRFPKVKIRELKDDYVKFELRETDASMANALRRVMIAEVPTIAIDLVEIEVNSSVLNDEFIAHRLGLIPLTSERAMSMRFSRDCDACDGDGQCEFCSVEFHLRAKCINDQTLDVTSKDLYSSDHTVVPVEFSDSGAGYENPEDQRGITIVKLRKGQELRLRAIARKGIGKDHAKWSPAATVTFMYEPEIHINEEMMETLSLEEKTSVVESSPTKVFALNPQTHQVEVVDPEAYTYDDEVLKKVEAMGKPGLVEVYAKEDSFIFTVESTGAVKASQLVINAIDVLKQKLDAVRLLEDTVEADDQFGELGAHMRGG

SEQ ID NO: 9728 - protein, 321 aa, Platanus occidentalis
MEGASYQRFPKVKIREMKDDYLKFELRETDVSMANALRRVMLAEVPTIAIDLVEIEANSSVLNDEFIAHRLGLIPLTSDRAMGMRFSRDCDACDGDGQCEFCSVEFHLHVRCDSDQTLDVTSHDLLSSDPSVVPVDVAQRSGSAGYEGSEQRGIIIVKLRRGQELRLRAIARKGIGKDHAKWSPGATVTFMYEPDIHINEDLMETLTLDEKRDWIESSPTKVFGIDPNTQQVIVVDPEAYTYDEEVIKKAEAMGKPGLVEIYAKEDNFIFTVESTGAIKASQLVINAIEILKQKLDAVRLSGDTEEADDQFGELGAHMRGG

SEQ ID NO: 9729 - protein, 319 aa, Solanum lycopersicum
MEGVSYQRFPKIKIREVKDDFMKFELRDTDASIANALRRIMIAEVPTIAIDLVEIEVNSSVLNDEFISHRLGLVPLTSERAMSMRFSRDCDACDGDGQCEYCSVEFYLRVKCLSDQTLDVTSKDLLSSDHTVVPVDYSDASSSFDNTPNKGIIIVKLRRGQELRLRAIARKGIGKDHAKWSPAATVTFMYEPEIYINEDMMESLTLEEKTELVESSPTKVFGIDPENKQVIVVDPEAYTYDDEVLKKAEAMGKPGVVEIHAKEDSFIFTVETTGAVKASQLVLNAIEVLKQKLDAVRLSDDTVEADDQFGELGAHMRGG

SEQ ID NO: 9730 - protein, 324 aa, Aquilegia formosa
MEVGGGASNQRFPKIKIREMKDEYLKFELRETDASMANALRRVMIAEVPTIAIDLVEIEVNSSVLNDEFISHRLGLIPLTSDRAMGMRFSRDCDACDGDGQCEHCSVEFHLDVRCDQDQTLDVTSADLISTDPSVIPVDVAAKSSSSAYDASENKGIIIVKLRRGQELRLRAIARKGIGKDHAKWSPAATVTFMYEPEIRINEEMMESLSIDDKRSWIESSPTKVFDIDPNTQQVVVVDPEAYTYDEEVIKKAEAMGKPGLIEIEAKEDSFIFTVESTGAVKASKLVVNAIEVLKQKLDAVRLSDDTVEADDQFGELGVHMRGG

SEQ ID NO: 9731 - protein, 318 aa, Phaseolus vulgaris
MEGASYARMPRVKIRELKDDYAKFELRDTDASIANALRRVMIAEVPTIAIDLVEIEVNSSVLNDEFIAHRLGLIPLTSERAMSMRFSRDCDACDGDGQCEFCSVEFHLRVKCMTDQTLDVSSKDLYSSDPSVVPVDFSDPASTDSSESRGVIIVKLRRGQELRLRAIARKGIGKDHAKWSPAATVTFMYEPEIHLNEDLMETLTLEEKREWVDSSPTRVFEIDPVTQQVMVVDSEAYSYDDEVIKKAEAMGKPGLVEIIARQDSFIFTVESTGAIKSSQLVLNAIEILKQKLDAVRLSEDTVEADDQFGELGAHMRGG

SEQ ID NO: 9732 - protein, 318 aa, Medicago truncatula
MEGASYARMPRVKIRELKDDYMKFELRDTDASVANALRRVMISEVPTVAIDLVEIEVNSSVLNDEFIAHRLGLIPLTSERAMAMRFSRDCDACDGDGQCEYCSVEFHLRVKCITDQTLDVSSKDLISSDHTVTPVDVPGGDASIESDGRGIIIVKLRRGQELRLRAIARKGIGKDHAKWSPAATVTFMYEPDIHINEDLMESLTLEEKKEWVDSSPTRVFDIDPVTQQVMVVDPEAYSYDDEVIKKAEAMGKPGLIEITAKQDSFIFTVESTGAVKASQLLLNSIEILKQKLDAVRLSEDTVEADDQFGELGAHMRGG

SEQ ID NO: 9733 - protein, 318 aa, Cajanus cajan
MEGVSYARMPRVKIRELKDDYAKFELRDTDASIANALRRVMIAEVPTIAIDLVEIEVNSSVLNDEFIAHRLGLIPLTSERAMSMRFSRDCDACDGDGQCEFCSVEFHLRVKCMTDQTLDVSSKDLYSSDHSVVPVDFSDPSNHESSDNRGIIIVKLRRGQELRLRAIARKGIGKDHAKWSPAATVTFMYEPEIHINEDLMETLTLEEKREWVDSSPTRVFEIDPVTQQVMVVDAEAYTYDDEVLKKAEAMGKPGLVEIIARQDSFIFTVESTGAIKASQLVLNAIEILKQKLDAVRLSEDTVEADDQFGELGAHMRGG

SEQ ID NO: 9734 - protein, 319 aa, Solanum tuberosum
MESVSYQRFPKIKIREVKDDFMKFELRETDASIANALRRIMIAEVPTIAIDLVEIEVNSSVLNDEFISHRLGLVPLTSERAMSMRFSRDCDACDGDGQCEYCSVEFYLRVKCLSDQTLDVTSKDLLSSDHTVVPVDYSDTSSSFDNTPNKGIIIVKLRRGQELRLRAIARKGIGKDHAKWSPAATVTFMYEPEIYINEDMMESLTLEEKTELVESSPTKVFGIDPENKQVIVVDPEAYTYDDEVLKKAEAMGKPGVVEIHAKEDSFIFTVETTGAVKASQLVLNAIEVLKQKLDAVRLSDDTVEADDQFGELGAHMRGG

SEQ ID NO: 9735 - protein, 318 aa, Prunus persica
MEGKSYQRLPRVKIREMRDDYMKFELRDTDASVANALRRVMIAEVPTVAIDLVEIEINSSVLNDEFIAHRLGLIPLTSDRAMSMRFSRDCDACDGDGQCEFCSVEFHLRAKCHSDQTLDVTSKDLLSSDHTVVPVDFSDSAGMESSEQKGIIIVKLRRGQELRLRAIARKGIGKDHAKWSPAATVTFMYEPDIRINEELMDMLTLDEKKAWVESSPTKVFDFDPKTEKVMVVDPEAYTYDDEVIKKAEAMGKPGLVDIIAKEDSFIFTVESTGAVKASQLLLNAIEILKQKLDAVRLSEDTVEADDQFGELGAHMRGG

SEQ ID NO: 9736 - protein, 319 aa, Trigonella foenum-graecum
MEGASYARMPRVKIRELKDDYMKFELRDTDASVANALRRVMISEVPTIAIDLVEIEVNSSVLNDEFIAHRLGLIPLTSERAMAMRFSRDCDACDGDGQCEYCSVEFHLRVKCITDQTLDVSSKDLYSSDHTVVPVDFSGGGDASTESDGRGIIIVKLRRGQELRLRAIARKGIGKDHAKWSPAATVTFMYEPDIHINEDLMESLTLEEKKEWVDSSPTRVFDIDPVTQQVMVVDPEAYSYDDEVIKKAEAMGKPGLIEITAKQDSFIFTVESTGAVKASQLLQNAIEILKQKLDAVRLSEDTVEADDQFGELGAHMRGG

SEQ ID NO: 9737 - protein, 114 aa, Ipomoea nil
MEGASYQRFPKIKIREVKDDYMKFELRDTDASVANALRRVMIAEVPTIAIDLVEIECNSTVLNDEFIAHRLGLIPLTSERAMSMRFSRDCDACVRRRPVRVLLRRVLPPRQVHH

SEQ ID NO: 9738 - protein, 321 aa, Lupinus angustifolius
MEGVSYARMPRVKIRELKDDYAKFELRDTDASIANALRRVMIAEVPTIAIDLVEIETNSSVLNDEFLAHRLGLIPLTSERAMSMRFSRDCDACDGDGQCEFCSVEFHLRVKCMTDQTLDVTSKDLISSDHTVTPVDFNDSSLIESSDVNTNRGIIIVKLRRGQELKLRAIARKGIGKDHAKWSPAATVTFMYEPEIHINEDLMESLTLEEKKEWVESSPTRVFDIDPVTQEVLVVDPEAYTYDDEVIKKAEAMGKPGLVEINAKQDSFIFTVESTGAVKASQLLLNAIEILKTKLDAVRLSEDTVEADDQFGELGAHLRGG

SEQ ID NO: 9739 - protein, 321 aa, Lupinus angustifolius
MEGVSYARMPRVKIRELKDDYAKFELRDTDASIANALRRVMIAEVPTIAIDLVEIETNSSVLNDEFLAHRLGLIPLTSERAMSMRFSRDCDACDGDGQCEFCSVEFHLRVKCMTDQTLDVTSKDLISSDHTVTPVDFNDSSLIQSSDAITNRGIIIVKLRRGQELKLRAIARKGIGKDHAKWSPAATVTFMYEPEIHINEDLMESLTLEEKKEWVESSPTHVFDIDVVTQQVTVVDPEAYTYDDEVIKKAEAMGKPGLVEINAKQDSFIFTVESTGAVKASQLLLNAIEILKTKLDAVRLSEDTVEADDQFGELGAHLRGG

SEQ ID NO: 9740 - protein, 320 aa, Ambrosia trifida
METATYQRFPKVKIRELKDDYVKFELKQTDASMANALRRVMIAEVPTIAIDLVEIEVNSSVLNDEFIAHRLGLIPLTSERAMSMRFSRDCDACDGDGQCEFCSVEFHLRAKCIGDQTLDVTSKDLYSSDHTVVPVDFSDSGAGFENVEDQRGITIVKLRKGQELRLRAIARKGIGKDHAKWSPAATVTFMYEPEIHINEEMMETLSLEEKTSVVESSPTKVFALNPHTQQVEVVDPEAYAYDDEVLKKVEAMGKPGLIEIYAKEDSFIFTVESTGAIKASQLVINAIDVLKQKLDAVRLLEDTVEADDQFGELGAHMRGG

SEQ ID NO: 9741 - protein, 263 aa, Malus domestica
MEGKSYQRLPRVKIREMRDDYVKFELRDTDASVANALRRVMIAEVPTVAIDLVEIEINSSVLNDEFIAHRLGLIPLTSDRAMSMRFSRDCDACDGDGQCEFCSVEFHLRAKCHSDQTLDVTSKDLLSSDHTVVPVDFSDSAGLESSEQKGIIIVKLRRGQELRLRAIARKGIGKDHAKWSPAATVTFMYEPDIRINEELMDTLTLEEKKAWVDSSPTKVFDIDPKTDKVVVVDPEAYTYDDEVIKKAEAMGKSGACGYQCKGR

SEQ ID NO: 9742 - protein, 286 aa, Valeriana officinalis
MANALRRVMISEVPTIAIDLVEIEVNSSVLNDEFLAHRLGLIPLTSEKAMSMRFSRDCDACDGDGQCEFCSVEFHLRSKCLNDQTLDVTSKDLYSSDHNVVPVDFGDSGLDTNTESKGIIIVKLRRGQELRLRAIARKGIGKDHAKWSPAATVTFMYEPEIHINEDMMATLSLEDIEKIVESSPTRVFAIDPDTKQMVVVDAEAYTYDDEVLKFVEAMGMPGLIEIYAKEDSFIFTVESTGAIKASNLVLNAIEILKQKLDAVRLAEDAVEADDQFGELGAHMRGG

SEQ ID NO: 9743 - protein, 236 aa, Tripterygium wilfordii
MSMRFSRDCDACDGDGQCEFCSVEFHLRAKCHSDQTLDVTSKDLYSSDHSAVPVDFSDLAGYESSEQRGIIIVKLRRAQELRLRAIARKGIGKDHAKWSPAATVTFMYEPEIHINEEMMQTLTLEEKVALVESSPTKVLGMDSNQQVVVVDPEAYTYDDEVLKKAESMGKPGLIEINAREDSFIFTVECTGAIKASQLLLNAIEILKQKLDAVRLSEDTVEADDQFGELGAHMRGG

SEQ ID NO: 9744 - protein, 318 aa, Fragaria vesca
MEGKSYQRFPRVKIREMRHDYLKFELRDTDASVANALRRVMIAEVPTVAIDLVEIEINSSVLNDEFIAHRLGLIPLTSDRAMSMRFSRDCDACDGDGQCEYCSVEFHLRARCHSDQTLDVTSKELLSSDHTVVPVDFSDASGYEASEQRGIIIVKLRRGQELRLRAIARKGIGKDHAKWSPAATVTFMYEPDIRINEEMMDTLSLEDKAAWVDSSPTKVFEIDPNTGKVVVVDPEAYTYDDEVIKKAEAMGKPGLVDITAKEDSFIFTVESTGAIKASQLLLNAIEILKQKLDAVRLSEDTVEADDQFGELGAHMRGG

SEQ ID NO: 9745 - protein, 315 aa, Tabernaemontana elegans
SYQRFPRVKIREIKDDFLKFELRDTDSSIANALRRVMIAEVPTIAIDLVEIEVNSSVLNDEFIAHRLGLIPLISERAMSMRFSRDCDACDGDGQCEYCSVEFHLRAKCINDQTLDVTSRDLISSDPSVVPVDFSDLSSGFDNSENRGIIIVKLRRGQELKLRAIARKGIGKDHAKWSPAATVTFMYEPDIYINEEMMDKLTLDQKRIIVESSPTKVFDVDEKTGQFVVADAEAYTYDDEVLKKCEAMNKPGLIEIQPKEDSFVFTVESTGAIKASQLVLNALDILKQKLDAVRLSDDTVEADDQFGELGAHMRGG

SEQ ID NO: 9746 - protein, 235 aa, Capsicum annuum
DGVSYQRFPRIKIREVKHDYMKFELRDTDSSIANALRRIMIAEVPTIAIDLVEIEVNSSVLNDEFISHRLGLIPLTSERAMSMRFSRDCDACDGDGQCEYCSVEFYLRVKCLSDQTLDVTSKDLLSSDHTVVPVDYSDGLDNATNKGIIIVKLRRGQELRLRAIARKGIGKDHAKWSPAATVTFMYEPEIYINEDMMESLTLEEKQELVDSSPTKVFAIDPENKQVIVVDPEAYT

SEQ ID NO: 9747 - protein, 99 aa, Ambrosia trifida
FPKVKIRELKDDYVKFELKQTDASMANALRRVMIAEVPTIAIDLVEIEVNSSVLNDEFIAHRLGLIPLTSERAMSMRFSRDCDACDGDGQCEFAQLSFI

SEQ ID NO: 9748 - protein, 239 aa, Ambrosia trifida
MSMRFSRDCDACDGDGQCEFCSVEFHLRAKCIGDQTLDVTSKDLYSSDHTVVPVDFSDSGAGFENVEDQRGITIVKLRKGQELRLRAIARKGIGKDHAKWSPAATVTFMYEPEIHINEEMMETLSLEEKTSVVESSPTKVFALNPHTQQVEVVDPEAYAYDDEVLKKVEAMGKPGLIEIYAKEDSFIFTVESTGAIKASQLVINAIDVLKQKLDAVRLLEDTVEADDQFGELGAHMRGG

SEQ ID NO: 9749 - protein, 333 aa, Flaveria ramosissima
MEGASYQRFPKVKIRELKDDYVKFELRETDASMANALRRVMIAEVPTIAIDLVEIEVNSSVLNDEFIAHRLGLIPLTSERAMSMRFSRDCDACDGDGQCEFCSVEFHLRAKCISDQTLDVTSKDLYSSDHTVVPVDFSDSGAGYENPEDQRGITIVKLRKGQELRLRAIARKGIGKDHAKWSPAATVTFMYEPEIHINEEMMETLSLEEKTSVVESSPTKVFALNPHTHQVEVVDPEAYTYDDEVLKKVEAMGKPGLIEIYAKEDSFIFTVESTGAIKASQLVINAIEVLKQKLDAVRLLEDTVEADEFVGLGKLGCSICEEVRSLNFILYVS

SEQ ID NO: 9750 - protein, 319 aa, Sesamum indicum
MEGVSYQRFPKIKIRTVRDDFMKFELRDTDASIANALRRVMIAEVPTIAIDLVEIEVNSSVLNDEFIAHRLGLIPLTSERAMSMRFSRDCDACDGDGQCEYCSVEFHLRAKCINDQTLDVTSKDLYSSDHTVVPVDFSDSSTGFDNTENRGIIIVKLRRGQELVLRAIARKGIGKDHAKWSPAATVTFMYEPEIYINEEMMEGLTLEEKKEFVDSSPTKVFDINPNTHQVYVHDAEAYTYDDEVLKKAEAMGKPGLVEIHAKEDSFIFTVETTGGIKASQLFLNAIDVLKQKLDAVRLSSDTVEADEQFGELGAHMRGG

SEQ ID NO: 9751 - protein, 319 aa, Ocimum basilicum
MEGASYQRFPKIKIRTVRDDFMKFELRETDASIANALRRVMIAEVPTIAIDLVEIEVNSSVLNDEFIAHRLGLIPLISDRAMSMRFSRDCDACDGDGQCEYCSVEFHLRAKCINDQTLDVTSKDLYSSDHTVIPVDFSDSSSGIDSSDTRGIIIVKLRRGQELILRAIARKGIGKDHAKWSPAATVTFMYEPEIYINEELMETLTLKEKQEFVESSPTKVFDINPHTGQVFVHDAEAYTYDDEVLKKAEAMGKPGLVEIHAKEDSFIFTVETTGAIKASQLLLNAIEILKQKLDAVRLSADTVEADEQFGELGAHMRGG

SEQ ID NO: 9752 - protein, 319 aa, Lippia dulcis
MEGVSYQRFPKIKIRTVRDDFMKFELRETDASIANALRRVMIAEVPTIAIDLVEIESNSSVLNDEFIAHRLGLIPLTSQRAMAMRFSRDCDACDGDGQCEYCSVEFHLRAKCISDQTLDVTSKDLYSSDHTVVPVDFSDSSAGIDNTENRGIIIVKLRRGQELVLRAIARKGIGKDHAKWSPAATVTFMYEPEIYINEELMETLTLEEKNEFVDSSPTKVFEINQQTQQVYVHDAEAYTYDDEVLKKAEAMGKPGLVEIHAKEDSFIFTVETTGAITASQLFLNAIDVLKQKLDAVHLSSDTVEADEQFGELGAHMRGG

SEQ ID NO: 9753 - protein, 210 aa, Humulus lupulus
MEGKSYQRFPKVKIREMKDDFLKFELRDTDASMANALRRVMIAEVPTIAIDLVEIEVNSSVLNDEFIAHRLGLIPLTSDRAMSMRFSRDCDACDGDGQCEFCSVEFTLRARCVEDRTLDVTSKDLLTPDHTVVPVDFSDPAGDESTEHRGVIIVKLRRGQELRLRAIARKGIGKDHAKWSPAATVSFMYEPDIRINEELMETLTLEEKKS

SEQ ID NO: 9754 - protein, 199 aa, Orobanche aegyptiaca
MEGASYQRFPKVKIRTVRDDFMEFELRETDPSIANALRRVMIAEVPTIAIDLVEIEVNSSVLNDEFIAHRLGLIPLVSERAMAMRFSRDCDSCDGDGQCEYCSVEFHLRAKCINDQTLDVTSKDLISSDHTVVPVDFSDSSSGVDNAEHRGVIIVKLRRGQELNLRAIARKGIGKDHAKLVLQRLSLLCTNLRFISTKS

SEQ ID NO: 9755 - protein, 319 aa, Triphysaria pusilla
MEGASYQRFPKVKIRVVKDDFMKFELRETDVSIANALRRIMIAEVPTIAIDLVEIEVNSSVLNDEFLAHRLGLIPLTSERSMAMRFSRDCDACDGDGQCEYCSVEFHLRAKCINDQTLDVTSKDLYSSDHTVVPVDFSDSSSGLDNAENRGIIIVKLRRGQELNLRAIARKGIGKDHAKWSPAATVTFMYEPDIYINEELMETLTLQEKKDFIESSPTKVLEINPNTEQVYVHDAEAYAYDDELPKKADAMGKPGLIEITPKEDSFIFTVETTGAMKASQLFLNAIDILKQKLDAVRLSADTVEADEQFGELGAHMRGG

SEQ ID NO: 9756 - protein, 318 aa, Cannabis sativa
MEGKSYQRFPKVKIREMKDDYLKFELRDTDASMANALRRIMIAEVPTIAIDLVEIEVNSSVLNDEFIAHRLGLIPLTSDRAMSMRFSRDCDACDGDGQCEFCSVEFTLRCRCIEDRTLDVTSKDLVTPDHTVVPVDFSDSAGNESNENRGVIIVKLRRGQELRLRAIARKGIGKDHAKWSPAATVSFMYEPDIRINEELMETLTLEEKRSWVESSPTRVFELDPETHQVCVYDAEAYTYDDEVIKKAEAMGKPGLVDITAKEDSFIFTVETTGAVKASQLVIHAIEILKQKLDAVRLSDDTVEADDQFGELGAHLRGG

SEQ ID NO: 9757 - protein, 311 aa, Populus trichocarpa
MESVSYQRFPKIKIREMKDDYLKFELRETDASMANALRRVMIAEVPTIAIDLVEIEVNSSVLNDEFIAHRLGLIPLTSERAMGMRFSRDCDACDGDGQCEYCSVEFHLRAKCITDQTLDVTSKDLYSSDHAVIPVDFSDPSDANDPFDHTETQRGIIIVKLRRGQELRLRAIARKGIGKDHAKWSPAATVTFMYEPEIHINEDLMETLTLEEKLSWIESSPTKVFDIDKVTQQVVVVDPEAYTYDDEVIKKAEAMGKRGLIDIRAKEDSFIFTVESTIEILKQKLDAVRLSDDTVEADDQFGELGVHMRGG

SEQ ID NO: 9758 - protein, 285 aa, Camellia sinensis
MEGASYQRFPKVKIRELKDDYCKFELRDTDASMANALRRVMIAEVPTIAIDLVEIEVNSSVLNDEFIAHRLGLIPLTSDRAMSTRFSRDCDACDGDGQCEFCSVEFHLRAKCINDQTLDVTSKDLYSSDHTVVPVDFSDSSSGFDNTEQRGIIIVKLRRGQELRLRAIARKGIGKDHAKWSPAATVTFMYEPEIHINEELMETLSLEEKTSWVESSPTKVFDIDPNTQQVVVVDPEAYTYDDEVIKKAEAMGKPGLVEIYAKEDSFIFTVESTGASKLLNCCLMQ

SEQ ID NO: 9759 - protein, 319 aa, Amsonia hubrichtii
MEGVSYHRFPRVKVREIKDDFLKFELRDTDASIANALRRVMIAEVPTIAIDLVEIEVNSSVLNDEFIAHRLGLIPLTSERAMSMRFSRDCDACDGDGQCEYCSVEFHLRAKCINDQTLDVTSRDLISSDPSVVPVDYSDSSSGFDNTENRGIIIVKLRRGQELRLRAIARKGIGKDHAKWSPAATVTFMYEPDIYINEEMMDRLTLDQKRSIVESSPTKVFDVDEKTGQFVVVDAEAYTYDDEVLKKCDAMDKSGLLEIHPKEDSFIFTVESTGAIKSSQLVLNAIDILKQKLDAVRLSDDTVEADDQFGELGAHMRGG

SEQ ID NO: 9760 - protein, 340 aa, Eschscholzia californica
DGISYQRFPKVKIREMKDEYMKFELRETDPSMANALRRVMIAEVPTIAIDLVEIEVNSTVLNDEFIAHRLGLIPLTSERAMGMRFSRDCDACDGDGQCEYCSVEFHLSVRCDSDQTVDVTSADLLSSDPSVVPVDVAARSGSSGFDSTENRGIIIVKLRRGQELRLRAIARKGIGKDHAKWSPAATVTFMYEPDIHINEEMMESLSLEEKKSWVESSPTKVFDIDPNTQQVVVVDSEAYTYDDEVIKKAEAMGKPGLVEIYGREDSFIFTVESTGAVKASQIVINAIEVIKQKLDAVRLSEDTEGADEQLVSWEHTCVEDDHIEKQLQVTGTKCRYKKGS

SEQ ID NO: 9761 - protein, 318 aa, Chenopodium quinoa
MEGISYQRFPQIKIREMRDDFMKFELKKTDSSVANALRRVMIAEVPTVAVDLVEIEVNSSVLNDEFIAHRLGLIPLVSERAMAMRFSRDCDACDGDGQCEYCSVEFHLRAKCIGDQTLDVTSKDLLSSDHTVTPVDFSEAPASDDATDNRGIIIVKLRKGQELKLRAIARKGIGKDHAKWSPAATVTFMYEPEILINEDMMESLSLEQKKEWVESSPTKVFDIDPNTQQVVVVDPEAYTYDDEVIKKAEAMGKSGLVEIYPKEDSFIFTVESTGAVKAPQLLLNAIEVLKQKLDAVRLPEDTVDADDFGELGAHMRGG

SEQ ID NO: 9762 - protein, 318 aa, Beta vulgaris
MEGVSYQRFPRIKIREMRDDYLKFELRDTDSSVANALRRVMIAEVPTVAVDLVEIEVNSSVLNDEFIAHRLGLIPLTSDRAMSMRFSRDCDACDGDGQCEYCSVEFHLRAKCIGDQTLDVTSKDLLSSDHTVTPIDFSDSPAADDASDNRGIIIVKLRKGQELKLRAIARKGIGKDHAKWSPAATVTFMYEPEILINEDLMETLTLEQKKAWVESSPTKVFDIDPNTQQVVIVDPEAYAYDDEVIKKAEAMGKPGLVEIYPKEDSFIFTVESTGAVKAYQLVLNAIEILKQKLDAVRLPEDTVDADDFGELGAHMRGG

SEQ ID NO: 9763 - protein, 321 aa, Vinca minor
MDGGVSSQRQRFPRIKIRESKDDFMKFELRDTDASIANALRRVMIAEVPTIAIDLVEIEVNSSVLNDEFIAHRLGLIPVTSSRAMSMRFSRDCDACDGDGQCEYCSVEFHLRAKCINDQTLDVTSRDLISSDPSVVPVDFSDSSGFENAENRGIIIVKLRRGQELMLRAIARKGIGKDHAKWSPAATVTFMYEPDIYINEEMMEKLSLDQKKSIVESSPTKVFDVDDKTGRFLVADAEAYTYDDEVLKKCEAMSMPGLIEIHPKEDSFIFTVETTGAVKASQLFLNAIDILKQKLDAVRLSDDTVEADDQFGELGAHMRGG

SEQ ID NO: 9764 - protein, 315 aa, Euphorbia peplus
SYQRFPRVKIRELKDDYCKFELRDTDASIANALRRVMIAEVPTVAIDLVEIEVNTSVLNDEFIAHRLGLIPLVSDRAMSMRFSRDCDSCDGDGQCEYCSVEFHLRAKCITDQTLDVTSKDLISSDHTVTPVDFSDSTGYDPATEPRGITIVKLRRGQELKLRAIARKGIGKDHAKWSPAATVTFMYEPDIHINEDMMETLSLEDKQSWVDSSPTKVFAIDENTQQVVTIDPEAYTYDEEVLKKADAMGKSGLVSIQAKEDSFIFTVESTGAIKSSQLLLNAIEVLKTKLDTVRLSEDTVEADEQFGELGAHMRGG

SEQ ID NO: 9765 - protein, 320 aa, Vinca minor
MDGLTSQRQRLPRIKIRELKDDFMKFELRDTDASIANALRRVMIAEVPTIAIDLVEIEVNSSVLNDEFIAHRLGLIPVTSSRAMAMRFSRDCDACDGDGQCEYCSVEFHLRAKCINDQTLDVTSRDLISSDPSVVPVDFSDSSGFENAENRGIIIVKLRRGQELMLRAIARKGIGKDHAKWSPAATVTFMYEPDIYINEEMMEKLTPDQKRSIIESSPTKVFDMDDKTGRFLVADAEAYTYDDEVLKKCEAMSMPGLIEIHPKEDSFIFTVETTGAVKASQLFLNAIDILKQKLDAVRLSDDTVEADDQFGELGAHMRGG

SEQ ID NO: 9766 - protein, 317 aa, Plantago ovata
MEGGVSYQRFPRIKIRTVRDDFMKFELHDTDVSIANALRRVMISEVPTIAIDLVEIEVNSSVLNDEFIAHRLGLIPLTSERAMGMRFSRDCDACDGDGQCEFCSVEFHLRAKCMGDTTTDVTSKDLISSDHTVVAVDFSDSGYDATENKGIIIVKLRRGQELVLRAIARKGIGKDHAKWSPAATVTFMYEPRIDINEELMATLSLEEKQAFIESSPTKVFDLNPQGQVFVHDAEAYTYDDEVLKKAEAMGKPGLVDIQAKEDSFIFTVESTGAIKASQLFLNAIEILKRKLDAVRLSADTVEADEQFGELGAHMRGG

SEQ ID NO: 9767 - protein, 325 aa, Arachis hypogaea
MEGQSYARMPRVKIRELRDDYARFELRDTDASIANALRRVMIAEVPTIAIDLVEIEVNSSVLNDEFIAHRLGLIPLTSDRAMSMRFSRDCDACDGDGQCEFCSVEFHLMAVCRNDETQDVTSSDLISSDHTVVPVDYSESAASIDASDGISGNKKGGITIVKLRKGQEVKLRAIARKGIGKDHAKWSPAATVTFMYEPEIHINEDLMESLTLEEKKEWVESSPTPVFEIDQVTQQVMVVDAEAYTYDDEVIKKAEAMGKPGLVEINAKQDSFIFTVETTGAIKASQLLLNAIEILKQKLDAVRLSEDTVEADDQFGELGAHMRGG

SEQ ID NO: 9768 - protein, 318 aa, Silene vulgaris
MDGGLTTYQRFPRIKIREMRSDFMKFELRDTDASVANALRRVMISEVPTIAIDLVEIEVNSSVLNDEFIAHRLGLIPLTSERAMAMRFSRDCDACDGDGQCEFCSVEFYLRAKCVQDQTLDVTSKDLITSDHTVTPVDFADFPSSDGASDNKGIIIVKLRKGQELRLRAIARKGIGKDHAKWSPAATVTFMYEPEIHINEDMMESLSLEQKREWVDSSPTKVFDIDPNSQQVVVVDPEAYTYDDEVLKKAEAMGKAGLVEIYPREDSFIFTVESTGGVKASQLVLNAIEILKQKLDAVRLAEDAVDADDFGELGAHVR

SEQ ID NO: 9769 - protein, 318 aa, Lotus japonicus
MEGVSYARMPRVKIRELKDDMARFELRDTDASIANALRRVMISEVPTIAIDLVEIEVNSSVLNDEFIAHRLGLIPLTSERAMAMRFSRDCDACDGDGQCEFCSVEFHLRVKCMTDETLDVTSKDLYSSDHTVVPVDFSPDTSSDSAVNKGIIIVKLRRGQELRLRAIARKGIGKDHAKWSPAATVSFMYEPEIHINDDLMETLTLKEKKEWVESCPTHVFDIDANTQKVYVHEAENYSYDDEVIKKAEAMGKPGLVEITAKQDSFIFIVETTGAVKASQLVLNAIEILKQKLDAVRLSEDTVEADDQFGELGAHMRGG

SEQ ID NO: 9770 - protein, 316 aa, Silene vulgaris
MEGLATYQRFPRIKVREMRNDFMKFELRDTDASMANALRRIMISEVPTIAIDLVEIEVNSSVLNDEFIAHRLGLIPLTSERAMAMRFSRDCDACDGDGQCEFCSVEFYLRAKCVQDQTLDVTSKDLITSDHTVTPVDFSDFPSSDGATDGRGIIIVKLRKGQELRLRAIARKGIGKDHAKWSPAATVTFMYEPEIHINEDMMESLNLEQKKEWVESSPTKVFDIDPNSQQVVVVDPEAYTYDDEVIKKAEAMGKPGLVEIYPREDSFIFTVESTGGVKASQLVLNAIEILKQKLDAVRLSGDVMDADDLGDLGAHI

SEQ ID NO: 9771 - protein, 276 aa, Papaver somniferum
EGMSYQRFPKIKIREMKDEYLKFELRETDVSMANALRRIMIAEVPTIAIELVEIEVNSTVLNDEFLAHRLGLIPLTSDKAMGMRFSRDCDACDGDGQCEYCSVEFHLSVRCDQDQTLDVTSADLLTADPNVIPVDVANAARSTSFDSAENKGIIIVKLRRGQELRLRAIARKGIGKDHAKWSPTATVTFMYEPDIHINEDMMATLTLEEKQSWVESSPTKVFDIDPNTQQVIVVDPEAYTYDDEVIKKAEAMGKPGLVEITGREDSFILQLNLQVL

SEQ ID NO: 9772 - protein, 327 aa, Papaver somniferum
MESGISYQRFPKIKIRSMRDDYMKFELRDTDPSMANALRRIMISEVPTIAIDLVEIEVNSTVLNDEFIAHRLGLIPLVSDRAMEMRFSRDCDACDGDGQCAYCSVEFQLSVRCDEDQTVDVTSADLISSDLMVVPVDVALAAARSEGFDSAENKGIIIVKLRRGQELRLRAIARKGIGKDHAKWSPAATVTYMYEPDIHINEDMMESLTLEEKQDWVESSPTKVFDIDSNTQQVKVYDAEAYTYDDEVIKKAEAMGKPGLVEITAREDSFIFTVESTGAVKASQIVINAIEVLKQKLDAVRLSEDTVEADDQFGELGAHMRGGWSCL

SEQ ID NO: 9773 - protein, 286 aa, Brassica rapa
MGANISGVTPEFDRSSEPRLSDLPENCVALIMMRLDPPEICRLARLSRVFRRASSADFVWESKLPPSYRAIARKVFDEITLRKLLIKKDLYAKLCRPNLFEGGTKELWIDKNTGRLCVLVSSKALRITGIDDRRYWSHIPTDESRFHSVAYVQQIWWFEVGGEFEIQFPSGTYSLFFRIQLGKTSKRLGRRICNSDHIHGWDIKPVRFQLATSDNQQAVSLRYLNNNPGHWSHYHVGDFKVVNPDVSTGVKFSMTQIDCTHTKGGLCIDSVLIVPKENARKVVESE

SEQ ID NO: 9774 - protein, 271 aa, Eutrema parvulum
MGANISGGLPEFDRNGEGYSRKPRLEDLPENCVALIMMRLDPPEICRLARLNRVFRRASSADFIWESKFPSNYRVIARKVFDEITLKKLIKKDLYAKLTRPKLFDGGTKELWIDKNTGRLCVSISSKALRITGIDDRRYWSQIPTDESRFQTVAYVQQIWWFEVGGEFKIQFPSGTYSLFFRIQLGKTSKRLGRRICNSEHIHGWDIKPVRFQLATSDNQQAVSLCYLDNNPGNWSHYHVGDFKVENPDILTEIKFLMTQIIALTRKVGCA

SEQ ID NO: 9775 - protein, 290 aa, Arabidopsis thaliana
MGANISGGSPEFDRNDDVYSRKLRLVDLPENCVALIMTRLDPPEICRLARLNRMFRRASSADFIWESKLPANYRVIAHKVFDEITLTKLIKKDLYAKLSQPNLFDDGTKELWIDKNTGRLCLSISSKALRITGIDDRRYWSHIPTDESRFQSAAYVQQIWWFEVGGEFEIQFPSGTYSLFFRIQLGKTSKRLGRRICNSEHIHGWDIKPVRFQLATSDNQQAVSLCYLNNNPGSWSHYHVGDFKVTNPDVSTGIKFSMTQIDCTHTKGGLCIDSVLILPKECAKEVIGSQ

SEQ ID NO: 9776 - protein, 271 aa, Eutrema parvulum
MGANISGGFPEFDRNGEGYSRKPRLVDLPENCVALIMMRLDPPEICRLARLNRVFRRASSADFIWDSKLPSNYRVFARKVFDEITLRKLIKKDVYAKLCRPNLFDGGTKELWIDKNTGKLCVSISSKALRITGIDDRRYWSLIPTDESRFQSVAYVQQVWWFEVGGEFEIQFPPGIYSLFFRIQLGKTSKRLGRRICNSEHIHGWDIKPVRFQLATSDNQQAVSLCYVDNNPGTWSHYHVGDFKVENPDILTEIKFLMTQIIALTRKVGCA

SEQ ID NO: 9777 - protein, 290 aa, Arabidopsis lyrata
MGANISGGLTEFDRDGDVYARKPGLVDLPENCVALIMIRLDPPEICRLARLNRMFRRASSADFIWESKLPSNYRVIAHKVFDEITLRKLIKKDLYAKLSRPNLFEDGTKELWIDKNTGRLCLSISSKALRITGIDDRRYWSHIPTDESRFQSVAYVQQIWWFEVGGEFEIQFPSGTYSLFFRIQLGKTSKRLGRRICNSEHIHGWDIKPVRFQLATSDNQQAVSFCYLNKNPGSWSHYHVGDFKVTNPDISTGIKFSMTQIDCTHTKGGLCIDSVLILPKDCAKEVIGSQ

SEQ ID NO: 9778 - protein, 290 aa, Eutrema halophilum
MGANISGGFPEFDRNGEGYSRKPRLVDLPENCVALIMMRLDPPEICRLARLNRVFRRASSADFIWDSKLPSNYRVFARKVFDEITLRKLIKKDVYAKLCRPNLFDGGTKELWIDKNTGKLCVSISSKALRITGIDDRRYWSLIPTDESRFQSVAYVQQVWWFEVGGEFEIQFPPGIYSLFFRIQLGKTSKRLGRRICNSEHIHGWDIKPVRFQLATSDNQQAVSLCYVDNNPGTWSHYHVGDFKVEDPDLLTRIKFSMTQIDCTHTKGGLCIDSVLILPKKCAQEAIGSK

SEQ ID NO: 9779 - protein, 290 aa, Eutrema halophilum
MGANISGGFPEFDRNGEGYSRKPRLVDLPENCVALIMMRLDPPEICRLARLNRVFRRASSADFIWDSKLLSNYRVFARKVFDEITLRKLIKKDVYAKLCRPNLFDGGTKELWIDKNTGKLCVSISSKALRITGIDDRRYWSLIPTDESRFQSVAYVQQVWWFEVGGEFEIQFPPGIYSLFFRIQLGKTSKRLGRRICNSEHIHGWDIKPVRFQLATSDNQQAVSLCYVDNNPGTWSHYHVGDFKVEDPDLLTRIKFSMTQIDCTHTKGGLCIDSVLILPKKCAQEAIGSK

SEQ ID NO: 9780 - protein, 593 aa, Arabidopsis lyrata
MVLLHSMTSLLLVFFFLSGVSPVISDGSDHRYKVGDDVPLYANKVGPFHNPSETYRYFDLPFCSSAPVKEKKEALGEVLNGDRLVSAPYKLEFLGEKNSEVACRKRLSREDVAKFRDVIAKDYYFQMYYDDLPIWGFLGKVFKEGKTDPSEYKYYLFNHLQFEIFYNKDRVIEIIVRTDQNFLVDLTEDKEVQVDFTYTVRWKETEIPFEKRMEKYSLASSMPHHLEIHWFSIINSCVTVLLLTGFLATILMRVLKNDFVKYAHDEEAVDDQEETGWKLIHGDVFRFPKHKSLLAAALGSGTQLFTLAVFIFMLALVGVFYPYNRGALFTALVVIYALTSGIAGYTAASFYCQLEGTNWVRNVILTGSLFCGPLLLTFSFLNTVAIAYQATAALPFGTIVVIFLIWALVTSPLLILGGIAGKNRKSEFQAPCRTTKYPREIPPMRWYRRTLPQMAMAGFLPFSAIYIELYYIFASVWGHRIYTIYSILSIVFLILVIVTAFITVALTYFQLAAEDHEWWWRSLLCGGSTGLFIYAYCLYYYYARSDMSGFMQTSFFFGYMACICYGFFLMLGAIGFRASLLFVRHIYRSIKCE

SEQ ID NO: 9781 - protein, 595 aa, Eutrema halophilum
MEKPASRVLLPSLLLVLFIYGVAPVISDGSDHRYKVGDDVPLYANKVGPFHNPSETYRYFDLPFCSSAPVKEKKEALGEVLNGDRLVSAPYKLEFLGEKNSEVACRKRLSREDVAKFRDVITKDYYFQMYYDDLPIWGFLGKVVKDGKSDPSEYKYYLFNHLQFEIFYNKDRVIEIIVRTDQNFLVDLTEDKEVEVDFTYTVRWKETEIPFEKRMEKYSLASSMPHHLEIHWFSIINSCVTVLLLTGFLATILMRVLKNDFVKYAHDEEAADDQEETGWKLIHADVFRFPKHKSLLAAALGSGTQLFTLAVFIFMLALVGVFYPYNRGALFTALVVIYALTSGIAGYTAASFYCQLEGTNWVRNLMLTGSLFCGPLLLTFSFLNTVAIAYQATAALPFGTIVVIFLIWALVTSPLLILGGIAGKNRKPEFQAPCRTTKYPREIPPLRWYRRTLPQMAMAGFLPFSAIYIELYYIFASVWGHRIYTIYSILSIVFLILVIVTAFITVALTYFQLASEDHEWWWRSLLCGGSTGLFIYAYCLYYYYARSDMTGFMQTSFFFGYMACICYGFFLMLGAIGFRASLFFVRHIYRSIKCE

SEQ ID NO: 9782 - protein, 592 aa, Gossypium raimondii
MDRIRAFLVAVAIVTLCGVPQVRSTASDHRYKAGDEVPLYANKVGPYHNPSETYRYFDFPFCSSAPVKEKKEALGEVLNGDRLVSAPYKLEFLTEKEAEIACKRKLTRDEVVKFRKAVSKDYYFQMYYDDLPIWGFLGKVEKEGKTDPADYKYYLFKHLVFEIHHNKDRVIEITVRSDPNALVDLTEDVPVDVDFMYTVKWKETNTPFEKRMDKYSLSSSLPHHLEIHWFSIINSCVTVLLLTGFLATILMRVLKNDFIKYAHDEESADDQEESGWKYIHGDVFRYPKHKSLFAAALGSGTQLFTLTSFIFILALVGVFYPYNRGALFTALVVIYALTSGIAGYTAASFYCQLEGTNWVRNLLLTGSLFCGPLFVTFCFLNTVAIAYKATAALPFGTIVVIFLIWALVTSPLLVLGGIAGKNSKAEFQAPCRTTKYPREIPPLPWYRKTIPQMAMAGFLPFSAIYIELYYIFASVWGHRIYTIYSILFIVFIILLIVTAFITVALTYFQLAAEDHEWWWRSFLCGGSTGLFIYAYCLYYYNARSDMSGFMQTSFFFGYMACICYGFFLMLGAIGFRASLLFVRHIYRSIKCE

SEQ ID NO: 9783 - protein, 590 aa, Olea europaea
MMGGGLFAVVLIVLCTSIQVRSDGSDHKYKVGDPVPLYANKVGPFHNPSETYRFFDLPFCSPAHPKEKKEALGEVLNGDRLVSAPYKLDFLQDKDSEIVCKKILSKEEVGQFRTAVLKDYYFQMYYDDLPIWGFLGKVEKEGKSDPSEYKYYLFKHLHFEIFYNKDRVIEINARTDPNALVDLSEDKEVEVEFMYSVKWKETNTPFEKRMEKYSQSSSLPHHLEIHWFSIINSCVTVLLLTGFLATILMRVLKNDFVKYAHDEETADDQEETGWKYIHGDVFRYPKYKSLFAAALGSGTQLFTLTIFIFILALVGVFYPYNRGALFTALVVIYALTSGIAGYTASSFYCQLEGTNWVRNLLLTGSLFCGPLLLTFSFLNTVAIAYSATAALPFGTIVVIFLIWALVTSPLLVLGGIAGKNSRAEFQAPVRTTKYPREIPPLPWYRGTLPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMACICYGFFLMLGAVGFRAALFFVRHIYRSIKCE

SEQ ID NO: 9784 - protein, 590 aa, Solanum lycopersicum
MEKMALYVVVLLIICYASPARSDGSDHKYKSGDQVPLYANKVGPFHNPSETYRFFDLPFCTPDHVKEKKEALGEVLNGDRLVSAPYKLDFLYDKDSEIVCKKKLSKEEVSQFRSAVAKDYYFQMYYDDLPIWGFLGKVDKEGKSDPSEYKYYLFKHLHFEIFYNDDRVIEINARTDPNALVDITEDKEVDVDFMYTVKWKETKTPFDKRMEKYSQSSSLPHHLEIHWFSIINSCVTVLLLTGFLATILMRVLKNDFVKYAHDEEAADDQEETGWKYIHGDVFRYPSHKSLMAAALGSGTQLFTLTIFIFLLSLVGVFYPYNRGALFTALVVIYALTSGIAGYTAASFYCQLEGTNWVRNLILTGALFCGPLFLTFCFLNSVAIAYSATAALPFGTIVVIFLIWALVTSPLLVLGGIAGKNSRAEFQAPCRTTKYPREIPPLPWYRGTLPQMAMAGFLPFSAIYIELYYIFASVWGHRIYTIYSILFIVFIILIIVTAFITVALTYFQLAAEDHEWWWRAFLCGGSTGLFIYGYCLYYYYARSDMSGFMQTSFFFGYMACICYGFFLMLGTVGFRAALFFVRHIYRSIKCE

SEQ ID NO: 9785 - protein, 590 aa, Olea europaea
MMEGGLYAVVLILLCTSIQVRSDGSDHKYKVGDPVPLYANKVGPFHNPSETYRFFDLPFCSPAHPKEKKEALGEVLNGDRLVSAPYKLDFLLDKDSEIVCKKKLSKEEAAQFRSAVSKDYYFQMYYDDLPIWGFLGKVEKEGKSDPSEYKYYLFKHIHFEIFYNKDRVIEINARTDPNALVDLSEDKDVEVEFMYSVKWKETNTPFEKRMEKYSQSSSLPHHLEIHWFSIINSCVTVLLLTGFLATILMRVLKNDFVKYTHDEETADDQEETGWKYIHGDVFRYPKYKSLFAAALGSGTQLFTLTIFIFILALVGVFYPYNRGALFTALVVIYALTSGIAGYTASSFYCQLEGTNWVRNLLLTGGLFCGPLLLTFCFLNTVAIAYSATAALPFGTIVVIFLIWALVTSPLLVLGGIAGKNSKAEFQAPVRTTKYPREIPPLPWYRGTLPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMACICYGFFLMLGTVGFRAALFFVRHIYRSIKCE

SEQ ID NO: 9786 - protein, 592 aa, Mimulus guttatus
MARGGEWRAVVLLLLCTAFPAARSDGSDHKYKVGDPVPLYANKVGPFHNPSETYRYFDLPFCSPGDVKDKSEALGEVLNGDRLVSAPYKLDFLADRESEVICKKQLSKEEVAVFRSAVAKDYYFQMYYDDLPIWGFLGKVDKEGKADPSEYKYYLFKHLHFEIFYNKDRVIEINARTDPSALVDLTEDKEVDVEFVYSAKWKETNIAFEKRMEKYSHSSSLPRHLEIHWFSIINSCVTVLLLTGFLATILMRVLKNDFVKYAHDEEAADDQEETGWKYIHGDVFRFPKYKSLFAAALGSGTQLFTLATFIFLLALVGVFYPYNRGALFTALVVIYALTSGIAGYTAAAFYCQLEGTNWVRNLLLTGGLFCGPLFLTFCFLNTVAIAYHATAALPFGTIVVIFLIWALVTSPLLVLGGIAGKNSKAEFQAPVRTTKYPREIPPLPWYRSTVPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMASVCYAFFLMLGAVGFRASLFFVRHIYRSIKCE

SEQ ID NO: 9787 - protein, 592 aa, Populus trichocarpa
MEKKLVPCLVVSILIFCSVTHVRSDASDHRYKVGEDVPLYVNKVGPFHNPSETYRYFDLPFCSSGPTKDKKEALGEVLNGDRLVTAPYKLDFLNDKDSEIACRKRLTKEQVAQFREVVSKDYYFQMYYDDLPIWGFLGKVDKERKNDPSEYKYYLFKHLHFTIFYNKDRVIEITAQSDLNNVVDLTEDKEVDVEFMYSVKWKETEIPFEKRMEKYSQSSSLPHHLEIHWFSIINSCVTVLLLTGFLATILMRVLKNDFVKYAHDEESAEDQEETGWKYIHGDVFRYPKYKSLLAAAVGSGTQLFTLTIFIFVLALVGVFYPYNRGALFTALVVIYALTAGIAGYTAASFFCQLEGTNWVRNLLLTGALFCGPLFLTFCFLNTVAIAYSATAALPFGTIVVIFLIWALVTTPLLVLGGIAGKNSKAEFQAPVRTTKYPREIPQLPWYRKTLPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMACVCYGFFLMLGSIGFRASLFFVRHIYRSIKCE

SEQ ID NO: 9788 - protein, 593 aa, Nicotiana benthamiana
MEKKRTMAWYVVVLLIVSCASPVRSDGSDHKYKAGDPVPLYANKVGPFHNPSETYRFFDLPFCAPAHVKEKKEALGEVLNGDRLVSAPYKLDFMYDKDSEIVCKKKLSKEEVAQFRSAVAKDYYFQMYYDDLPIWGFLGKVDKEGKSDPSDYKYYLFKHLHFEIFSNNDRVIEINARTDPNALVDITEDKEVDVEFMYSVKWKETKTPFDKRMEKYSQSSSLPHHLEIHWFSIINSCVTVLLLTGFLATILMRVLKNDFVKYAHDEEAADDQEETGWKYIHGDVFRYPNYKSVLAAALGSGTQLFTLTIFIFLLSLVGVFYPYNRGALFTALVVIYALTSGIAGYTASSFYCQLEGTNWVRNLLLTGGLFCGPLFLTFCFLNSVAIAYSATAALPFGTIVVIFLIWALVTSPLLVLGGIAGKNSKAEFQAPCRTTKYPREIPPLPWYRGTLPQMAMAGFLPFSAIYIEVYYIFASVWGHRIYTIYSILFIVFIILIIVTAFITVALTYFQLAAEDHEWWWRAFLCGGSTGLFIYGYCLYYYYARSDMSGFMQTSFFFGYMACICYGFFLMLGTVGFRAALFFVRHIYRSIKCE

SEQ ID NO: 9789 - protein, 594 aa, Theobroma cacao
MKNLGNCPTFLILGVLFFCCLSHVRSDASDHRYKDGDPVPLYANKVGPFHNPSETYRYFDLPFCSPDHLKEKKEALGEVLNGDRLVNAPYKLNFREERDSYVVCKTKLSKEEVAIFRKVVDKDYYFQMYYDDLPIWGFIGKVDKEGKADPSEYKYFLYKHIQFDILYNKDRVIEISAKMDPHSLVDLTEDKEVDAEFMYTVKWKETETPFEKRMDKYSMSSSLPHHLEIHWFSIINSCVTVLLLTGFLATILMRVLKNDFIKYGQDEEAADDQEETGWKYIHGDVFRFPKFKSLFAAALGSGTQLFTLTVFIFMLALVGVFYPYNRGALFTALVVIYALTSGIAGYTATSFYCQLEGKNWVRNLLLTGCLFCGPLFLTFCFLNTVAIAYRATAALPFGTIVVIVLIWTLVTSPLLVLGGIAGKNSKAEFQAPCRTTKYPREIPPLPWYRSAIPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACICYGFFLMLGTVGFRASLLFVRHIYRSIKCE

SEQ ID NO: 9790 - protein, 593 aa, Chenopodium quinoa
MEKSKATLMVAIVILLFSGFIQVRSDGSNHRYKAGEQVPLYANKVGPFHNPSETYRYFDLPFCIPDHVKEKKEALGEVLNGDRLVSAPYKLDFLVDKDSEVICKKKLSKEDIVQFRDAVAKDYYFQMYYDDLPIWGFLGKVDKEGKLDPSEYKYYLYKHIHFDIFYNKDRVIEINVRTDPNSLVDITDDKEVDVEFMYSVKWKETNTPFEKRMDKYSQSSSLPHHLEIHWFSIINSCVTVLLLTGFLATILMRVLKNDFVKYAHDEETAEDQEETGWKYIHGDVFRFPKYKSVLAAALGSGTQLFTLTVFIFLLALVGVFYPYNRGALFTALVVIYALTSGIAGYTATSFYCQLEGSNWVRNLLLTGFLFCGPLFLTFCFLNTVAIAYHATAALPFGTIMVILLIWTLVTSPLLVLGGIAGKNSKAEFQAPCRTTKYPREIPPLPWYRGTLPQMAMAGFLPFSAIYIELYYIFASVWGHRIYTIYSILFIVFIILIIVTAFITVALTYFQLAAEDHEWWWRSFLCGGSTGLFIYGYCLYYYYARSDMSGFMQTSFFFGYMACICYGFFLMLGMVGFRAALFFVRHIYRSIKCE

SEQ ID NO: 9791 - protein, 594 aa, Chenopodium quinoa
MVKSMATLMVAVFAVVLISGVSRVRSDASDHRYKAGEAVPLYANKVGPFHNPSETYRYFDLPFCVPDHVKEKKEALGEVLNGDRLVSAPYKLDFLVDKDSELICKKKMTKEEVTKFRDAVSKDYYFQMYYDDLPIWGFLGKADKEGKLDPSEYKYYLYKHIHFDIFYNKDRVIEINVRTDPNSLVDITEDKDVDVEFMYTVKWKETNTPFEKRMDKYSQSSSLPHHLEIHWFSIINSCVTVLLLTGFLATILMRVLKNDFVKYAHDEETAEDQEETGWKYIHGDVFRFPKYQSLLAASLGSGTQLFTLTFFIFLLALVGVFYPYNRGALFTALVVIYALTSGIAGYTATSFYFQLEGTNWVRNLLLTGCLFCGPLFLTFCFLNTVAIAYHATAALPFGTIVVILLIWTLVTSPLLVLGGIAGKNSKAEFQAPCRTTKYPREIPPLPWYRGTLPQMAMAGFLPFSAIYIELYYIFASVWGHRIYTIYSILFIVFIILIIVTAFITVALTYFQLAAEDHEWWWRAFLCGGSTGLFIYGYCLYYYYARSDMTGFMQTSFFFGYMACICYGFFLMLGTVGFRASLLFVRHIYRSIKCE

SEQ ID NO: 9792 - protein, 589 aa, Prunus mume
MAVGVPVIIALLILCGVDLVRSDASDHRYKEGDLVPLYANKVGPFHNPSETYRYFDLPFCSPDKVKEKKEALGEVLNGDRLVSAPYKLEFQKHKDSEVACKRTIKKEEVARFRSAVNKDYYFQMYYDDLPIWGFIGKVDKEGKDPSEYKTYLYKHIHFDISYNKDRVIEINVRTDPNALVDLTEDKEIDVEFMYTVKWKETTTPFDKRMDKYSQSSSLPHHLEIHWFSIINSCVTVLLLTGFLATILMRVLKNDFVKYAHDEEAAEDQEETGWKYIHGDVFRFPKYKSLFAAALGSGTQLFTLTIFIFILALVGVFYPYNRGALFTALVVIYALTSGIAGYTATSFYCQLEGTNWVRNLLLTGCLFCGPLFLTFCFLNTVAIAYTATAALPFGTIVVIVLIWTLVTSPLLVLGGIAGKNSKAEFQAPVRTTKYPREIPPLPWYRATIPQMAMAGFLPFSAIYIELYYIFASVWGHRIYTIYSILFIVFIILLIVTAFITVALTYFQLAAEDHEWWWRSFLCGGSTGIFIYAYCLYYYYARSDMSGFMQTSFFFGYMACICYGFFLMLGTVGFRAALLFVRHIYRSIKCE

SEQ ID NO: 9793 - protein, 592 aa, Arabidopsis lyrata
MRLPTSLLLFIGALIFSGAGNVRSDASDHRYKDGDSVPLYANKVGPFHNPSETYRYFDLPFCIPDGVKDKKEALGEVLNGDRLVSAPYKLNFREEKDSDVYCRKKLSREQVEQFRRAVEKDYYFQMYYDDLPIWGFIGKVDKESKSDPSEFKYFLYKHIQFEILYNKDRVIEINARMDPHSLVDLTEDKEVDAEFMYTVKWKETETPFEKRMDKYAMSSSLPHHLEIHWFSIINSCVTVLLLTGFLATILMRVLKNDFMKYAQDEEAADDQEETGWKYIHGDVFRFPKHKSLFAASLGSGTQLFTLTIFIFMLSLVGVFYPYNRGALFTALVVIYALTSGIAGYTASSFYCQLEGKNWVRNLLLTGGLFCGPLFLTFCFLNTVAIAYSATAALPFGTIVVIVLIWTLVTSPLLVLGGIAGKNSKAEFQAPVRTTKYPREIPPLPWYRSAIPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACICYGFFLMLGTVGFRAALLFVRHIYRSIKCE

SEQ ID NO: 9794 - protein, 591 aa, Triphysaria pusilla
MARGEWPFVVLLLLCIAIPAVRSDGSDHKYKIGDSVPLYANKVGPFHNPSETYRYFDLPFCSPGNVKDKSEALGEVLNGDRLVSAPYKLDFLVDKELEVICKRQLSKKDVAEFRSAVAKDYYFQMYYDDLPIWGFLGKVDKEGKADPSEYKYYLFKHLHFEIFYNKDRVIEINARTDPSALVDLTDGKEVDVEFMYSAKWKETNIAFDKRMEKYSHSSSLPRHLEIHWFSIINSCVTVLLLTGFLATILMRVLKNDFVKYAHDEETADDQEETGWKYIHGDVFRFPKYKSLFSAALGSGTQLFTLATFIFLLALVGVFYPYNRGALFTALVVIYALTSGIAGYTAASFYCQLEGTNWVRNLLLTGGLFCGPLFLTFCFLNTVAIAYHATAALPFGTIVVIFLIWALVTSPLLVLGGIAGKNSKAEFQAPCRTTKYPREIPPLPWYRGTLPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACVCYAFFLMLGAVGFRAALFFVRHIYRSIKCE

SEQ ID NO: 9795 - protein, 592 aa, Populus trichocarpa
MEKKLVPCLVSFVLILCSVSHVRSDASDHRYKVGDDVPLYVNKVGPFHNPSETYRYFDLPFCSSGPTKDKKEALGEVLNGDRLVTAPYKLDFLNDKDSEVACKNTLTKEQVAQFREAVSKDYYFQMYYDDLPIWGFLGKVDKERKNDPSEYKYYLFKHLHFTIFYNKDRVIEISAQSDLNNVVDLTEDKEVNVEFMYSVKWKETDITFEKRMDKYSQSSSLPHHLEIHWFSIINSCVTVLLLTGFLATILMRVLKNDFVKYAHDEESAEDQEETGWKYIHGDVFRYPKYKSLLAAAVGSGTQLFTLTIFIFVLALVGVFYPYNRGALFTALVVIYALTAGIAGYTAASFFCQLEGTNWVRNLLLTGALFCGPLFLTFCFLNTVAITYSATAALPFGTIVVIFLIWALVTTPLLVLGGIAGKNSKAEFQAPVRTTKYPREIPQLPWYRKTLPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMACVCYGFFLMLGSIGFRASLFFVRHIYRSIKCE

SEQ ID NO: 9796 - protein, 592 aa, Solanum lycopersicum
MEKKMMSYVVVLIVLCCGVTPARSDGSDHKYKAGDQVTMYANKVGPFHNPSETYRFFDLPFCAPAHVTEKKEALGEVLNGDRLVSAPYKLDFMYDKDSEIVCKKKLSKEEVSLFRNAVAKDYYFQMYYDDLPIWGFLGKVDKEGKTDPSEYKYYLFKHLHFEIFYNNDRVVEINARTDPNALVDITEDKEVDVDFMYSVKWKESTTPFEKRMEKYSQSSSMPHHLEIHWFSIINSCVTVLLLTGFLATILMRVLKNDFVKYAHDEEAADDQEETGWKYIHGDVFRYPKYKSLLAAAVGSGTQLFTMTIFIFILALVGVFYPYNRGALFTALVVIYALTSGIAGYTASAFYCQLEGTNWVRNLILTGALFCGPLFLTFCFLNSVAIGYTATAALPFGTIMVIFLIWALVTSPLLVLGGIAGKNSKSEFQAPCRTTKYPREIPPSPWYRGTLSQMAMAGFLPFSAIYIELYYIFASVWGHRIYTIYSILFIVFIILLIVTAFITVALTYFQLAAEDHEWWWRAFLCGGSTGLFIYGYCLYYYYARSDMTGFMQTSFFFGYMACICYGFFLMLGSVGFRAALFFVRHIYRSIKCE

SEQ ID NO: 9797 - protein, 592 aa, Arachis hypogaea
MRKNHHLLPLLLLSLTFLSFSTVRSDSSDHRYKEGNIVPLYANKVGPFHNPSETYRYFDLPFCLPDDLKEKKEALGEVLNGDRLVSAPYKLEFQQDKDSVPVCKKTLKKEDVAKFRAAVRKDYYFQMYYDDLPIWGFIGKVDKEGKDPSDYKYYLYKHIHFDIYYNNDRVIEINVRTDPNALVDVTEDNEVEVEFLYTVKWKETNTPFEKRMDKYSQSSSLPHHLEIHWFSIINSCVTVLLLTGFLATILMRVLKNDFVKYAHDEEAAEDQEETGWKYIHGDVFRFPKYKSLFAAALGSGTQLFTLTVFIFILALVGVFYPYNRGALFTALVVIYALTSGIAGYTATSFYCQLEGSNWVRNLLLTGCLFCGPLFLTFCFLNTVAIVYNATAALPFGTIVVIVLIWTLVTSPLLVLGGIAGKNSKAEFQAPCRTTKYPREIPPLPWYRGTIPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACICYGFFLMLGTVGFRAALLFVRHIYRSIKCE

SEQ ID NO: 9798 - protein, 598 aa, Nicotiana benthamiana
MEKKKRTMAWYVVVLLIVSCASPVRSDGSDHKYKAGDPVPLYANKVGPFHNPSETYRFFDLPFCAPDHVKEKKEALGEVLNGDRLVSAPYKLDFMYDKDSEIDSEIVCKKKLSKEEVAQFRSAVAKDYYFQMYYDDLPIWGFLGKVDKEGKSDPSEYKYYLFKHLHFEIFSNNDRVIEINARTDPNALVDITEDKEVDVEFMYSVKWKETKTPFDKRMEKYSQSSSLPHHLEIHWFSIINSCVTVLLLTGFLATILMRVLKNDFVKYAHDEEAADDQEETGWKYIHGDVFRYPNYKSVLAAALGSGTQLFTLTIFIFLLSLVGVFYPYNRGALFTALVVIYALTSGIAGYTASSFYCQLEGTNWVRNLLLTGGLFCGPLFLTFCFLNSVAIAYSATAALPFGTIVVIFLIWALVTSPLLVLGGIAGKNSKAEFQAPCRTTKYPREIPPLPWYRGTLPQMAMAGFLPFSAIYIELYYIFASVWGHRIYTIYSILFIVFIILIIVTAFITVALTYFQLAAEDHEWWWRAFLCGGSTGLFIYGYCLYYYYARSDMSGFMQTSFFFGYMACICYGFFLMLGTVGFRAALFFVRHIYRSIKCE

SEQ ID NO: 9799 - protein, 591 aa, Prunus mume
MKNLSTILVLAILITCCVTRVRSDASDHRYNDGDAVPLYANKVGPFHNPSETYRYFDLPFCSAGDVKEKREALGEVLNGDRLVSAPYKLEFRKEKDTEVACRRKLTKEEVAQFRTAVKKDYYFQMYYDDLPIWGFLGKVDKEGKTDPSEYKYFLYKHIQFEVMYNKDRVIEIGAKMDPHSVVDLTEDKDVDADFMYTVKWRETNIPFENRMDKYSQSSSLPHHLEIHWFSIINSCVTVLLLTGFLATILMRVLKNDFMKYAQDEEAADDQEETGWKYIHGDVFRFPKHKSLFAAAHGSGTQLFTLTIFIFMLALVGVFYPYNRGALFTALVVIYALTSGIAGYTATSFYCQLEGTNWVRNLLLTGCLFCGPLFLTFCFLNTVAIAYSATAALPFGTIVVIVLIWTLVTSPLLVLGGIAGKNSKAEFQAPCRTTKYPREIPPLPWYRTTIPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMACICYGFFLMLGTVGFRAALLFVRHIYKSIKCE

SEQ ID NO: 9800 - protein, 592 aa, Eutrema halophilum
MKIPTTLLLLVGALIFSGAGNVRSDASDHRYKEGDSVPLYANKVGPFHNPSETYRYFDLPFCVPEGVKDKKEALGEVLNGDRLVSAPYKLNFRDEKDSEIYCKKKLSREEVEQFRRAVEKDYYFQMYYDDLPIWGFIGKVDKESKSDPSEFKYFLYKHIQFEILYNKDRVIEINARMDPHSLVDLTEDKEVDAEFMYTVKWKETETPFDKRMEKYAMSSSLPHHLEIHWFSIINSCVTVLLLTGFLATILMRVLKNDFMKYAQDEEAADDQEETGWKYIHGDVFRFPKHKSLFAASLGSGTQLFTLTIFIFMLSLVGVFYPYNRGALFTALVVIYALTSGIAGYTASSFYCQLEGKNWVRNLLLTGCLFCGPLFLTFCFLNTVAIAYSATAALPFGTIVVIVLIWTLVTSPLLVLGGIAGKNSKAEFQAPVRTTKYPREIPPLPWYRSAVPQMAMAGFLPFSAIYIELYYIFASVWGHRIYTIYSILFIVFIILIIVTAFITVALTYFQLAAEDHEWWWRSFLCGGSTGLFIYAYCLYYYYARSDMSGFMQTSFFFGYMACICYGFFLMLGTVGFRAALLFVRHIYRSIKCE

SEQ ID NO: 9801 - protein, 592 aa, Arabidopsis thaliana
MRTPTTILLLVGAILFSGAGYVRSDASDHRYKEGDTVPLYANKVGPFHNPSETYRYFDLPFCIPEGVKEKKEALGEVLNGDRLVSAPYKLNFRDEKESEVYCNKKLSKEEVKQFRKAVEKDYYFQMYYDDLPIWGFIGKVDKDIKSDPSEFKYFLYKHIQFEILYNKDRVIEISARMDPHSLVDLTEDKEVDAEFMYTVKWKETETPFEKRMEKYSMSSSLPHHLEIHWFSIINSCVTVLLLTGFLATILMRVLKNDFMKYAQDEEAADDQEETGWKYIHGDVFRFPTHNSLFAASLGSGTQLFTLTIFIFMLALVGVFYPYNRGALFTALVVIYALTSGIAGYTSASFYCQLEGKSWVRNLLLTGCLFCGPLFLTFCFLNTVAITYTATAALPFGTIVVIVLIWTLVTSPLLVLGGIAGKNSKAEFQAPCRTTKYPREIPPLPWYRSAIPQMAMAGFLPFSAIYIELYYIFASVWGHRIYTIYSILFIVFIILIIVTAFITVALTYFQLAAEDHQWWWRSFLCGGSTGLFIYAYCLYYYYARSDMSGFMQTSFFFGYMACICYGFFLMLGTVGFRAALLFVRHIYRSIKCE

SEQ ID NO: 9802 - protein, 591 aa, Vitis vinifera
MERAMAILVVAVLILLCGSQVRSDASSHRYKAGEAVPLYANKVGPFHNPSETYRYFDLPFCVPAHLKEKKEALGEVLNGDRLVSAPYKLDFLREKDSEVVCKKKLKKEEVAQFRAAVAKDYYFQMYYDDLPIWGFIGKVDKEGKADPSEYKYFLYKHIQFDIRYNKDRVIEINARTDPHSMVDVTDDKDVDVEFMYTVKWTETDAPFEKRMEKYSQTSSMPHHLEIHWFSIINSCVTVLLLTGFLATILMRVLKNDFIKYAHDEESADDQEETGWKYIHGDVFRYPKYKSLFAAALGSGTQLFTLTVFIFILALVGVFYPYNRGALFTALVVIYALTSGIAGYTATSFYCQLEGTNWVRNLLLTGCLFCAPLFLTFCFLNTVAIIYSATAALPFGTIVVIVLIWTLVTSPLLVLGGIAGKNSKAEFQAPCRTTKYPREIPALPWYRSTIPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMACICYGFFLMLGTVGFRASLLFVRHIYRSIKCE

SEQ ID NO: 9803 - protein, 592 aa, Eutrema parvulum
MRTPTMLLLYVGALIFSGAGYVRSDASDHRYKEGDTVPLYANKVGPFHNPSETYRYFDLPFCIPEGVKEKKEALGEVLNGDRLVSAPYKLNFKDEKESEVYCKKKLSKEEVKQFRKAVEKDYYFQMYYDDLPIWGFIGKVDKEMKSDPSEYKYFLYKHIQFEILYNKDRVIEISARMDPHSLVDLTEDKEVDAEFMYTVKWKETETAFEKRMEKYSMSSSLPHHLEIHWFSIINSCVTVLLLTGFLATILMRVLKNDFMKYAQDEEAADDQEETGWKYIHGDVFRFPTHNSLFAASLGSGTQLFTLTIFIFMLALVGVFYPYNRGALFTALVVIYALTSGIAGYTSASFYCQLEGKSWVRNLLLTGCLFCGPLFLTFCFLNTVAITYTATAALPFGTIVVIVLIWTLVTSPLLVLGGIAGKNSKAEFQAPCRTTKYPREIPPLPWYRSAVPQMAMAGFLPFSAIYIELYYIFASVWGHRIYTIYSILFIVFIILIIVTAFITVALTYFQLAAEDHQWWWRSFLCGGSTGLFIYAYCLYYYYARSDMSGFMQTSFFFGYMACICYGFFLMLGTVGFRAALLFVRHIYRSIKCE

SEQ ID NO: 9804 - protein, 592 aa, Mimulus guttatus
MAIGGEWHVVVLLLLCTAFPAVRSDASDHKFKVGDPVPLYANKVGPFHNPSETYRYFDLPFCSPGNVKDKSEALGEVLNGDRLVSAPYKLDFLADKESEVICKKHLSKEEVAVFRSAVAKDYYFQMYYDDLPIWGFLGKVDKEGKADPSEYKYHLFKHLHFEIFYNKDRVIEINARTDPNALVDLTDDKEVDVEFVFSAKWKETNIEFDKRMEKYSHSSSLPRHLEIHWFSIINSCVTVLLLTGFLATILMRVLKNDFVKYAHDEEAADDQEETGWKYIHGDVFRFPKYKSLFAAALGSGTQLFTLTTFIFLLALVGVFYPYNRGALFTALVVIYALTSGIAGYTASSFYCQLEGTNWVRNLLLSGGLFCGPLFLTFCFLNTVAIAYHATAALPFGTIVVIFLIWALVTSPLLVLGGIAGKNSKAEFQAPVRTTKYPREIPPLPWYRSTVPQMAMAGFLPFSAIYIELYYIFASVWGHRIYTIYSILFIVFIILLIVTAFITVALTYFQLAAEDHEWWWRSFLCGGSTGLFIYSYCLYYYYARSDMSGFMQTSFFFGYMACVCYAFFLMLGAVGFRAALFFVRHIYRSIKCE

SEQ ID NO: 9805 - protein, 594 aa, Gossypium raimondii
MRNFGNSPAFVILGVFILSCVSHVRSDASDHRYKEGDPVPLYANKVGPFHNPSETYRYFDLPFCSPDHVKEKKEALGEVLNGDRLVSAPYKLNFKEEKDSSVVCKKKLSKDEVVFFRKAVEKDYYFQMYYDDLPIWGFIGKVDKEGKADPSEYKYYLYKHIQFDVLYNKDRVIEISARMDPHLLVDLTEDKEVDAEFMYTVKWKETDTPFEKRMERYSMSSSLPHHLEIHWFSIINSCVTVLLLTGFLATILMRVLKNDFIKYGQDEEAADDQEETGWKYIHGDVFRFPKYKSLFAAALGSGTQLFTLTVFIFMLALVGVFYPYNRGALFTALVVIYALTSGIAGYVATSFYCQLEGTNWVRNLLLTGCLFCGPLFLTFCFLNTVAIAYSATAALPFGTIVVIVLIWTLVTSPLLVLGGIAGKNSRAEFQAPCRTTKYPREIPPLPWYRSAIPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACICYGFFLMLGTVGFRASLFFVRHIYRSIKCE

SEQ ID NO: 9806 - protein, 254 aa, Nicotiana benthamiana
MKKKMTVTCYVVALIILCCVLPARSDGSDHKYKAGDPVPLYANKVGPFHNPSETYRFFDLPFCAPAHVKEKKEALGEVLNGDRLVSAPYKLDFMYDKDSEIVCKKNLSKEEVSQFRSAVAKDYYFQMYYDDLPIWGFLGKVDKDGKSDPNEYKYYLFKHLHFEIFYNNDRVVEINARTDPNALVDITEDKEVDVDFIYSVKWKETPTPFEKRMEKYSQSSSLPHHLEIHWFSIINSCVTVLLLTGFLATTYARP

SEQ ID NO: 9807 - protein, 592 aa, Populus trichocarpa
MEMKLVPCLVVSILILCNVTRVRSDASNNRYKVGDDVPLYVNKVGPFHNPSETYRYFDLPFCSSGPTKDKKEALGELLNGDRLVTAPYKLDFLNDKDSEIACKNKLTKEQVAQFREAVSKDYYFQMYYDDLPIWGFIGKVEKEGKNDPSEYKYYLFKHLHFTIFYNKDRVIEITALSDQKNVVELTENKEVNVEFMYSVKWKETEIPYEKRMEKYSQSSSLPHHLEIHWFSIINSCVTVLLLTGFLATILMRVLKNDFVKYAHDEESAEDQEETGWKYIHGDVFRYPKYKSVLAAAVGSGTQLFTLTIFIFLLALVGVFYPYNRGALFTALVVIYALTAGIAGYTAASFFCQLEGTNWVRNLLLTGGLFCGPLLLTFSFLNTVAITYSATAALPFGTIVVIFLIWALVTTPLLVLGGIAGKNSKAEFQAPCRTTKYPREIPLLPWYRKTLPQMAMAGFLPFSAIYIELYYIFASVWGHRIYTIYSILFIVFIILLIVTAFITVALTYFQLAAEDHEWWWRSFLCGGSTGLFIYGYCLYYYFARSDMSGFMQTSFFFGYMACVCYGFFLMLGSIGFRASLFFVRHIYHSIKCE

SEQ ID NO: 9808 - protein, 587 aa, Glycine max
MRNLSFFFFFFFTFFAAVRSDPSDHRYKEGDPVPLYANKVGPFHNPSETYRYFDLPFCEPGDLKEKKEALGEVLNGDRLVSAPYKLEFQRDKELVSVCDRKLSKQDVARFRSAVRKDYYFQMYYDDLPIWGFIGKVDKEGKDPSDYRYFLYKHIHFDVFYNKDRVIEINVRTDPNALVDLTEDAEVQAEFLYTVKWKETNTPFEKRMDKYSQSSSLPHHLEIHWFSIINSCVTVLLLTGFLATILMRVLKNDFVKYAHDEESAEDQEETGWKYIHGDVFRFPKFKSLFAAALGSGTQLFTLTVFIFILALVGVFYPYNRGALFTALVVIYALTSGIAGYTATSFYCQLEGTNWVRNLLLTGCLFCGPLFLTFCFLNTVAIAYKATAALPFGTIVVIVLIWSLVTSPLLVLGGIAGKNSKAEFQAPVRTTKYPREIPPLPWYRGTIPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACICYGFFLMLGTVGFRAALLFVRHIYRSIKCE

SEQ ID NO: 9809 - protein, 592 aa, Eutrema halophilum
MRTPTLLLLFVGALIFSGAGYVRSDASDHRYKEGDTVPLYANKVGPFHNPSETYRYFDLPFCVPEGVKEKKEALGEVLNGDRLVSAPYKLNFRDEKESEVYCKKKLSKEEVKQFRKAVEKDYYFQMYYDDLPIWGFIGKVDKDIKSDPSEYKYFLYKHIQFEILYNKDRVIEISARMDPHSLVDLTEDKEVDAEFMYTVKWKETETPFEKRMEKYSMSSSLPHHLEIHWFSIINSCVTVLLLTGFLATILMRVLKNDFMKYAQDEEAADDQEETGWKYIHGDVFRFPTHNSLFAASLGSGTQLFTLTIFIFMLALVGVFYPYNRGALFTALVVIYALTSGIAGYTSASFYCQLEGKSWVRNLLLTGCLFCGPLFLTFCFLNTVAITYTATAALPFGTIVVIVLIWTLVTSPLLVLGGIAGKNSKAEFQAPCRTTKYPREIPPLPWYRSAVPQMAMAGFLPFSAIYIELYYIFASVWGHRIYTIYSILFIVFIILIIVTAFITVALTYFQLAAEDHQWWWRSFLCGGSTGLFIYAYCLYYYYARSDMSGFMQTSFFFGYMACICYGFFLMLGTVGFRAALLFVRHIYRSIKCE

SEQ ID NO: 9810 - protein, 592 aa, Populus trichocarpa
MEKKLVPCLVVSILILCSVTLVRSDASDNRYKVGEDVPLYVNKVGPFHNPSETYRYFDLPFCSSGPTKDKKEALGELLNGDRLVTAPYKLDFLNDKDSEIACKNKLTKEQVAQFREAISKDFYFQMYYDDLPIWGFIGKVEKEGKNDPSEYKYYLLKHLHFTIFYNKDRVIEITALSDPKNVVDLTEDKEVNVEFMYSVKWKETEIPYEKRMEKYSQSSSLPHHLEIHWFSIINSCVTVLLLTGFLATILMRVLKNDFVKYAHDEESAEDQEETGWKYIHGDVFRYPKYKSVLAAAVGSGTQLFTLTFFIFLLALVGVFYPYNRGALFTALVVIYALTAGIAGYTAASFFCQLEGTNWVRNLLLTGGLFCGPLLLTFSFLNTVAITYSATAALPFGTIVVIFLIWALVTTPLLVLGGIAGKNSKAEFQAPCRTTKYPREIPLLPWYRKTLPQMAMAGFLPFSAIYIELYYIFASVWGHRIYTIYSILFIVFIILLIVTAFITVALTYFQLAAEDHEWWWRSFLCGGSTGLFIYGYCLYYYFARSDMSGFMQTSFFFGYMACVCYGFFLMLGSIGFRASLFFVRHIYHSIKCE

SEQ ID NO: 9811 - protein, 592 aa, Populus trichocarpa
MEKKLVPCLVVSILILCSVTLVRSDASDNRYKVGEDVPLYVNKVGPFHNPSETYRYFDLPFCSSGPTKDKKEALGELLNGDRLVTAPYKLDFLNDKDSEIACKNKLTKEQVAQFREAVSKDYYFQMYYDDLPIWGFIGKVEKEGKNDPSEYKYYLFKHLHFTIFYNKDRVIEITALSDQKNVVELTENKEVNVEFMYSVKWKETEIPYEKRMEKYSQSSSLPHHLEIHWFSIINSCVTVLLLTGFLATILMRVLKNDFVKYAHDEESAEDQEETGWKYIHGDVFRYPKYKSVLAAAVGSGTQLFTLTIFIFLLALVGVFYPYNRGALFTALVVIYALTAGIAGYTAASFFCQLEGTNWVRNLLLTGGLFCGPLLLTFSFLNTVAITYSATAALPFGTIVVIFLIWALVTTPLLVLGGIAGKNSKAEFQAPCRTTKYPREIPLLPWYRKTLPQMAMAGFLPFSAIYIELYYIFASVWGHRIYTIYSILFIVFIILLIVTAFITVALTYFQLAAEDHEWWWRSFLCGGSTGLFIYGYCLYYYFARSDMSGFMQTSFFFGYMACVCYGFFLMLGSIGFRASLFFVRHIYHSIKCE

SEQ ID NO: 9812 - protein, 596 aa, Solanum lycopersicum
MARKSRMGCGNYAVVLVLLFFGAMKVRSDSSDHKYKSGEEVPLYANKVGPFHNPSETYRYFDLPFCSPGHVKDKTEALGEVLNGDRLVTAPYKLDFTNDRETEVVCKKTLSKEEVARFRDAVAKDYYFQMFYDDLPIWGFIGKVDKEGKADPSEYKYYLFKHLHFDIHHNKDRVIEVNARTDPNALVDITEDKEIDVDFMYSVKWKETEIPFEKRMEKYSQTSALPHHLEIHWFSIINSCVTVLLLTGFLATILMRVLKNDFVKYAHDEEAADDQEETGWKYIHGDVFRYPKQKSLFAAALGSGTQLFTLAIFIFILALVGVFYPYNRGALFTALVVIYALTSGIAGYTAASFYCQLEGKNWVRNLLLTGGLFCGPLLLTFCFLNSVAIGYHATAALPFGTIVVIFLIWALVTSPLLVLGGIAGKNSKAEFQAPTRTTKYPREIPQLPWYRGALPQMAMAGFLPFSAIYIELYYIFASVWGHRIYTIYSILFIVFIILIIVTAFITVALTYFQLAAEDHEWWWRSFVCGGSTGLFIYGYCLYYYYARSDMSGFMQTSFFFGYMACICYAFFLMLGTVGFRAALFFVRHIYRSIKCE

SEQ ID NO: 9813 - protein, 594 aa, Phaseolus vulgaris
MRNLFSSSSSFCLLLFTAFAALSAVRSDSSDHRYKQGDIVPLYANKVGPFHNPSETYRYFDLPFCPPVDLKEKKEALGEVLNGDRLVSAPYVLEFQRDKESVHVCDAKLSKKDVARFRSAVRKDYYFQMYYDDLPIWGFIGKVDKEGKDPSEYRYFLYKHIHFDVFYNKDRVIEINVRTDPNALVDLTEDAEVNAEFQYTVKWKETNTPFEKRMDKYSQSSSLPHHLEIHWFSIINSCVTVLLLTGFLTTILMRVLKNDFVKYAHDEETAEDQEETGWKYIHGDVFRFPKFKSLFAAALGSGTQLFTLTLFIFILALVGVFYPYNRGALFTALVVIYALTSGIAGYTATSFYCQLEGTNWVRNLLLTGCLFCGPLFLTFCFLNTVAIAYKATAALPFGTIVVIVLIWTLVTSPLLVLGGIAGKNSKVEFQAPVRTTKYPREIPPLPWYRGPIPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACICYGFFLMLGTVGFRAALLFVRHIYRSIKCE

SEQ ID NO: 9814 - protein, 592 aa, Arabidopsis thaliana
MRLPTTLLLFIGALIFSGAGNVRSDASDHRYKDGDSVPLYANKVGPFHNPSETYRYFDLPFCIPEGVKDKKEALGEVLNGDRLVSAPYKLNFRDEKDSEVYCKKKLSREEVEHFRRAVEKDYYFQMYYDDLPIWGFIGKVDKESKSDPSEFKYFLYKHIQFEILYNKDRVIEINARMDPHSLVDLTEDKEVDAEFMYTVKWKETETSFEKRMDKYAMSSSLPHHLEIHWFSIINSCVTVLLLTGFLATILMRVLKNDFMKYAQDEEAADDQEETGWKYIHGDVFRFPKNKSLFAASLGSGTQLFTLTIFIFMLSLVGVFYPYNRGALFTALVVIYALTSGIAGYTASSFYCQLEGKNWVRNLLLTGGLFCGPLFLTFCFLNTVAIAYSATAALPFGTIIVIVLIWTLVTSPLLVLGGIAGKNSKAEFQAPVRTTKYPREIPPLPWYRSAVPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACICYGFFLMLGTVGFRAALLFVRHIYRSIKCE

SEQ ID NO: 9815 - protein, 592 aa, Eutrema parvulum
MKIPTTLLLFIGALIFSGAGNVRSDASDHRYKEGDSVPLYANKVGPFHNPSETYRYFDLPFCVPEGVKDKKEALGEVLNGDRLVSAPYKLSFRDEKDSETYCKKKLSREEVEQFRRAVEKDYYFQMYYDDLPIWGFIGKVDKESKADPSEFKYFLYKHIQFEILYNKDRVIEINARMDPHSLVDLTEDKEVDAEFMYTVKWKETETSFEKRMDKYAMSSSLPHHLEIHWFSIINSCVTVLLLTGFLATILMRVLKNDFMKYAQDEEAADDQEETGWKYIHGDVFRFPKYKSLFAASLGSGTQLFTLTIFIFMLSLVGVFYPYNRGALFTALVVIYALTSGIAGYTASSFYCQLEGKNWVRNLLLTGGLFCGPLFLTFCFLNTVAIAYSATAALPFGTIVVIVLIWTLVTSPLLVLGGIAGKNSKAEFQAPCRTTKYPREIPPLPWYRSAIPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACICYGFFLMLGTVGFRAALLFVRHIYRSIKCE

SEQ ID NO: 9816 - protein, 596 aa, Nicotiana benthamiana
MVKKNSMGCGDYVVVLALLLFGATIVRSDSSDHKYKNGEEVPLYANKVGPFHNPSETYRYFDLPFCSPGHVKDKTEALGEVLNGDRLVTAPYKLDFLSDRETEVVCKKSLSKEEVARFRDAVAKDYYFQMFYDDLPIWGFIGKVDKEGKSDPSEYKYYLFKHLHFDIHFNNDRVIEVNARTDPNALVDITEGKEVDVDFMYSVKWKETDIPFEKRMEKYSQTSALPHHLEIHWFSIINSCVTVLLLTGFLATILMRVLKNDFVKYAHDEESADDQEETGWKYIHGDVFRYPKRNSLFAAALGSGTQLFTLTIFIFILALVGVFYPYNRGALFTALVVIYALTSGIAGYTAASFYCQLEGKNWVRNLLLTGGLFCGPLFLTFCFLNTVAIAYHATAALPFGTIVVIFLIWALVTSPLLVLGGIAGKNSKAEFQAPCRTTKYPREIPQLPWYRGALPQMAMAGFLPFSAIYIELYYIFASVWGHRIYTIYSILFIVFIILIIVTAFITVALTYFQLAAEDHEWWWRSFLCGGSTGLFIYGYCLYYYYARSDMSGFMQISFFFGYMACICYAFFLMLGTVGFRAALFFVRHIYRSIKCE

SEQ ID NO: 9817 - protein, 594 aa, Gossypium raimondii
MKNMGDFPTFLVVALLIFSCLSYVRSDASDHRYKDGDAVPLYANKVGPFHNPSETYRYFDLPFCSPDHVTEKREALGEVLNGDRLVSAPYKLNFKEEKDSSVVCKKKLLKDEVAFFRKAVDKDYYFQMYYDDLPIWGFIGKVDKEGKTDPSEYKYFLFKHIQFDVLYNKDRVIEVNARMDPHSLVDLTEDKEVDAEFMYSAKWKETETPFEKRMDKYSMSSSLPHHLEIHWFSIINSCVTVLLLTGFLATILLRVLKNDFIKYGQDEEAADDQEETGWKYIHGDVFRFPKYKSLFAAALGSGTQLFTLTVFIFMLALVGVFYPYNRGALFTALVVIYALTSGIAGYTATSFYCQLEGNNWVRNLLLTGCLFCGPLFLTFCFLNTVAIVYSATAALPFGTIVVIVLIWTLVTSPLLVLGGIAGKNSKAEFQAPCRTTKYPREIPPLPWYRSAIPQMAMAGFLPFSAIYIELYYIFASVWGHRIYTIYSILFIVFIILLIVTAFITVALTYFQLAAEDHEWWWRSFLCGGSTGIFIYAYCLYYYYARSDMSGFMQTSFFFGYMACICYGFFLMLGTVGFRASLLFVRHIYRSIKCE

SEQ ID NO: 9818 - protein, 592 aa, Ricinus communis
MSYNPLTILILLLSISSSLLHVRSDTSDHRYKEGDPVPFYANKVGPFHNPSETYRYFDLPFCVPDHLKEKKEALGEVLNGDRLVSAPYTLNFRDDKVSAPVCQKKLSKEDVAQFRSAIAKDYYFQMYYDDLPIWGFIGKVVKDGKDDPSEYKYFLYQHVQFDVLYNKDRVIEVGVRMDPNSMLDLTEDKEVDVEFLYTVKWKETDNTFENRMKKYSLSSSLPHHLEIHWFSIINSCVTVLLLTGFLATILMRVLKNDFVKYAQDEEEADDQEETGWKYIHGDVFRYPKYKSLFAAALGSGTQLFTLTLFIFILALVGVFYPYNRGALFTALVVIYALTSGIAGYTATSFYCQLEGNNWVRNLLLTGCLFCGPLFLTFCFLNTVAIVYSATAALPFGTIVVIVLIWTLVTSPLLILGGIAGKNSKAEFQAPCRTTKYPREIPQLPWYRSALPQMAMAGFLPFSAIYIELYYIFASVWGHRIYTIYSILFIVFIILVIVTAFITVALTYFQLAAEDHEWWWRSFLCGGSTGLFIYAYCLYYYHARSEMSGFMQTSFFFGYMACICYGFFLMLGTVGFRASLFFVRHIYKSIKCE

SEQ ID NO: 9819 - protein, 585 aa, Centaurea maculosa
MEIVALFVISSLLLLGSVTSDASNHKYKSGDVVPLYANKVGPFQNPSETYRYFDLPFCLPGDLKEKKEALGEVLNGDRLVSAPYKLDFLVDKDSEFICTKKLTKQEVAKFRKSIAKDYYFQMYFDDLPLWGFIGKYEKTESNEQKYYLFKHLQFEVLYNKNRVIEVNVRTDPSALVDVTEDKEVNVDFMYTVRWKETSIPFEKRMEKYSHNSSLPHHLEIHWFSIINSCVTVLLLTGFLATILMRVLKNDFVKYAHDEETAEDQEETGWKYIHGDVFRYPKFKSLFAAALGSGSQLFALTIFIFILALVGVFYPYNRGALFTALVVIYALTSGIAGYTASSFYCQLEGTNWVRNLLLTGSLFCGPLFLTFCFLNTVAIAYSATAALPFGTIVVIALIWALVTSPLLVLGGIAGKNSKAEFQAPCRTTKYPREIPPLPWYRGTLAQMGMAGFLPFSAIYIELYYIFASVWGHRIYTIYSILFIVFIILVIVTAFITIALTYFQLAAEDHEWWWRSFLCGGSTGLFIYGYCLYYYYGRSDMTGFMQTSFFFGYMACICYGFFLMLGTIGFRAALFFVRHIYRSIKCE

SEQ ID NO: 9820 - protein, 588 aa, Medicago truncatula
MAKMNPLFILAFFFFFSTVRSDSSDKRYKEGDLVPLFANKVGPFHNPSETYRYFDLPFCIPDHLKEKKEALGEVLNGDRLVSAPYQLEFQKDKDSLSVCKKTLTKEEVANFRSAVRKDYYFQMYYDDLPIWGFIGKVDKEGKDPSDYRYYLYKHIHFDIFYNKDRVIEINVRTDPNALVDVTEDNEVDVEFFYTVKWKETNTPFEKRMDKYSQPSSLPHHLEIHWFSIINSCVTVLLLTGFLATILMRVLKNDFVKYAHDEETAEDQEETGWKYIHGDVFRFPKFKSVFAAALGSGTQLFTLTVFIFILALVGVFYPYNRGALFTALVVIYALTSGIAGYTATSFYCQLEGTNWVRNLLLTGCLFCGPLFLTFCFLNTVAIVYNATAALPFGTIVVIVLIWTLVTSPLLVLGGIAGKNSKAEFQAPVRTTKYPREIPPLPWYRGAIPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACICFGFFLMLGTVGFRAALFFVRHIYRSIKCE

SEQ ID NO: 9821 - protein, 592 aa, Cicer arietinum
MNNNHSLFIIAFFFFISSLFSTVRSDSSDHRFKEGDLVPLFANKVGPFHNPSETYRYFDLPFCIPDHLKEKKEALGEVLNGDRLVSAPYQLEYRRDKESVSVCKKKLTKEDVGKFRSAVRKDYYFQMYYDDLPIWGFIGKVDKEGKDPSDYRYYLYKHIHFDIFYNKDRVIEINVRTDPNALVDVTEDNEVDVEFFYTVKWKETNTPFDKRMDKYSQSSSLPHHLEIHWFSIINSCVTVLLLTGFLATILMRVLKNDFVKYAHDEEVADDQEETGWKYIHGDVFRFPKFKSVFAAALGSGTQLFTLTVFIFILALVGVFYPYNRGALFTALVVIYALTSGIAGYTATSFYCQLEGTNWVRNLLLTGCLFCGPLFLTFCFLNTVAIVYNATAALPFGTIVVIVLIWTLVTSPLLVLGGIAGKNSKAEFQAPVRTTKYPREIPPLPWYRGTIPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACICYGFFLMLGTVGFRAALFFVRHIYRSIKCE

SEQ ID NO: 9822 - protein, 590 aa, Lupinus angustifolius
MKTLSFFLLFTFITSSSLYTVRSDPSNHRYQQGDLVPLYANKVGPFHNPSETYRYFDLPFCLPGDLKEKKEALGEVLNGDRLVSAPYKLEFQQDKESVAVCKKTLKKEDVALFRSAVRKDYYFQMYYDDLPIWGFIGKIDKEGKDPSDYKYYLYQHIHFDIFYNKDRVIEINVRTDPNALVDLTEDNEVGVEFLYTVKWKETNTPFDNRMDKYSKSSSLPHHLEIHWFSIINSCVTVLLLTGFLATILMRVLKNDFVKYAHDEESAEDQEETGWKYIHGDVFRFPKYKSIFAAALGSGSQLFTLTVFIFILALVGVFYPYNRGALFTALVVIYALTSGIAGYTATSIYCQLEGTNWVRNLLLTGCIFCGPLFLTFCFLNTVAITYNATAALPFGTIVVIVLIWTLVTSPLLVLGGIAGKNSKAEFQAPCRTTKYPREIPSLPWYRGTIPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACICYGFFLMLGTVGFRAALFFVRHIYRSIKCE

SEQ ID NO: 9823 - protein, 592 aa, Phaseolus vulgaris
MGRSGLALVLAILISLQGTILVRSDASDHRYKEGDHVPLYANKVGPFHNPSETYRYFDLPFCVTGNEKEKTEALGEVLNGDRLVSTPYELDFRTEKDAKLACSRKLKKQEVAQFREAVKKDYYFQMYYDDLPIWGFIGTVDKEGKTDPSEYKYFLYKHIQFDILYNKDRVVEISARMDPNSVVDLTEDKEVDVDFRYTAKWKETDTPFEKRMEKYSQSSSLPHHLEIHWFSIINSCVTVLLLTGFLATILMRVLKNDFMKYAQDEEAADDQDETGWKYIHGDVFRFPKHKSLFAASLGSGTQLFTLTIFIFMLALVGVFYPYNRGALFTALVVIYALTSGIAGYTATSFYIQLEGSNWVRNLLLTGCLFCGPLFLMFCFLNTVAIVYSATAALPFGTILVIVLIWTLVTSPLLVLGGIAGKNSKSEFQAPVRTTKYPREIPPLPWYRSTLPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMACICYGFFLMLGSVGFRASLLFVRHIYRSIKCE

SEQ ID NO: 9824 - protein, 592 aa, Glycine max
MGRSTLALVLAILISLQGTPHVRSDASDHRYKDGDSVPLYANKVGPFHNPSETYRYFDLPFCVTGHEKDKTEALGEVLNGDRLVSAPYELSFKKEKDSKVVCKRKLTKEQVAQFREAVKKDYYFQMYYDDLPIWGFIGTVDKEGKTDPSEYKYFLYKHIQFDIHYNKDRVIEISARMDPHSVVDLTEDKDVDVEFVYTAKWKETETPFEKRMDKYSQSSSLPHHLEIHWFSIINSCVTVLLLTGFLATILMRVLKNDFMKYAQDEEAADDQEETGWKYIHGDVFRFPKFKSFFSAALGSGTQLFTLTIFIFMLALVGVFYPYNRGALFTALVVIYALTSGIAGYTATSFYIQLEGTNWVRNLLLTGCLFCGPLFLMFCFLNTVAIAYSATAALPFGTIVVIVLIWTLVTSPLLVLGGIAGKNSKTEFQAPVRTTKYPREIPPLPWYRSTIPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMACICYGFFLMLGSVGFRASLLFVRHIYRSIKCE

SEQ ID NO: 9825 - protein, 327 aa, Theobroma cacao
MISSSMHMTRNQQMTRKRLGGSTFMVMCSGTQSTSLCLQRLLVLAPSSLLFGVFYPYNRGALFTALVVIYALTSGIAGYTAASFYCQLEGTNWVRNLLLTGGLFCGPLLITFCFLNTVAIAYKTTTALPFGTIVVIFLIWALVTSPLLVLGGIAGKNSKAEFQAPCCTTKYPREIPLLPWYRKTFPQMAMARFLPFSAIYIELYYIFANVWGHRIYTIYSILFIVFIILLIVTAFITVALTYFQLAAEDHEWWWRSFLCGGSTGLFIYAYCLYYYNARSDMSGFMQTSFFFGCMACICYGFFLMLGAIGFHASLFFVRHIYRSIKCE

SEQ ID NO: 9826 - protein, 587 aa, Panax ginseng
MEQKMGLLFMVSFLVMMSSASLVRSSASTHKYKAGDQVPLYVNKVGPFQNPSETYRYFDLPFCMPGSTHLLDKPEALGEVLNGDRLVSAPYQLNFLVEKDSEIVCRKTLTKEEVSKFRSAVAKDYYFQMYYDDLPLWGFLGKAEKDAKADPGEIKYYLFKHLHFEVFYNKDRVIEVNVRTDPSALVDLTEDKEVDADFMYTVKWKETHTPFEKRMDKYSQSSNMPHHLEIHWFSIINSCVTVLLLTGFLATILMRVLKNDFVKYAHDEETAEDQEETGWKYIHGDVFRYPKYKSVFAAALGSGTQLFAIAILVFMLALVGVFYPYNRGALFTALVIVYALTSGFAGYTAASFYCQLEGTNWVRNLLLTGSLFCGPLFLTFCFLNTVAIAYNATAALPFGTIVVIVLIWALVTSPLLVLGGIAGKNSKAEFQAPVRTTKYPREIPPLPWYRGTLPQMAMAGFLPFSAIYIELYYIFASVWGHRIYTIYSILFIVFIILLIVTAFITVALTYFQLAAEDHEWWWRSFLCGGSTGLFIYGYCLYYYYARSDMNGFMQTSFFFGYMACICYGFFSCSGPSVSVHHCFLFVT

SEQ ID NO: 9827 - protein, 595 aa, Panax ginseng
MEQKMGLLFMVSLLVMMSSASLVRSSASNHKYKAGDQVPLYVNKVGPFQNPSETYRYFDLPFCMPGSTHLLDKPEALGEVLNGDRLVSAPYQLNFLVEKDSEIVCRKTLTKEEVSKFRSAVAKDYYFQMYYDDLPLWGFLGKAEKDAKADPGEIKYYLFKHLHFEVFYNKDRVIEVNVRTDPSALVDLTEDKEVDADFMYTVKWKETHTPFEKRMDKYSQSSNMPHHLEIHWFSIINSCVTVLLLTGFLATILMRVLKNDFVKYAHDEETAEDQEETGWKYIHGDVFRYPKNKSVFAAALGSGTQLFAIAILVFMLALVGVFYPYNRGALFTALVIIYALTSGFAGYTAASFYCQLEGTNWVRNLLLTGSLFCGPLFLTFCFLNTVAIAYNATAALPFGTIVVIVLIWALVTSPLLVLGGIAGKNSKAEFQAPVRTTKYPREIPPLPWYRGTLPQMAMAGFLPFSAIYIELYYIFASVWGHRIYTIYSILFIVFIILLIVTAFITVALTYFQLAAEDHEWWWRSFLCGGSTGLFIYGYCLYYYYARSDMNGFMQTSFFFGYMACICYGFFLMLGTVGFRASLFFVRHIYRSIKCE

SEQ ID NO: 9828 - protein, 592 aa, Centaurea maculosa
MLKKMVAIRWLLVALLVVFPIQQVRSGSSDHKYKPNDEVPIYANKVGPFHNPSETYRFFDLPFCLPAHLKEKPEALGEVLNGDRLVSAPYKLPFMVEKDSEIVCRKKLTKEEVSKFRSAVAKDYYFQMYYDDLPSGAFGKVEKDKTDPSEEKYYLFKHLHFEIHYNKDRVIEINAKADPNAVVDLTEDKEIEVEFMYTVRWKETDIPFENRMEKYSQSSSQPHHLEIHWFSIINSCVTVLLLTGFLATILMRVLKNDFVKYAHDEEAADDQEETGWKYIHGDVFRYPKYKSLFAASLGSGTQLFSLALFIFALALVGVFYPYNRGALFTALVVIYALTSGIAGYTAASFYHQLEGTNWVRNLLLTGCLFCGPLFLTFCFLNTVAIAYTATAALPFGTIVVIVLIWTLVTSPLLVLGGIAGKNSKAEFQAPVRTTKYPREIPPLPWYRKTIPQMAMAGFLPFSAIYIELYYIFASVWGHRIYTIYSILFIVFIILLIVTAFITVALTYFQLAAEDHEWWWRSFLCGGSTGVFIYGYCLYYYYERSDMSGFMQTSFFFGYMACICYGFFLMLGTVGFRAALFFVRHIYRSIKCE

SEQ ID NO: 9829 - protein, 601 aa, Glycine max
MRRTNESAAAMGRSTLALVLAILISFQGTHVRSDASDHRYKDGDSVPLYANKVGPFHNPSETYRYFDLPFCVTGHEKEKTEALGEVLNGDRLVSAPYELSFKKEKDSKVVCKRKLTKEQVAQFREAVKKDYYFQMYYDDLPIWGFIGTIDKEGKTDPSEYKYFLYKHIQFDILYNKDRVIEISARMDPHSVVDLTEDKDVDVEFMYTAKWKETDTSFEKRMDKYSQSSSLPHHLEIHWFSIINSCVTVLLLTGFLATILMRVLKNDFMKYAQDEEAADDQEETGWKYIHGDVFRFPKHKSFFSAALGSGTQLFTLTIFIFMLALVGVFYPYNRGALFTALVVIYALTSGIAGYTATSFYIQLEGTNWVRNLLLTGCLFCGPLFLMFCFLNTVAIAYSATAALPFGTIVVIVLIWTLVTSPLLVLGGIAGKNSKTEFQAPVRTTKYPREIPPLPWYRSTIPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMACICYGFFLMLGSVGFRASLLFVRHIYRSIKCE

SEQ ID NO: 9830 - protein, 592 aa, Cicer arietinum
MGRSKVLVLWILISLSLLATHVRSDASDHRYGDGDPVPLYANKVGPFHNPSETYRYLDLPFCVTGHEKEKTEALGEVLNGDRLVSAPYELHFRKEKDSNVVCKKKLTREEVNQFREAVKKDYYFQMYYDDLPIWGFIGTVDKEGKTDPSEYKYFLYKHIQFDVLYNKDRVIEVSARMDPHSVVDLTEDKEIDVEFMYTVKWKETDIPFEKRMDKYSQSSSLPHHLEIHWFSIINSCVTVLLLTGFLATILMRVLKNDFMKYAQDEEAADDQEETGWKYIHGDVFRFPKYKSIFAAALGSGTQLFTLTIFIFMLALVGVFYPYNRGALFTALVVIYALTSGIAGYTATSFYIQLEGSNWVRNLLLTGCLFCGPLFLMFCFLNTVAIAYSATAALPFGTILVIVLIWTLVTSPLLVLGGIAGKNSKTEFQAPVRTTKYPREIPPLPWYRSTIPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMACICYGFFLMLGSVGFRASLLFVRHIYRSIKCE

SEQ ID NO: 9831 - protein, 593 aa, Zea mays
MAALRAPAATLLVLLALAAAGGVAADGSDHRYKIREPVPLYANKVGPFHNPSETYRYFDLPFCSPDKVKEKSEALGEVLNGDRLVDAPYKLDFRDEVESKAVCSKKLTTEDVVKFRNAVAKDYYFQMYYDDLPLWGFIGKVEKGGKDDPSEWKYYLYRHIIFDILYNNDRVIEINVHTDQSALVDLTEDKETNVEFLYSAKWKETPTPFEKRMEKYSSSSNMPHHLEVHWFSIINSCVTVLLLTGFLATILMRVLKNDFVKYAHDEEAADDQEESGWKYIHGDVFRFPKNKSLFSAALGTGTQLFALTTFIFLLALVGVFYPYNRGALFTALVVIYALTSGIAGYIATSFYCQLEGTNWVRNLLLTGCLFCGPLFLTFCFLNTVAIAYSATAALPFGTICVIVLIWTLVTFPLLVLGGIAGKNSKSEFQAPCRTTKYPREIPPLPWYRRTIPQMAMAGFLPFSAIYIELYYIFASVWGHRIYTIYSILFIVFIILLIVTAFITVALTYFQLAAEDHEWWWRSFLCGGSTGFFVYGYCLYYYYARSDMSGFMQTSFFFGYMACICYAFFLMLGMVGFRASLFFVRHIYKSIKCE

SEQ ID NO: 9832 - protein, 311 aa, Panax ginseng
MEQKMGLLFMVSFLVMMSSASLVRSSASTHKYKAGDQVPLYVNKVGPFQNPSETYRYFDLPFCMPGSTHLLDKPEALGEVLNGDRLVSAPYQLNFLVEKDSEIVCKKTLTKEEVSKFRSAVAKDYYFQMYYDDLPLWGFLGKAEKDAKADPSEIKYYLFKHLHFEVFYNKDRVIEVNVRTDPSALVDLTEDKEVDADFMYTVKWKETHTPFEKRMDKYSQSSNMPHHLEIHWFSIINSCVTVLLLTGFLATILMRVLKMILLSMLMMKRQLRTKKKLDGSTSMVMFSGTQSTNLCLLQLLVLAPNYLPLQY

SEQ ID NO: 9833 - protein, 595 aa, Panax ginseng
MEQKMGLLFMVSFLVMMSSASLVRSSASTHKYKAGDQVPLYVNKVGPFQNPSETYRYFDLPFCMPGSTHLLDKPEALGEVLNGDRLVSAPYQLNFLVEKDSEIVCKKTLTKEEVSKFRSAVAKDYYFQMYYDDLPLWGFLGKAEKDAKADPSEIKYYLFKHLHFEVFYNKDRVIEVNVRTDPSALVDLTEDKEVDADFMYTVKWKETHTPFEKRMDKYSQSSNMPHHLEIHWFSIINSCVTVLLLTGFLATILMRVLKNDFVKYAHDEETAEDQEETGWKYIHGDVFRYPKYKSVFAAALGSGTQLFAIAILVFMLALVGVFYPYNRGALFTALVIVYALTSGFAGYTAASFYCQLEGTNWVRNLLLTGSLFCGPLFLTFCFLNTVAIAYNATAALPFGTIVVIVLIWALVTSPLLVLGGIAGKNSKAEFQAPVRTTKYPREIPPLPWYRGSLPQMAMAGFLPFSAIYIELYYIFASVWGHRIYTIYSILFIVFIILLIVTAFITVALTYFQLAAEDHEWWWRSFLCGGSTGLFIYGYCLYYYYARSDMNGFMQTSFFFGYMACICYGFFLMLGTVGFRASLFFVRHIYRSIKCE

SEQ ID NO: 9834 - protein, 593 aa, Zea mays
MAASPAAAAALLILFALGAAGGVAADGSDHRYKMYEPVPLYANKVGPFHNPSETYRYFDLPFCSPEKVKEKSEALGEVLNGDRLVDAPYKLDFRSEVESKAVCSKKLTKEDVVKFRNAVAKDYYFQMYYDDLPLWGFIGKVEKGGKADPSEWKYYLYRHIIFDILYNNDRVIEINVHTDQSALVDLTEDKETNVDFLYSVKWKETPTPFEKRMEKYSSSSNMPHHLEVHWFSIINSCVTVLLLTGFLATILMRVLKNDFVKYAHDEEAADDQEESGWKYIHGDVFRFPKNKSLFSAALGTGTQLFALTTFIFLLALVGVFYPYNRGALFTALVVIYALTSGIAGYVATSFYSQLEGTNWVRNLLLTGCLFCGPLLLTFCFLNTVAIAYSATAALPFGTICVIVLIWTLVTFPLLVLGGIAGKNSKSEFQAPCRTTKYPREIPPLPWYRRTIPQMAMAGFLPFSAIYIELYYIFASVWGHRIYTIYSILFIVFIILLIVTAFITVALTYFQLAAEDHEWWWRSFLCGGSTGFFVYGYCLYYYYARSDMSGFMQTSFFFGYMACICYAFFLMLGMVGFRAALFFVRHIYKSIKCE

SEQ ID NO: 9835 - protein, 645 aa, Lolium multiflorum
PIRSPSSSRGLSPSLLRSTSKGATQISPPRLPPLVPRALPPRARQRCRPGRDGIAGGGPAAAALLLLLAFAVAGVLADGSDHRYKSGDPVPLYANKVGPFHNPSETYRYFDLPFCSPEEVKEKKEALGEVLNGDRLVDAPYKLGFRTDYDSKAVCSKRLTKEDVARFRASVAKDYYFQMYYDDLPLWGFIGKVDKGNKLPPSEWKYYLYKHIIFDILYNADRVIEINVHTDQSALVDLTDDTERDVEFLYTVKWKETATPFEKRMEKYSSSSNMPHHLEVHWFSIINSCVTVLLLTGFLATILMRVLKNDFVKYAHDEEAVDDQEESGWKYIHGDVFRFPKNKSLFSAALGTGTQLFALTTFIFLLALVGVFYPYNRGALFTALVVIYALTSGIAGYIATAFYCQLEGTNWVRNLLLTGCLFCGPLFLTFCFLNTVAIAYSATAALPFGTICVIVLIWTLVTFPLLVLGGIAGKNSKSEFQAPCRTTKYPREIPPLPWYRTTVPQMAMAGFLPFSAIYIELYYIFASVWGHRIYTIYSILFIVFIILLIVTAFITVALTYFQLAAEDHEWWWRSFLIGGSTGFFVYGYCLYYYYARSDMSGFMQTSFFFGYMACICYAFFLMLGMIGFRAALFFVRHIYKSIKCE

SEQ ID NO: 9836 - protein, 594 aa, Panax ginseng
MEQKICSLFMVALLVMTSASLVRSSASNHRYKPRDPVPLYVNKVGPFQNPSETYRYFDLPFCMPGSTHLLDKPEALGEVLNGDRLVSAPYQLDFLLDKDSEIVCKKRLTKEEVSKFRSAVAKDYYFQMYYDDLPLWGFLGKAEKDAKADPSENKYYLFKHLHFEVLYNKDRVIEVNVRTDPSALVDLTEDKEVDAVFMYTVKWKETNTPFDKRMDKYSQSSNMPHHLEIHWFSIINSCVTVLLLTGFLATILMRVLKNDFVKYAHDEETAEDQEETGWKYIHGDVFRYPKYKSVFAAALGSGTQLFAIAILVFMLALVGVFYPYNRGALFTALVIIYALTSGFAGYTAASFYCQLEGTNWVRNLLLTGSLFCGPLFLTFCFLNTVAIAYNATAALPFGTIVVIALIWALVTSPLLVLGGIAGKNSKAEFQAPVRTTKYPREIPPLPWYRGTLPQMAMAGFLPFSAIYIELYYIFASVWGHRIYTIYSILFIVFIILLIVTAFITVALTYFQLAAEDHEWWWRSFLCGGSTGLFIYGYCLYYYYARSDMNGFMQTSFFFGYMACICYGFFLMLGTVGFRASLFFVRHIYRSIKCE

SEQ ID NO: 9837 - protein, 593 aa, Panicum virgatum
MAASPAAAAALLALLALAAAGGVAADGSDHRYKAGEPVPLYANKVGPFHNPSETYRYFDLPFCSPEKVKEKSEALGEVLNGDRLVDAPYKLDFRVDIESKPVCSKKLTTEDVVKFRNAVAKDYYFQMYYDDLPLWGFIGKVEKGGKADPSEWKYYLYRHIIFDILYNNDRVIEINVHTDQSALVDLTEDKETNVDFLYSVKWKETPTPFEKRMEKYSSSSNLPHHLEVHWFSIINSCVTVLLLTGFLATILMRVLKNDFVKYAHDEEAADDQEESGWKYIHGDVFRFPKNKSLFSAALGTGTQLFALTTFIFLLALVGVFYPYNRGALFTALVVIYALTSGIAGYIATSFYCQLEGTNWVRNLLLTGCLFCGPLFLTFCFLNTVAIAYSATAALPFGTICVIVLIWTLVTFPLLVLGGIAGKNSKSEFQAPCRTTKYPREIPPLPWYRKTIPQMAMAGFLPFSAIYIELYYIFASVWGHRIYTIYSILFIVFIILLIVTAFITVALTYFQLAAEDHEWWWRSFLCGGSTGFFVYGYCLYYYYARSDMSGFMQTSFFFGYMACICYAFFLMLGMVGFRAALFFVRHIYKSIKCE

SEQ ID NO: 9838 - protein, 594 aa, Panax ginseng
MEQKICSLFMVALLVMTSASLVRSSASNHRYKPRDPVPLYVNKVGPFQNPSETYRYFDLPFCMPGSTHLLDKPEALGEVLNGDRLVSAPYQLDFLLDKDSEIVCKKRLTKEEVSKFRSAVAKDYYFQMYYDDLPLWGFLGKAEKDTKADPSENKYYLFKHLHFEVLYNKDRVIEVNVRTDPSALVDLTEDKEVDAVFMYTVKWKETNTPFDKRMDKYSQSSNMPHHLEIHWFSIINSCVTVLLLTGFLATILMRVLKNDFVKYAHDEETAEDQEETGWKYIHGDVFRYPKYKSVFAAALGSGTQLFAIAILVFMLALVGVFYPYNRGALFTALVIIYALTSGFAGYTAASFYCQLEGTNWVRNLLLTGSLFCGPLFLTFCFLNTVAIAYNATAALPFGTIVVIALIWALVTSPLLVLGGIAGKNSKAEFQAPVRTTKYPREIPPLPWYRGTLSQMAMAGFLPFSAIYIELYYIFASVWGHRIYTIYSILFIVFIILLIVTAFITVALTYFQLAAEDHEWWWRSFLCGGSTGLFIYGYCLYYYYARSDMNGFMQTSFFFGYMACICYGFFLMLGTVGFRASLFFVRHIYRSIKCE

SEQ ID NO: 9839 - protein, 595 aa, Sorghum bicolor
MAASPAPAAAAALLVLLALAAAGGVAADGSDHRYKMNEPVPLYANKVGPFHNPSETYRYFDLPFCSPEKVREKSEALGEVLNGDRLVDAPYKLDFRLEVESKAVCSKKLTVEDVVKFRNAVAKDYYFQMYYDDLPLWGFIGKVEKGGKADPSEWKYYLYRHIIFDILYNNDRVIEINVHTDQSALVDLTEDKETNVEFLYSVKWKETPTPFEKRMEKYSSSSNMPHHLEVHWFSIINSCVTVLLLTGFLATILMRVLKNDFVKYAHDEEAADDQEESGWKYIHGDVFRFPKNKSLFSAALGTGTQLFALTTFIFLLALVGVFYPYNRGALFTALVVIYALTSGIAGYVATSFYCQLEGTNWVRNLLLTGCLFCGPLFLTFCFLNTVAIAYSATAALPFGTICVIVLIWTLVTFPLLVLGGIAGKNSKSEFQAPCRTTKYPREIPPLPWYRRTVPQMAMAGFLPFSAIYIELYYIFASVWGHRIYTIYSILFIVFIILLIVTAFITVALTYFQLAAEDHEWWWRSFLCGGSTGFFVYGYCLYYYYARSDMSGFMQTSFFFGYMACICYAFFLMLGMVGFRAALFFVRHIYKSIKCE

SEQ ID NO: 9840 - protein, 593 aa, Panicum virgatum
MAASPAAAAALLALLALAAAGGVAADGSDHRYKAGEPVPLYANKVGPFHNPSETYRYFDLPFCSPEKVKDKSEALGEVLNGDRLVDAPYKLDFRVDLESKPVCSKKLTTEDVAKFRNAVAKDYYFQMYYDDLPLWGFIGKVEKGGKADPSEWKYYLYRHIIFDILYNNDRVIEINVHTDQSALVDLTEDKETNVEFLYSVKWKETPTPFAKRMEKYSSSSNLPHHLEVHWFSIINSCVTVLLLTGFLATILMRVLKNDFVKYAHDEEAADDQEESGWKYIHGDVFRFPKNKSLFSAALGTGTQLFALTTFIFLLALVGVFYPYNRGALFTALVVIYALTSGIAGYVATSFYCQLEGTNWVRNLLLTGCLFCGPLFLTFCFLNTVAIAYSATAALPFGTICVIVLIWTLVTFPLLVLGGIAGKNSKSEFQAPCRTTKYPREIPPLPWYRKTIPQMAMAGFLPFSAIYIELYYIFASVWGHRIYTIYSILFIVFIILLIVTAFITVALTYFQLAAEDHEWWWRSFLCGGSTGFFVYGYCLYYYYARSDMSGFMQTSFFFGYMACICYAFFLMLGMVGFRAALFFVRHIYKSIKCE

SEQ ID NO: 9841 - protein, 593 aa, Setaria italica
MAASPAAAAALLALLALAAAGGVAADGSDHRYKAGEPVPLYANKVGPFHNPSETYRYFDLPFCSPEKVREKSEALGEVLNGDRLVDAPYKLDFRVDLDSRSVCSKKLTTEDVAKFRNAVAKDYYFQMYYDDLPLWGFIGKVDKEGKADPSEWKYYLYKHIIFDILFNNDRVIEINVHTDQSALVDLTEDKETNVEFLYSVKWKETLTPFEKRMEKYSSSSNLPHHLEVHWFSIINSCVTVLLLTGFLATILMRVLKNDFVKYAHDEEAADDQEESGWKYIHGDVFRFPKNKSLFSAALGTGTQLFALTTFIFLLALVGVFYPYNRGALFTALVVIYALTSGIAGYIATSFYCQLEGTNWVRNLLLTGCLFCGPLFLTFCFLNTVAIAYSATAALPFGTICVIVLIWTLVTFPLLVLGGIAGKNSKTEFQAPCRTTKYPREIPPLPWYRQTIPQMAMAGFLPFSAIYIELYYIFASVWGHRIYTIYSILFIVFIILLIVTAFITVALTYFQLAAEDHEWWWRSFLCGGSTGFFVYGYCLYYYYARSDMSGFMQTSFFFGYMACICYAFFLMLGMVGFRAALFFVRHIYKSIKCE

SEQ ID NO: 9842 - protein, 593 aa, Brachypodium distachyon
MASPAAGAASAVLLLLAFAVAGVLSDGSDHRYKSSEPVPLYANKVGPFHNPSETYRYFDLPFCSPEKVKEKSEALGEVLNGDRLVDAPYKLDFRVDLDSKPVCSKKLTKEDVAKFRNSVAKDYYFQMYYDDLPLWGFIGKLEKTAKADPSEWKYYLYRHIIFDILYNNDRVIEITVHTDQSALVDLTEDKEANVEFLYTVKWKETATPFEKRMEKYSSSSNLPHHLEVHWFSIINSCVTVLLLTGFLATILMRVLKNDFVKYAHDEEAADDQEESGWKYIHGDVFRFPKNKSLFSAALGTGTQLFALTTFIFLLALVGVFYPYNRGALFTALVVIYALTSGIAGYIATSFYCQLEGTNWVRNLLLTGCLFCGPLFLTFCFLNTVAIAYSATAALPFGTICVIVLIWTLVTFPLLVLGGIAGKNSKSEFQAPCRTTKYPREIPPLPWYRTTVPQMAMAGFLPFSAIYIELYYIFASVWGHRIYTIYSILFIVFIILLIVTAFITVALTYFQLAAEDHEWWWRSFLCGGSTGFFVYGYCLYYYYARSDMSGFMQTSFFFGYMACICYAFFLMLGMVGFRAALFFVRHIYKSIKCE

SEQ ID NO: 9843 - protein, 131 aa, Brassica napus
MAAASLSANQGLLGTSFYGGWGSSVCGEDYHTMLAKTTAPRQNFAKLSRKPIRVQPMMKNVNEGKGLFAPLVVVTRNIVGKKRFNQLRGKAIALHSQVITEFCKSIGADAKQRQGLIRLAKKNGERLGFLA

SEQ ID NO: 9844 - protein, 132 aa, Brassica napus
MAAAASLSASQGLLGTSFYGGWGSSICGEDYHTMLAKTTAPRQHFAKLSRKPIRVQPMMKNVNEGKGLFAPLVVVTRNIVGKKRFNQLRGKAIALHSQVITEFCKSIGADAKQRQGLIRLAKKNGERLGFLA

SEQ ID NO: 9845 - protein, 129 aa, Raphanus sativus
MAAAASLSANLGTSFYGGWGSSISGEDYHTMLAKTTAPRQHFAKLSRKPIRVQPMMKNVNEGKGLFAPLVVVTRDIVGKKRFNQLRGKAIALHSQVITEFCKSIGADAKQRQGLIRLAKKNGEKLGFLA

SEQ ID NO: 9846 - protein, 130 aa, Eutrema parvulum
MATASLSANQGLLGTSFYGGWGSSISGEDYHNMLAKTTSPQQQARVSRKPIRVQPMMKNVNEGKGLFAPLVVVTRNVVGKKRFNQLRGKAIALHSQVITEFCKSIGADAKQRQGLIRLAKKNGERLGFLA

SEQ ID NO: 9847 - protein, 131 aa, Unknown
  Sequence found in Organisms: Brassica napus, Brassica oleracea
MAAAASLSAHQGLLGTSFYGAWGNSISGDDYHTMLAKTTAPRQQAKVSRKLIRVQPMMKNVNEGKGLFAPLVVVTRDIVGKKRFNQLRGKAIALHSQVITEFCKSIGADAKQRQGLIRLAKKNGERLGFLA

SEQ ID NO: 9848 - protein, 130 aa, Eutrema halophilum
MATASLSANQGLLGTSFCGGWGNSISGDDYHNMLAKTSAPPQQARVSRKPIRVQPMMKNVNEGKGLFAPLVVVTRNVVGKKRFNQLRGKAIALHSQVITEFCKSIGADAKQRQGLIRLAKKNGERLGFLA

SEQ ID NO: 9849 - protein, 128 aa, Raphanus sativus
MAATASLSANQGLLGTSFYGGWGNSISGDDYQIKTTAPPKQARVSRKPIRVQPMMKNVNEGKGLFAPLVVVTRNIVGKKRFNQLRGKAIALHSQVITEFCKSIGADAKQRQGLIRLAKKNGERLGFLA

SEQ ID NO: 9850 - protein, 133 aa, Arabidopsis lyrata
MAAASISATGCNQTLLRTSFYGGWGSSISGEDYQTMLSKTVAPPQQARVSRKAIRAVPMMKNVNEGKGLFAPLVVVTRNIVGKKRFNQLRGKAIALHSQVITEFCKSIGADAKQRQGLIRLAKKNGERLGFLA

SEQ ID NO: 9851 - protein, 133 aa, Arabidopsis thaliana
MAAASISAIGCNQTLLGTSFYGGWGSSISGEDYQTMLSKTVAPPQQARVSRKAIRAVPMMKNVNEGKGLFAPLVVVTRNLVGKKRFNQLRGKAIALHSQVITEFCKSIGADAKQRQGLIRLAKKNGERLGFLA

SEQ ID NO: 9852 - protein, 133 aa, Arabidopsis thaliana
MAAASISAIGCNQTLIGTSFYGGWGSSISGEDYQTMLSKTVAPPQQARVSRKAIRAVPMMKNVNEGKGLFAPLVVVTRNLVGKKRFNQLRGKAIALHSQVITEFCKSIGADAKQRQGLIRLAKKNGERLGFLA

SEQ ID NO: 9853 - protein, 277 aa, Brassica rapa
MHALKDKVSQKLSNLFADSPSQSASPRHSLTDSPKASGKSFTSYFSFGARNENEDTESESPPPPPPPIRTDSYESVENCKKNQASSTTVGNDDYEGEMKELTESSAFISPDLCEFLHACLPNIVRGCKWVLVYSTLKHGISLRTLLRKSAELPGPCLLVAGDKQGAVFGAMLECPLTTTPKRKYQGTSQTFLFTTIYGQPRIFRPTGANRYYYMCMNEFLAFGGGGSFALCLDEDLLKATSGPSETFGNECLASSAEFELKNVELWGFAHASQYLSS

SEQ ID NO: 9854 - protein, 113 aa, Brassica oleracea
  misc_feature (6)..(7): Xaa can be any naturally occurring amino acid
ERPGKXXCGEDYHTMLAKTTAPRQHFAKLSRKPIRVQPMMKNVNEGKGLFAPLVVVTRNIVGKKRFNQLRGKAIALHSQVITEFCKSIGADAKQRQGLIRLAKKNGERLGFLA

SEQ ID NO: 9855 - protein, 913 aa, Arabidopsis lyrata
MERPRAPPSPLNDTEPLTERRSLEIFNPQSGKETHGSTSSSLKPPLDGKSKGSSSKWMEFQDSAKMTERTAEWGISAIKPDSGEDGISFKVSSEAERSKNMSRRSSEESTSSESGAFPRVSQELKTALSTLQQTFVVSDATQPHCPIVYASSGFFTMTGYSSKEIVGRNCRFLQGPDTDKNEVAKIRDCVKNGKSYCGRLLNYKKDGTPFWNLLTVTPIKDDQGNTIKFIGMQVEVSKYTEGVNDKVLRPNGLSKSLIRYDARQKEKALDSITEVVQTIRHRKSQVQESVSNSNMVTPDSSTTPGRQNRQSDEASKSFRTPGRVSTPTGTKLKSSSNKHEDLLRMEPEELMLSTEVIGQRDSWDLSDRERDIRQGIDLATTLERIEKNFVISDPRLPDNPIIFASDSFLELTEYTREEILGRNCRFLQGPETDQATVQKIRDAIRDQTEITVQLINYTKSGKKFWNLFHLQPMRDQKGELQYFIGVQLDGSDHVEPLQNRLSERTEIQSSKLVKATATNVDEAVRELPDANTRPEDLWAAHSKPVYPLPHNKESTSWKAIKKIQAGGETVGLHHFKPIKPLGSGDTGSVHLVELKGTGELYAMKAMEKAMMLNRNKAHRACIEREIISLLDHPFLPTLYASFQTSTHVCLITDFCPGGELFALLDRQPMKILTEDSARFYAAEVVIGLEYLHCLGIVYRDLKPENILLKKDGHIVLADFDLSFMTTCTPQLIIPAAPSKRRRSKSQPLPTFVAEPSTQSNSFVGTEEYIAPEIITGAGHTSAIDWWALGILLYEMLYGRTPFRGKNRQKTFANILHKDLTFPSSIPVSLVCRQLINTLLNRDPSSRLGSKGGANEIKQHAFFRGINWPLIRGMSPPPLDAPLNIIEKDPNAKDIKWEDDGVLVNSTDLDIDLF

SEQ ID NO: 9856 - protein, 916 aa, Eutrema halophilum
MERPRAPPSPLTDLEPLSERRSLEVFNPLSGKEVNGSSSSSSSSSKPHDGNGKGKSSKWMEFQDSAKLVERTAEWGLSAVKPDSGEDGISFKVSSEVERSKMSRRSSEESTSSDSGAFPRVSQELKTALSTLQQTFVVSDATQPHCPIVYASSGFFTMTGYSSKEIVGRNCRFLQGPDTDKKEVAKIRDCVKNGKSYCGRLLNYKKDGTPFWNLLTVTPIKDDQGNTIKFIGMQVEVSKYTEGVNDKALRPNGLSKSLIRYDARQKEKALDSITEVVQTIKHRKSQVRDSVSNDVMVRLDSATTPGKQVIKSDEASKSARTPTRVSTPTRSKSKSLSSNKKHEDVPSVEPEALVLSTEVIEPRDSFDRSERERDIRQGIDLATTLERIEKNFVISDPRLPDNPIIFASDSFLELTEYTREEILGRNCRFLQGPETDQATVQKIRDAIRDQREITVQLINYTKSGKKFWNLFHLQPMRDQKGELQYFIGVQLDGSDHVEPLQNRLSERTELQSSKLVKATATNVDEAVRELPDANTRPEDLWAAHSKPVYPLPHNKESTSWKAIQKIQASGETVGLHHFKPIKPLGSGDTGSVHLVELKGTGELYAMKAMEKTMMLNRNKAHRACIEREIISLLDHPFLPTLYTSFQTATHVCLITDFCPGGELFALLDKQPMKFLSEESARFYAAEVVIGLEYLHCLGIVYRDLKPENILLKKDGHIVLADFDLSFMTSCTPQLINPPAPNKRRKSKSQPLPTFVAEPITQSNSFVGTEEYIAPEIITGAGHTSAIDWWALGILLYEMLYGRTPFRGKNRQKTFANILHKDLTFPSSIPVSLVCRQLINMLLNRDPSCRLGSKGGANEIKQHAFFRGINWPLIRCMSPPPLDAPLRIIEKDPNAKDIKWEDDGVLVNSMDIDIDLF

SEQ ID NO: 9857 - protein, 915 aa, Eutrema parvulum
MERPRAPQSPLTDLESLSVRRSLEVFNPLSGKELNGSSSSSSSSKPQDGDGKGSSSKWVEFQDSAKLAERTAEWGLSAVKPDSGEDGISFKLSGEVERSKMSRRSSEESTSSESGAFPRVSQELKTALSTLQQTFVVSDATQPHCPIVYASSGFFTMTGYSSKEIVGKNCRFLQGPDTDQKEVAKIRDCVKNGKSYCGRLLNYKKDGTPFWNLLTITPIKDDQGNTIKFIGMQVEVSKYTEGVNDKELRPNGLSKSLIRYDARQKEKALDSITEVVQTIRHRKSQVRESVSNDIMVRPDSATTPNRQAIQSDEGSKSARTPGRVSTPASSKSKSLSSNKRHEHGSSVEPEALLLSTEVIEPRDSWDSTERERDIRQGIDLATTLERIEKNFVISDPRLPDNPIIFASDSFLELTEYTREEILGRNCRFLQGPETDQATVQKIRDAIRDQREITVQLINYTKSGKKFWNLFHLQPMRDQKGELQYFIGVQLDGSDHVEPLQNRLSEKTEMQSSKVVKATATNVDEAVRELPDANMRPEDLWAAHSKPVYPLPHKKESTSWKAIHKIQASGETVGLHHFKPIKPLGSGDTGSVHLVELKGTGELYAMKAMEKAMMLNRNKAHRACIEREIISLLDHPFLPTLYASFQTSTHVCLITDFYPGGELFALLDRQPMKFLSEESARFYAAEVVIGLEYLHCLGIVYRDLKPENILLKKDGHIVLADFDLSFMTSCTPQLIIPPAPNKRRRSKSQPLPTFVAEPTAQSNSFVGTEEYIAPEIITGAGHTSAIDWWALGILLYEMLYGRTPFRGKNRQKTFANILHKDLTFPSSIPVSLVCRQLINALLHRDPSSRLGSKGGANEIKQHAFFRGINWPLIRCMDPPPLDAPLRIIEKDPNAKEIKWEDDGVLVNSMDMDIDLF

SEQ ID NO: 9858 - protein, 909 aa, Brassica rapa
MERPRAPPSIFTELEPLSERKSLEVFNPSSGKEVNGSASASSSSSKPHDENGKGSSSKWMEFQDTAKLAERTAEWGLSAVKPDSGEDGISFKVSSEVDRSKTSRRSSEESSSSESGAFPRVSQELKTALSTLQQTFVVSDATQPHCPIVYASSGFFTMTGYSSKEIVGRNCRFLQGPDTDQKEVAKIRDAVKNGKSYCGRLLNYKKDGTPFWNLLTITPIKDDQGNTIKFIGMQVEVSKYTEGVNDKALRPNGLSKSLIRYDARQKEKALDSITEVVQTVRHRKSQVRDSVSNDVMVTPGSTTTTTPVRQAIQPDEASKSARTPGRVSTPAKSKSKSLDVPSVEPEELMLSTEVIEPRDSWDRLERERDIRQGIDLATTLERIEKNFVISDPRLPDTPIIFASDSFLELTEYTREEILGRNCRFLQGPETDQATVQKIRDAIREQREITVQLINYTKSGKKFWNLFHLQPMRDQKGELQYFIGVQLDGSDHVEPLRNRLSERTEMQSSKLVKATATNVDEAVRELPDANMRPEDLWAAHSKPVYPLPHKKESTSWKAIQKIQASGETVGLHHFKPIKPLGSGDTGSVHLVELKGTGELYAMKAMEKTMMLNRNKVHRACIEREIISLLDHPFLPTLYASFQTSTHVCLITDFCPGGELFALLDRQPMKFLSEDSARFYAAEVVIGLEYLHCLGIVYRDLKPENILLMKDGHIVLADFDLSFMTACTPQLIIPPAPSKRRRSKSQPLPTFVAEPNAQSNSFVGTEEYIAPEIITGSGHTSAIDWWALGILLYEMLYGRTPFRGKNRQKTFANILHKDLTFPSSIPVSLVGRQLINMLLNRDPSSRLGSKGGANEIKQHAFFRGINWPLIRGMSPPPLEAPLRIIEKDPKAKDINWEDDGVLVNSIDIDLF

SEQ ID NO: 9859 - protein, 908 aa, Brassica napus
MEMPRAPPSIFTDLEPLSERKSLEVFNPSSGKEVNGSASASSSSKPHDENGKGSSSKWMEFQDTAKLAERTAEWGLSAVKPDSGEDGISFKVSSEVDRSKTSRRSSEESSSSESGAFPRVSQELKTALSTLQQTFVVSDATQPHCPIVYASSGFFTMTGYSSKEIVGRNCRFLQGPDTDQKEVAKIRDAVKNGKSYCGRLLNYKKDGTPFWNLLTITPIKDDQGNTIKFIGMQVEVSKYTEGVNDKALRPNGLSKSLIRYDARQKEKALDSITEVVQTVRHRKSQVRDSVSNDVMVTPGSTTTTTPVRQAIQPDEASKSARTPGRVSTPAKSKSKSLDAPSVEPEELMLSTEVIEPRDSWDRLERERDIRQGIDLATTLERIEKNFVISDPRLPDTPIIFASDSFLELTEYTREEILGRNCRFLQGPETDQATVQKIRDAIREQREITVQLINYTKSGKKFWNLFHLQPMRDQKGELQYFIGVQLDGSDHVEPLRNRLSERTEMQSSKLVKATATNVDEAVRELPDANMRPEDLWAAHSKPVYPLPHKKESTSWKAIQKIQASGETVGLHHFKPIKPLGSGDTGSVHLVELKGTGELYAMKAMEKTMMLNRNKVHRACIEREIISLLDHPFLPTLYASFQTSTHVCLITDFCPGGELFALLDRQPMKFLSEDSARFYAAEVVIGLEYLHCLGIVYRDLKPENILLMKDGHIVLADFDLSFMTACTPQLIIPPAPSKRRRSKSQPLPTFVAEPNAQSNSFVGTEEYIAPEIITGSGHTSAIDWWALGILLYEMLYGRTPFRGKNRQKTFANILHKDLTFPSSIPVSLVGRQLINMLLNRDPSSRLGSKGGTNEIKQHAFFRGINWPLIRGMSPPPLEAPLRIIEKDPKAKDINWEDDGVLVNSIDIDLF

SEQ ID NO: 9860 - protein, 909 aa, Brassica napus
MERPRAPPSIFTELEPLSERKSLEVFNPSSGKEVNGSASASSSSSKPHDENGKGSSSKWMEFQDTAKLAERTAEWGLSAVKPDSGEDGISFKVSSEVDRSKTSRRSSEESSSSESGAFPRVSQELKTALSTLQQTFVVSDATQPHCPIVYASSGFFTMTGYSSKEIVGRNCRFLQGPDTDQKEVAKIRDAVKNGKRYCGRLLNYKKDGTPFWNLLTITPIKDDQGNTIKFIGMQVEVSKYTEGVNDKALRPNGLSKSLIRYDARQKEKALDSITEVVQTVRHRKSQVRDSVSNDVMVTPGSTTTTTPVRQAIQPDEASKSARTPGRVSTPAKSKSKSLDVPSVEPEELMLSTEVIEPRDSWDRLERERDIRQGIDLATTLERIEKNFVISDPRLPDTPIIFASDSFLELTEYTREEILGRNCRFLQGPETDQATVQKIRDAIREQREITVQLINYTKSGKKFWNLFHLQPMRDQKGELQYFIGVQLDGSDHVEPLRNRLSERTEMQSSKLVKATATNVDEAVRELPDANMRPEDLWAAHSKPVYPLPHKKESTSWKAIQKIQASGETVGLHHFKPIKPLGSGDTGSVHLVELKGTGELYAMKAMEKTMMLNRNKVHRACIEREIISLLDHPFLPTLYASFQTSTHVCLITDFCPGGELFALLDRQPMKFLSEDSARFYAAEVVIGLEYLHCLGIVYRDLKPENILLMKDGHIVLADFDLSFMTACTPQLIIPPAPSKRRRSKSQPLPTFVAEPNAQSNSFVGTEEYIAPEIITGSGHTSAIDWWALGILLYEMLYGRTPFRGKNRQKTFANILHKDLTFPSSIPVSLVGRQLINMLLNRDPSSRLGSKGGANEIKQHAFFRGINWPLIRGMSPPPLEAPLRIIEKDPKAKDINWEDDGVLVNSIDIDLF

SEQ ID NO: 9861 - protein, 918 aa, Eutrema parvulum
MERPRAPQSPLTDLESLSVRRSLEVFNPLSGKELNGSSSSSSSSKPQDGDGKGSSSKWVEFQDSAKLAERTAEWGLSAVKPDSGEDGISFKLSGEVERSKMSRRSSEESTSSESGAFPRVSQELKTALSTLQQTFVVSDATQPHCPIVYASSGFFTMTGYSSKEIVGKNCRFLQGPDTDQKEVAKIRDCVKNGKSYCGRLLNYKKDGTPFWNLLTITPIKDDQGNTIKFIGMQVEVSKYTEGVNDKELRPNGLSKSLIRYDARQKEKALDSITEVVQTIKHRKSQVRDSVSNDVMVRLDSATTPGKQVIKSDEASKSARTPTRVSTPTRSKSKSLSSNKKHEDVPSVEPEALVLSTEVIEPRDSFDRSERERDIRQGIDLATTLERIEKNFVISDPRLPDNPIIFASDSFLELTEYTREEILGRNCRFLQGPETDQATVQKIRDAIRDQREITVQLINYTKSGKKFWNLFHLQPMRDQKGELQYFIGVQLDGSDHVEPLQNRLSEKTEMQSSKVVKATATNVDEAVRELPDANMRPEDLWAAHSKPVYPLPHNKESTSWKAIQKACIKPHYGETVGLHHFKPIKPLGSGDTGSVHLVELKGTGELYAMKAMEKTMMLNRNKAHRACIEREIISLLDHPFLPTLYTSFQTATHVCLITDFCPGGELFALLDKQPMKFLSEESARFYAAEVVIGLEYLHCLGIVYRDLKPENILLKKDGHIVLADFDLSFMTSCTPQLINPPAPNKRRKSKSQPLPTFVAEPITQSNSFVGTEEYIAPEIITGAGHTSAIDWWALGILLYEMLYGRTPFRGKNRQKTFANILHKDLTFPSSIPVSLVCRQLINMLLNRDPSCRLGSKGGANEIKQHAFFRGINWPLIRCMSPPPLDAPLRIIEKDPNAKDIKWEDDGVLVNSMDIDIDLF

SEQ ID NO: 9862 - protein, 911 aa, Brassica napus
MERPRASPSPLADLEPLSERTSLEIFNPSSGKEASSSSSSKPQDGNRKGSSSKWMEFHDSAKIVERTAEWGLSSVKPDTGEDGISFKVSSEVERSKMSRRSSEESSASESGAFPRVSQELKTALSTLQQTFVVSDATQPDCPIVYASSGFFTMTGYSSKEIVGRNCRFLQGPDTDKKEVVKIRDCVKNGKSYCGRLLNYKKDGTPFWNLLTVTPIKDDQGNTIKFIGMQVEVSKYTEGVNDKELRPNGLSKSLIRYDARQKELALDSITEVVQTIKHRKSQVRNSVSNDILVKPDSTTTPGGQVVRSDEASKSARTPGRVATPARPKSKSLSWNKKHEDVPSVEPEELMLSTEVVEPRESWERLERERDIRQGIDLATTLERIEKNFVISDPRLPDNPIIFASDSFLELTEYTREEILGRNCRFLQGPETDQATVQKIRDAIRDQREITVQLINYTKSGKKFWNLFHLQPMRDQKGELQYFIGVQLDGSDHVEPLRNRLSERTEMQSSKLVKATATNVDEAVRELPDANMRPEDLWAAYSKPVYPLPHKKESTSWKAIQKIQASGETIGLHHFKPIKPLGSGDTGSVHLVELKGTGELYAMKAMEKTMMLNRNKAHRACIEREIISLLDHPFLPTLYTSFQTSTHVCLITDFCPGGELFALLDIQPMKFLSEESARFYAAEVVIGLEYLHCLGIVYRDLKPENILLKKDGHIVLADFDLSFLTSCTPQLIVPPAPNKRRRSKSQPLPTFVAEPATQSNSFVGTEEYIAPEIISGSGHTSAIDWWALGILLYEMLYGRTPFRGKNRQKTFANILHKDLTFPSSIPVSLVCRQLINMLLNRDPSSRLGSKGGANEIKQHAFFCGINWPLIRGTEPPPLDAPLRITEKDPNAKDIKWEDDGVLVNSMDIDIDLF

SEQ ID NO: 9863 - protein, 912 aa, Brassica rapa
MERPRAPPSPSTDLEPLSERRSLEVFNPSSGSSSSSKPYDGNSKISSSSKWMEFQDSAKITERTAEWGLSAVKPEPGENGISFKLSTEVERSKMSRRSSEESTSSESGAFPRVSQELKTALSTLQQTFVVSDATQPHCPIVYASSGFFTMTGYTSKEIVGRNCLFLQGPETDQKEVAKIRDCVKNGKSYCGRILNYKKDGTPFWNLLTITPIKDDQGNTIKFIGMQVEVSKYTEGVNDKALRPNGLSKSLIRYDARQKEKALDSMTEVVQTIKHRKSQVRDSVSNDVMVKPGSATTTPGRQAIQSDEASKSAKTPERVSTPARSRSKSLSSNKRHEDVPSVEPEELMLSTEVIEPRDSWDRSEREKDIRQGIDLATTLERIEKNFVISDPRLPDNPIIFASDSFLELTEYTREEILGRNCRFLQGPETDQSTVQKIRDAIRDQREITVQLINYTKSGKKFWNLFHLQPMRDQKGELQYFIGVQLDGSDHVEPIRNRLSEGTEMQSSKLVKATATNVNEAVRELPDANMTPEDLWAAHSKPVYPMPHKKESASWKAIQKIQAGGETVGLHHFKPVKPLGSGDTGSVHLVELKGTGELYAMKAMEKTMMLNRNKAHRARIEREIISLLDHPFLPTLYASFQTSTHVCLITDFCPGGELFALLDRQPMKFLSEDSARFYAAEVVIGLEYLHCLGIVYRDLKPENILLKKDGHIVLADFDLSFMTSCTPQLIVPPAPNKRRRSSSSKSRPLPTFVAEPITKSNSFVGTEEYIAPEIITGAGHTSAIDWWALGILLYEMLYGRTPFRGKNRQKTFANILHKDLTFPSSIPVSLVGRQLINMLLNRDPRKRLGTKGGANEIKQHAFFRGINWPLIRDMDSPPLDVPLRIIEKDPKAKDIKWEDDGVLVNSMDIDIDLF

SEQ ID NO: 9864 - protein, 894 aa, Brassica napus
MERPRASPSPLTDLEPLSERTSLEIFNPLSGKEASSSSSSSKPQDGNRKGSSSKWIEFHDSAKIVERTAEWGLSAVKPDTGEDGISFKVSSEVDRSKMSRRSSEESSASESGAFPRVSQELKTALSTLQQTFVVSDATQPDCPIVYASSGFFTMTGYSSKEIVGRNCRFLQGPDTDKKEVVKIRDCVKNGKSYCGRLLNYKKDGTPFWNLLTVTPIKDDQGNTIKFIGMQVEVSKYTEGVNDKELRPNGLSKSLIRYDARQKELALDSITEVVQTIKHRKSQVRNSVSNDILVKPDSTTTPGGQVVRSDEASKSARTPGCVSTPARPKSKSLSWNKKHEDVPSVEPEELMLSTEVVEPRESWECLESERDIRQGIDLATTLERIEKNFVISDPRLPDNPIIFASDSFLELTEYTREEILGRNCRFLQGPETDQATVQKIRDAIRDQREITVQLINYTKSGKKFWNLFHLQPMRDQKGELQYFIGVQLDGSDHVEPLRNRLSERTEMQSSKLVKATATNVDEAVRELPDANMRPEDLWAAYSKPVYPLPHKKESTSWKAIQKIQASGETIGLHHFKPIKPLGSGDTGSVHLVELKGTGELYAMKAMEKTMMLNRNKAHRACIEREIISLLDHPFLPTLYTSFQTSTHVCLITDFCPGGELFALLDIQPMKFLSEESARFYAAEVVIGLEYLHCLGIVYRDLKPENILLKKDGHIVLADFDLSFLTSCAPQLIVPPAPNKRRRSKSQQLPTFVAEPATQSNSFVGTEEYIAPEIITGSGHASAIDWWALGILLYEMLYGRTPFRGKNRQKTFANILHKDLTFPSSIPVSLVCRQLINMLLNRDPSSRLGSKGGANEIKQHAFFCGINWPLIRGTEPPPLDAPLRITEKDPNDKRYK

SEQ ID NO: 9865 - protein, 881 aa, Brassica rapa
MERPRASPSPLADLEPLSERTSLEIFNPSSGKEASSSSSSKPQDGNRKGSSSKWMEFHDSAKIVERTAEWGLSSVKPDTGEDGISFKVSSEVERSKMSRRSSEESSASESGAFPRVSQELKTALSTLQQTFVVSDATQPDCPIVYASSGFFTMTGYSSKEIVGRNCRFLQGPDTDKKEVVKIRDCVKNGKSYCGRLLNYKKDGTPFWNLLTVTPIKDDQGNTIKFIGMQVEVSKYTEGVNDKELRPNGLSKSLIRYDVRQKELALDSITEVVQTIKHRKSQVRNSVSNDILVKPDSTTTPGGQVVRSDEASKSARTPGRVATPARPKSKSLSWNKRHEDVPSVEPEELMLSTEVVEPRESWERLERERDIRQGIDLATTLERIEKNFVISDPRLPDNPIIFASDSFLELTEYTREEILGRNCRFLQGPETDQATVQKIRDAIREQREITVQLINYTKSGKKFWNLFHLQPMRDQKGELQYFIGVQLDGSDHVEPLRNRLSERTEMQSSKLVKATATNVDEAVRELPDANMIQASGETIGLHHFKPIKPLGSGDTGSVHLVELKGTGELYAMKAMEKTMMLNRNKAHRACIEREIISLLDHPFLPTLYTSFQTSTHVCLITDFCPGGELFALLDIQPMKFLSEESARFYAAEVVIGLEYLHCLGIVYRDLKPENILLKKDGHIVLADFDLSFLTSCTPQLIVPPAPNKRRRSKSQPLPTFVAEPATQSNSFVGTEEYIAPEIITGSGHTSAIDWWALGILLYEMLYGRTPFRGKNRQKTFANILHKDLTFPSSIPVSLVCRQLINMLLNRDPSSRLGSKGGANEIKQHAFFCGINWPLIRGTEPPPLDAPLRITEKDPNAKDIKWEDDGVLVNSMDIDIDLF

SEQ ID NO: 9866 - protein, 259 aa, Gossypium raimondii
MLLRPVSSLCVQAKQGDNLICSLKGSPVTSSSSSALSFLPRKHGRALGVYASIGTNNHALTGVVFQPFEEVKKEELDIPIAPHLSLARQKYADACEAAINEQINVEYNVSYVYHSLYAYFDRDNVALKGFAKFFKESSEEEREHAEKLMEYQNKRGGRVKLHSILMPPSEFDHAEKGDALYGMELALSLEKLTNEKLLCLHNVAVQNNDAQMADFIESEYLAEQVEAIKKISEYVSQLRRVGKGHGVWHFDQMLLDEGA

SEQ ID NO: 9867 - protein, 269 aa, Theobroma cacao
MFLRSVSSISVQTKHGDNLISSLRGSPALSSSSFGSAFPSSSALGFPQRKPGRAFGVSASLETNDFALTGVVFQPFEEVKKKELDIPVAPQVSLARQKYTDECEAAINEQINVEYNVSYVYHSLYAYFDRDNIALKGLAKFFKESSEEEREHAEKLMEYQNIRGGRVKLHSILMPPSEFEHAEKGDALYAMELALSLEKLTNEKLLSLHNVAERNHDAQMSEFIEREFLSEQVEAIKKISEYVAQLRMVGKGHGVWHFDQMLLHEGDAA

SEQ ID NO: 9868 - protein, 742 aa, Eutrema parvulum
MDDHETPLLSKVSSSSSSSSTSVVASSLKWVLKVVMSVIFVSWVVFLFMYPGTFGDEILKNWRTVSSNTLFGTTGSMFLIFSGPILVISVLASLYLIISGEETVFTKKKISKFPRFRLWTFPVLVDGPFGVVSAAEFLGIMIFSVFFLWAIYAYTMRDLDLLDLFHVLPKDRSMLLLEITGLRFGMIGLLCMVFLFLPISRGSILLRLIDIPFEHATKYHVWLGHITMAFFSFHGLCYVVAWTIQGRLLELLFEWKAIGIAVLPGVISLVAGLLMWVTSLQYVRKYYFELFFYTHQLYIVFVVFLALHVGDYLFSIVAGGIFLFILDRFLRFCQSRRTVDIISAKSLPCGTIELVLSKPPNMRYNALSFVFLQVRELSWLQWHPFSVSSSPLDGKHHVAVLIKVLGGWTAKLRDQLSNLYEAENQDQLLSPQSYPKITTCVEGPYGHESPYHLGYENLVLVAGGIGISPFFAILSDILHRKRDGKACLPKKVLVIWAIKNSDELSLLSTIDIPSICPSFSHKLNLEINIYVTRQSEPLLEDGMVHKIVTPSVKPRTNGCPMSVLVGTGDNIWSGLYLVASTIGFISMITLLDIFYINKFNITAWWYKGLLFVVCMVASVLIFGGLVVVFWHLWGTKTGEVEANGHDKVNLNGEESHNPSSELKGLDVEEDIQSFITTRYGTRPEFKEIFESLNGKWGSVDVGVIVCGPSSLQSTVAKEIRSHSIWRSANHPLFHFNSHSFDL

SEQ ID NO: 9869 - protein, 747 aa, Eutrema halophilum
MDEHETPLLPKPSSSSSSSSSSSSSSSMVASSLKWILKVVMSVIFVAWVVFLLMYPGKLGDGFLTKWREVSSKTLFGTAGSMFLIFSGPILVISVLASLYLIIAGEEKVFTKKKISKFPRFRLWTFPVLVDGPFGVVSAAEFLGIMIFSIFFLWAIYAYTLRNLNLLDLFHVLPKDRSTLLLEITGLRFGMIGLLCMVFLFLPISRGSILLRLIDIPFEHATKYHVWLGHITMAFFSLHGLCYVVGWMMRGQLLEMIFEWKAIGIAVFPGVISLVAGLLMWVTSLHYVRKYYFELFFYTHQLYIVFVVFLALHVGDFIFSIVAGGIFLFILDRFLRFCQSRRTVDVISAKSLPCGTLELVLSKPPNMRYNALSFVFLQVRELSWLQWHPFSVSSSPLDGNHHVAVLIKVLGCWTAKLRDRLSKLYEAENQDQLLSPQSYPKITTCVEGPYGHESPYHLTYENLVLVAGGIGISPFFAILSDILHRKRDGKACLPKKVLVIWAIKNSDELSLLSAIDIPSICPSFSHKLKLEINIYVTRQSEPLLEDGLVHKIVNPSVKPRTNGCPMSVLVGTGDNIWSGLYLIASTIGFISMITLLDIFYINKYNITTWWYKGLLFVVCMVASVLIFGGSVVVFWHLWGHKTSEVEASGHKKVGSNQEEPQNASAELKSLDTEDDIQSFITTRYGTRPDFKETFESLNVKWGNVDVGVIVCGPASLQSTVAKEIRSHSIWRSANHPLFHFNSHSFDL

SEQ ID NO: 9870 - protein, 747 aa, Arabidopsis thaliana
MDDHETPLLSKDLSSSSSSSSSSSSVVVSSLKWILKVVMSVIFVTWVVFLMMYPGSLGDQILTNWRAISSNTLFGLTGSMFLIFSGPILVIAILASLYLIISGEETVFTKKKITKFPRFRLWTFPVLVDGPFGVVSAAEFLGIMVFSVFFLWAIYAYTLRNLNVLDYFHVLPNNRSIFLLELTGLRFGMIGLLCMVFLFLPISRGSILLRLIDIPFEHATRYHVWLGHITMTFFSLHGLCYVVGWTIQGQLLELLFEWKATGIAVLPGVISLVAGLLMWVTSLHTVRKNYFELFFYTHQLYIVFVVFLALHVGDYLFSIVAGGIFLFILDRFLRFYQSRRTVDVISAKSLPCGTLELVLSKPPNMRYNALSFIFLQVKELSWLQWHPFSVSSSPLDGNHHVAVLIKVLGGWTAKLRDQLSTLYEAENQDQLISPESYPKITTCVEGPYGHESPYHLAYENLVLVAGGIGITPFFAILSDILHRKRDGKDCLPGKVLVVWAIKNSDELSLLSAIDIPSICHFFSKKLNLEIHIYVTRQSEPCLEDGMVHKVVHPSVKTPWTNGCSMSVLVGTGDNIWSGLYLIISTIGFIAMITLVDIFYINKYNITTWWYKGLLFVVCMVASVLIFGGLVVVFWHRWEHKTGEVEANGNDKVDLNGEETHNPSAAELKGLAIEEDVQNYTTIRYGTRPAFREIFESLNGKWGSVDVGVIVCGPATLQTTVAKEIRSHSIWRSANHPLFHFNSHSFDL

SEQ ID NO: 9871 - protein, 548 aa, Brassica juncea
MELTLNSSSSLIKRKDAKSSRTQENSSNMSFAKTKPPTYQFQAKSSVKEMKFTHEKTYKPESETTERWEKLHVLSYPHPKSDSSVPVFVMLPLDTVTMSGHLNKPRAMNASLMALKGAGVEGVMVDAWWGLVEKDGPMKYNWEGYAELIQMVQKHGLKLQVVMSFHQCGGNVGDSCSIPLPPWVLEEISKNPDLVYTDKSGRRNPEYISLGCDSVPVLRGRTPIQVYSDFMRSFRERFDNYIGGVIAEIQVGMGPCGELRYPSYPESNGTWRFPGIGEFQCYDKYMKSSLQAYAESIGKTNWGTSGPHDAGEYKNLPEDTEFFRRDGTWNSEYGKFFMEWYSGKLLEHGDQLLSSAKAIFQGSGAKLSGKVAGIHWHYNTRSHAAELTAGYYNTRNHDGYLPIAKMFNKHGVVLNFTCMEMKDGEQPEHANCSPEGLVKQVQNATRQAGTELAGENALERYDSSAFGQVVATNRSDSGNGLTAFTYLRMNKRLFEGQNWQQLVEFVKNMKEGGHGRRLSEEDTTGSDLYVGGFVGSKISQTVEEAVLV

SEQ ID NO: 9872 - protein, 548 aa, Brassica rapa
MELTLNSSSSLIKRKDAKSSRTQENSSNMSFAKTKPPTYQFQAKSSVKEMKFTHEKTYKPESETTERWEKLHVLSYPHPKNDSSVPVFVMLPLDTVTMSGHLNKQRAMNASLMALKGAGVEGVMVDAWWGLVEKDGPMKYNWEGYAELIQMVQKHGLKLQVVMSFHQCGGNVGDSCSIPLPPWVLEEISKNPDLVYTDKSGRRNPEYISLGCDSVPVLRGRTPIQVYSDFMRSFRERFDNYIGGVIAEIQVGMGPCGELRYPSYPESNGTWRFPGIGEFQCYDKYMKSSLQAYAESIGKTNWGTSGPHDAGEYKNLPEDTEFFRRDGTWNSEYGKFFMEWYSGKLLEHGDQLLSSAKAIFQGSGAKLSGKVAGIHWHYNTRSHAAELTAGYYNTRNHDGYLPIAKMFNKHGVVLNFTCMEMKDGEQPEHANCSPEGLVKQVQNATRQAGTELAGENALERYDSSAFGQVVATNRSDSGNGLTAFTYLRMNKRLFEGQNWQQLVEFVKNMKEGGHGRRLSEEDTTGSDLYVGGFVGSKISQTVEEAVLV

SEQ ID NO: 9873 - protein, 547 aa, Brassica oleracea
MELTLNSSSSLIKRKDAKSSRIQENSSNMSFAKTKPPTYQFQAKSSVKEMKFTHEKTYKPESETTERWEKLHVLSYPHPKNDSSVPVFVMLPLDTVTMSGHLNKPRAMNASLMALKGAGVEGVMVDAWWGLVEKDGPMKYNWEGYAELIQMVQKHGLKLQVVMSFHQCGGNVGDSCSIPLPPWVLEEISKNPDLVYTDKSGRRNPEYISLGCDSVPVLRGRTPIQVYSDFMRSFRERFDNYIGGVIAEIQVGMGPCGELRYPSYPESNGTWRFPGIGEFQCYDKYMKSSLQAYAELIGKTNWGTSGPHDAGEYKNLPEDTEFFRRDGTWNSEYGKFFMEWYSGKLLEHGDKLLSSAKAIFQGSGAKLSGKVAGIHWHYNTRSHAAELTAGYYNTRNHDGYLPIAKMFNKHGVVLNFTCMEMKDGEQPEHANCSPEGLVKQVQNATRQAGTELAGENALERYDSSAFGQVVATNRSDSGNGLTAFTYLRMNKRLFEGQNWQQLVEFVKNMKEGGHGRRLSEEDTTGSDLYVGFVGSKISETVEEAALV

SEQ ID NO: 9874 - protein, 547 aa, Eutrema parvulum
MELTLNSSSSLIKRKDTKSSRNQESSSNMSFAKLKPPTYQFQAKNSVKEMKFTHEKTFTPEGETTERWEKLHVLSYPHPKSDASVPVFVMLPLDTVTMSGHLNKPRAMNASLMALKGAGVEGVMVDAWWGLVEKDGPMKYNWEGYAELIQMVQKHGLKLQVVMSFHQCGGNVGDSCSIPLPPWVLEEISKNPDLVYTDKSGRRNPEYISLGCDSVPVLRGRTPIQVYSDFMRSFRERFDSCIGGVIAEIQVGMGPCGELRYPSYPESNGTWRFPGIGEFQCYDKYMRSSLQAYAESIGKTNWGTSGPHDAGEYKNLPEDTEFFRRDGTWNSEYGKFFMEWYSGKLLEHGDKLLSSAKGIFQGTGAKLSGKVAGIHWHYNTRSHAAELTAGYYNTRNHDGYLPIAKMFNKHGVVLNFTCMEMKDGEQPEHANCSPEGLVKQVQNATRQAGTELAGENALERYDSSAFGQVVATNRSDSGNGLTAFTYLRMNKRLFEGQNWQQLVEFVKNMKEGGHGRKLSEEDTTGSDLYVGFVRSRISEKVEEASLV

SEQ ID NO: 9875 - protein, 548 aa, Arabidopsis thaliana
MELTLNSSSSLIKRKDAKSSRNQESSSNNMTFAKMKPPTYQFQAKNSVKEMKFTHEKTFTPEGETLEKWEKLHVLSYPHSKNDASVPVFVMLPLDTVTMSGHLNKPRAMNASLMALKGAGVEGVMVDAWWGLVEKDGPMNYNWEGYAELIQMVQKHGLKLQVVMSFHQCGGNVGDSCSIPLPPWVLEEISKNPDLVYTDKSGRRNPEYISLGCDSVPVLRGRTPIQVYSDFMRSFRERFEGYIGGVIAEIQVGMGPCGELRYPSYPESNGTWRFPGIGEFQCYDKYMKSSLQAYAESIGKTNWGTSGPHDAGEYKNLPEDTEFFRRDGTWNSEYGKFFMEWYSGKLLEHGDQLLSSAKGIFQGSGAKLSGKVAGIHWHYNTRSHAAELTAGYYNTRNHDGYLPIAKMFNKHGVVLNFTCMEMKDGEQPEHANCSPEGLVKQVQNATRQAGTELAGENALERYDSSAFGQVVATNRSDSGNGLTAFTYLRMNKRLFEGQNWQQLVEFVKNMKEGGHGRRLSKEDTTGSDLYVGFVKGKIAENVEEAALV

SEQ ID NO: 9876 - protein, 548 aa, Arabidopsis lyrata
MELTLNSSSSLIKRKDAKSSRNQESSSNNMTFAKMKPPTYQFQAKNSVKEMKFTHEKTFTPEGETLERWEKLHVLSYPHSKNESSVPVFVMLPLDTVTMSGHLNKPRAMNASLMALKGAGVEGVMVDAWWGLVEKDGPMNYNWEGYAELIQMVQKHGLKLQVVMSFHQCGGNVGDSCSIPLPPWVLEEISKNPDLVYTDKSGRRNAEYISLGCDSVPVLRGRTPIQVYSDFMRSFRERFEGYIGGVIAEIQVGMGPCGELRYPSYPESNGTWRFPGIGEFQCYDKYMKSSLQAYAESIGKTNWGTSGPHDAGEYKNLPEDTEFFRRDGTWNSEYGKFFMEWYSGKLLEHGDQLLSSAKGIFQGSGAKLSGKVAGIHWHYNTRSHAAELTAGYYNTRNHDGYLPIAKMFNKHGVVLNFTCMEMKDGEQPEHANCSPEGLVKQVQNATRQAGTELAGENALERYDSSAFGQVVATNRSDSGNGLTAFTYLRMNKRLFEGQNWQQLVEFVKNMKEGGHGRRLSKEDTTGSDLYVGFVKGRIAENVEEAALV

SEQ ID NO: 9877 - protein, 548 aa, Eutrema halophilum
MELTLNSSSSLIKRKDTKSSRNQDNSSNMSFAMMKPPTYQFQAKNSVKEMKFTHEKTFTPEGETTERWEKLHVLSYPHPKSDASVPVFVMLPLDTVTMSGHLNKPRAMNASLMALKGAGVEGVMVDAWWGLVEKDGPMKYNWEGYAELIQMVQKHGLKLQVVMSFHQCGGNVGDSCSIPLPPWVLEEISKNPDLVYTDKSGRRNPEYISLGCDSVPVLRGRTPIQVYSDFMRSFRERFDSCIGGVIAEIQVGMGPCGELRYPSYPESNGTWSFPGIGEFQCYDKYMRSSLQAYAESIGKTNWGTSGPHDAGEYKNLPEDTEFFRRDGTWNSEYGKFFMEWYSEKLLEHGDRLLASAKGIFQGTGAKLSGKVAGIHWHYNTRSHAAELTAGYYNTRNHDGYLPIAKMFNKHGVVLNFTCMEMKDGEQPEHANCSPEGLVKQVQNATRQAGTELAGENALERYDSSAFGQVVATNRSDSGNGLTAFTYLRMNKRLFEGQNWQQLVEFVKNMKEGGHGKKLSEEDTTGSDLYVGFVRGKKITEKVEEASLV

SEQ ID NO: 9878 - protein, 549 aa, Brassica rapa
MELTLNSSSSLIKRKDTKSSRNHESSSNMSFAKMKPPTYQFQAKSSVKEMKFTHEKTFKPEGEEATERWEKLHVLSYPHPKNDSSVPVFVMLPLDTVTMSGHLNKPRAMNASLMALKGAGVEGVMVDAWWGLVEKDGPMKYNWEGYAELIQMVQKHGLKLQVVMSFHQCGGNVGDSCSIPLPPWVLEEISKNPDLVYTDKSGRRNPEYISLGCDSVPVLRGRTPIQVYSDFMRSFRERFDHYIGGVIAEIQVGMGPCGELRYPSYPESNGTWRFPGIGEFQCYDKYMRSSLQAYAESVGKTNWGTSGPHDAGEYKNLPEDTEFFRRDGTWNSEYGKFFMEWYSGKLLEHGDKLLASAKGVFQGTGAKLSGKVAGIHWHYNTRSHAAELTAGYYNTRNHDGYLPIAKMFNKHGVVLNFTCMEMKDGEQPEHANCSPEGLVKQVQSATRQAGTDLAGENALERYDSSAFGQVVATNRSDTGNGLTAFTYLRMNKRLFEGQNWQQLVEFVKKMKEGGGDGRRRQLSEEDTTGSDLYVGFVRKSRKVEEASLV

SEQ ID NO: 9879 - protein, 548 aa, Brassica napus
MELTLNSSSSLIKRKDTKSSRNHESSSNMSFAKMKPPTYQFQAKSSVKEMFTHEKTFKLEGEEATQRWEKLHVLSYPHPKNDSSVPVFVMLPLDTVTMSGHLNKPRAMNASLMALKGAGVEGVMVDAWWGLVEKDGPMKYNWEGYAELIHMVQKHGLKLQVVMSFHQCGGNVGDSCSIPLPPWVLEEISKNPDLVYTDKSGRRNPEYISLGCDSVPVLRGRTPIQVYSDFMRSFRERFDHYIGGVIAEIQVGMGPCGELRYPSYPESNGTWRFPGIGEFQCYDKYMRSSLQAYAESVGKTNWGTSGPHDAGEYKNLPEDTEFFRRDGTWNSEYGKFFMEWYSGKLLEHGDKLLASAKGVFQGTGAKLSGKVAGIHWHYNTRSHAAELTAGYYNTRNHDGYLPIAKMFNKHGVVLNFTCMEMRDGEQPEHANCSPEGLVKQVQSATRQAGTELAGENALERYDSSAFGQVVATNRSDSGNGLTTFTYLRMNKRLFEGQNWQQLVEFVKKMKEGRGDGRRRQLSEEDTTGSDLYVGFVRRSRKVEEASLV

SEQ ID NO: 9880 - protein, 500 aa, Brassica napus
KEMKFTHEKTYKPRKRNHREVGEAPRSLIPTPQERLQRPVFVMLPLDTVTMSGHLNKPRAMNASLMALKGAGVEGVMVDAWWGLVEKDGPMKYNWEGYAELIQMVQKHGLKLQVVMSFHQCGGNVGDSCSIPLPPWVLEEISKNPDLVYTDKSGRRNPEYISLGCDSVPVLRGRTPIQVYSDFMRSFRERFDNYIGGVIAEIQVGMGPCGELRYPSYPESNGTWRFPGIGEFQCYDKYMKSSLQAYAESIGKTNWGTSGPHDAGEYKNLPEDTEFFRRDGTWNSEYGKFFMEWYSGKLLEHGDKLLSSAKAIFQGSGAKLSGKVAGIHWHYNTRSHAAELTAGYYNTRNHDGYLPIAKMFNKHGVVLNFTCMEMKDGEQPEHANCSPEGLVKQVQNATRQAGTELAGENALERYDSSAFGQVVATNRSDSGNGLTAFTYLRMNKRLFEGQNWQQLVEFVKNMKEGGHGRRLSEEDTTGSDLYVGFVGSKISETVEEAALV

SEQ ID NO: 9881 - protein, 475 aa, Brassica napus
LSYPHPKNDSSVPVFVMLPLDTVTMSGHLNKPRAMNASLMALKGAGVEGVMVDAWWGLVEKDGPMKYNWEGYAELIQMVQKHGLKLQVVMSFHQCGGNVGDSCSIPLPPWVLEEISKNPDLVYTDKSGRRNPEYISLGCDSVPVLRGRTPIQVYSDFMRSFRERFDNYIGGVIAEIQVGMGPCGELRYPSYPESNGTWRFPGIGEFQCYDKYMKSSLQAYAESIGKTNWGTSGPHDAGEYKNLPEDTEFFRRDGTWNSEYGKFFMEWYSGKLLEHGDQLLSSAKAIFQGSGAKLSGKVAGIHWHYNTRSHAAELTAGYYNTRNHDGYLPIAKMFNKHGVVLNFTCMEMKDGEQPEHANCSPEGLVKQVQNATRQAGTELAGENALERYDSSAFGQVVATNRSDSGNGLTAFTYLRMNKRLFEGQNWQQLVEFVKNMKEGGHGRRLSEEDTTGSDLYVGGFVGSKISQTVEEAVLV

SEQ ID NO: 9882 - protein, 237 aa, Sorghum bicolor
MFLTRTEYDRGVNTFSPEGRLFQVEYAIEAIKLGSTAIGLKTKDGVVLAVEKRVTSPLLEPSSVEKIMEIDEHIGCAMSGLIADARTLVEHARVETQNHRFSYGEPMTVESSTQAICDLALRFGEGDEESMSRPFGVSLLIAGHDENGPSLYYTDPSGTFWQCNAKAIGSGSEGADSSLQEQYNKELTLEEAETIALSILKQVMEEKVTPNNVDIAKVAPKYHLYTPAEVEAVIARL

SEQ ID NO: 9883 - protein, 237 aa, Unknown
  Sequence found in Organisms: Cenchrus ciliaris, Setaria italica
MFLTRTEYDRGVNTFSPEGRLFQVEYAIEAIKLGSTAIGLKTKDGVVLAVEKRVTSPLLEPSSVEKIMEIDEHIGCAMSGLIADARTLVEHARVETQNHRFSYGEPMTVESSTQAICDLALRFGEGDEESMSRPFGVSLLIAGHDENGPSLYYTDPSGTFWQCNAKAIGSGSEGADSSLQEQYNKDLTLQEAETIALSILKQVMEEKVTPNNVDIAKVAPKYHLYTPAEVEAVIARL

SEQ ID NO: 9884 - protein, 237 aa, Cenchrus ciliaris
MFLTRTEYDRGVNTFSPEGRLFQVEYAIEAIKLGSTAIGLKTKDGVVLAVEKRVTSPLLEPSSVEKIMEIDEHIGCAMSGLIADARTLVEHARVETQNHRFSYGEPMTIESSTQAICDLALRFGEGDEESMSRPFGVSLLIAGHDENGPSLYYTDPSGTFWQCNAKAIGSGSEGADSSLQEQYNKDLTLQEAETIALSILKQVMEEKVTPNNVDIAKVAPKYHLYTPAEVEAVIARL

SEQ ID NO: 9885 - protein, 237 aa, Zea mays
MFLTRTEYDRGVNTFSPEGRLFQVEYAIEAIKLGSTAIGLKTKDGVVLAVEKRVTSPLLEPSSVEKIMEIDEHIGCAMSGLIADARTLVEHARVETQNHRFSYGEPMTVESSTQAICDLALRFGEGDEESMSRPFGVSLLIAGHDENGPSLYYTDPSGTFWQCNAKAIGSGSEGADSSLQEQYNKELALEEAETIALSILKQVMEEKVTPNNVDIAKVAPKYHLYTPAEVEAVIARL

SEQ ID NO: 9886 - protein, 237 aa, Oryza sativa
MFLTRTEYDRGVNTFSPEGRLFQVEYAIEAIKLGSTAIGLKTKDGVVLAVEKRVTSPLLEPSSVEKIMEIDEHIGCAMSGLIADARTLVEHARVETQNHRFSYGEPMTVESTTQAICDLALRFGEGDEESMSRPFGVSLLIAGHDENGPSLYYTDPSGTFWQCNAKAIGSGSEGADSSLQEQYNKELTLQEAETIALSILKQVMEEKVTPNNVDIAKVSPNYHLYTPAEVEAVIARL

SEQ ID NO: 9887 - protein, 237 aa, Brachypodium distachyon
MFLTRTEYDRGVNTFSPEGRLFQVEYAIEAIKLGSTAIGLKTKDGVVLAVEKRVTSPLLEPSSVEKIMEIDEHVGCAMSGLIADARTLVEHARVETQNHRFSYGEPMTVESTTQAICDLALRFGEGDEESMSRPFGVSLLIAGHDENGPSLYYTDPSGTFWQCNAKAIGSGSEGADSSLQEQYNKELTLAEAETIALSILKQVMEEKVTPNNVDIAKVSPSYHLYTPAEVEAVIARL

SEQ ID NO: 9888 - protein, 237 aa, Brachypodium distachyon
MFLTRTEYDRGVNTFSPEGRLFQVEYAIEAIKLGSTAIGLKTKDGVVLAVEKRVTSPLLEPSSVEKIMEIDEHVGCAMSGLIADARTLVEHARVETQNHRFSYGEPMTVESTTQAICDLALRFGEGEEESMSRPFGVSLLIAGHDENGPSLYYTDPSGTFWQCNAKAIGSGSEGADSSLQEQFNKELTLQEAETIALSILKQVMEEKVTPNNVDIAKVAPNYHLYTPAEVEAVIGRL

SEQ ID NO: 9889 - protein, 237 aa, Festuca arundinacea
MFLTRTEYDRGVNTFSPEGRLFQVEYAIEAIKLGSTAIGLKTKDGVVLAVEKRVTSPLLEPSSVEKIMEIDEHVGCAMSGLIADARTLVEHARVETQNHRFSYGEPMTVESTTQAICDLALRFGEGEEESMSRPFGVSLLIAGHDENGPSLYYTDPSGTFWQCNAKAIGSGSEGADSSLQEQFNKELTLEEAESIALSILKQVMEEKVTPNNVDIAKVAPNYHLYTPAEVEAVIARL

SEQ ID NO: 9890 - protein, 237 aa, Unknown
  Sequence found in Organisms: Festuca arundinacea, Lolium multiflorum
MFLTRTEYDRGVNTFSPEGRLFQVEYAIEAIKLGSTAIGLKTKEGVVLAVEKRVTSPLLEPSSVEKIMEIDEHVGCAMSGLIADARTLVEHARVETQNHRFSYGEPMTVESTTQAICDLALRFGEGEEESMSRPFGVSLLIAGHDENGPSLYYTDPSGTFWQCNAKAIGSGSEGADSSLQEQYNKELTIAEAETIALSILKQVMEEKVTPNNVDIAKVSPSYHLYTPAEVEAVIARL

SEQ ID NO: 9891 - protein, 237 aa, Gossypium raimondii
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDLTLQEAETIALSILKQVMEEKVTPNNVDIAKVAPTYHLYTPSEVEAVISRL

SEQ ID NO: 9892 - protein, 237 aa, Theobroma cacao
MFLTRTEYDRGVNTFSPEGRLFQVEYAIEAIKLGSTAIGIKTKDGVVLAVEKRITSPLLEPSSVEKIMEIDAHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDLTLQEAETIALSILKQVMEEKVTPNNVDIAKVAPTYHLYTPSEVEAVITRL

SEQ ID NO: 9893 - protein, 237 aa, Echinacea purpurea
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLTLKEAETIALSILKQVMEEKVTPNNVDIAKVAPTYHLYTPAEVEAVIGRL

SEQ ID NO: 9894 - protein, 237 aa, Panax ginseng
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNGKAIGSGSEGADSSLQEQYNKDLTLKEAETIALSILKQVMEEKVTPNNVDIAKVAPTYHLYTPAEVEAVISRL

SEQ ID NO: 9895 - protein, 237 aa, Gossypium raimondii
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNGKAIGSGSEGADSSLQEQYNKDLTLQEAETIALSILKQVMEEKVTPNNVDIAKVAPTYHLYTPSEVEAVITRL

SEQ ID NO: 9896 - protein, 237 aa, Vitis vinifera
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNQDLTLQEAETIALSILKQVMEEKVTPNNVDIAKVAPTYHLYTPAEVEAVISRL

SEQ ID NO: 9897 - protein, 237 aa, Glycine max
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLTLQEAETIALSILKQVMEEKVTPNNVDIAKVAPTYHLYTPSEVEAVISRL

SEQ ID NO: 9898 - protein, 237 aa, Gossypium raimondii
MFLTRTEYDRGVNTFSPEGRLFQVEYAIEAIKLGSTAIGLKTKDGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGTSLYYTDPSGTFWQCNAKAIGSGSEGADSSLQEQYNKDLTLQEAETIALSILKQVMEEKVTPNNVDIARVAPTYHLYTPSEVEAVITRL

SEQ ID NO: 9899 - protein, 237 aa, Glycine max
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNGKAIGSGSEGADSSLQEQYNKDLTLQEAETIALSILKQVMEEKVTPNNVDIAKVAPTYHLYTPSEVEAVISRL

SEQ ID NO: 9900 - protein, 237 aa, Centaurea maculosa
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNGKAIGSGSEGADSSLQEQYNKDLTLKEAEIIALSILKQVMEEKVTPNNVDIAKVAPTYHLYTPAEVEAVISRL

SEQ ID NO: 9901 - protein, 237 aa, Lupinus angustifolius
MFLTRTEYDRGVNTFSPEGRLFQVEYAIEAIKLGSTAIGLKTKEGVVLAVEKRITSPLLEPSSVEKIMEIDDHIGCAMSGLIADARTLVEHARVETQNHRFSFGEPMTVESTTQALCDLALRFGEGDEESMSRPFGVSLLIAGHDENGPSLYYTDPSGTFWQCNAKAIGSGSEGADSSLQEQFNKELTLQEAETIALSILKQVMEEKVTPNNVDIAKVAPTYHLYTPSEVEAVISRL

SEQ ID NO: 9902 - protein, 237 aa, Arachis hypogaea
MFLTRTEYDRGVNTFSPEGRLFQVEYAIEAIKLGSTAIGLKTKHGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGRDENGPSLYYTDPSGTFWQCNAKAIGSGSEGADSSLQEQYNKDLTLEEAETIALSILKQVMEEKVTPNNVDIAKVSEKYHLYTPAEVEAVISRL

SEQ ID NO: 9903 - protein, 237 aa, Unknown
  Sequence found in Organisms: Glycine max, Phaseolus vulgaris
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNGKAIGSGSEGADSSLQEQFNKDLTLQEAETIALSILKQVMEEKVTPNNVDIAKVAPTYHLYTPSEVEAVISRL

SEQ ID NO: 9904 - protein, 237 aa, Medicago truncatula
MFLTRTEYDRGVNTFSPEGRLFQVEYAIEAIKLGSTAIGLKTKEGVVLAVEKRITSPLLEPSSVEKIMEIDDHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLTLQEAETIALSILKQVMEEKVTPNNVDIARVAPAYHLYTPSEVEAVISRL

SEQ ID NO: 9905 - protein, 237 aa, Eutrema halophilum
MFLTRTEYDRGVNTFSPEGRLFQVEYAIEAIKLGSTAIGVKTKEGVVLAVEKRITSPLLEPSSVEKIMEIDDHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLSLQEAETIAVSILKQVMEEKVTPNNVDIAKVAPAYHLYTPQEVEAVISRL

SEQ ID NO: 9906 - protein, 237 aa, Unknown
  Sequence found in Organisms: Arabidopsis thaliana, Arabidopsis lyrata
MFLTRTEYDRGVNTFSPEGRLFQVEYAIEAIKLGSTAIGVKTKEGVVLAVEKRITSPLLEPSSVEKIMEIDDHIGCAMSGLIADARTLVEHARVETQNHRFSYGEPMTVESTTQALCDLALRFGEGEEESMSRPFGVSLLIAGHDENGPSLYYTDPSGTFWQCNAKAIGSGSEGADSSLQEQFNKDLSLQEAETIAVSILKQVMEEKVTPNNVDIAKVAPAYHLYTPQEVEAVIARL

SEQ ID NO: 9907 - protein, 237 aa, Arabidopsis lyrata
MFLTRTEYDRGVNTFSPEGRLFQVEYAIEAIKLGSTAIGVKTKEGVVLAVEKRITSPLLEPSSVEKIMEIDDHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDITLQEAETIAVSILKQVMEEKVTPNNVDIAKVAPAYHLYTPQEVEAVISRL

SEQ ID NO: 9908 - protein, 237 aa, Solanum lycopersicum
MFLTRTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDLTLKEAETIALSILKQVMEEKVTPNNVDIARVSPTYHLYSPSEVEEVISRL

SEQ ID NO: 9909 - protein, 237 aa, Phaseolus vulgaris
MFLTRTEYDRGVNTFSPEGRLFQVEYAIEAIKLGSTAIGLKTKEGVVLAVEKRITSPLLEPSSVEKIMEIDDHIGCAMSGLIADARTLVEHARVETQNHRFSYGEPMTVESTTQALCDLALRFGEGDEESMSRPFGVSLLIAGHDENGPCLYYTDPSGTFWQCNGKAIGSGSEGADSSLQEQFNKDLTLQEAETIALSILKQVMEEKVTPNNVDIARVAPTYHLYTPSEVEAVISRL

SEQ ID NO: 9910 - protein, 237 aa, Arabidopsis thaliana
MFLTRTEYDRGVNTFSPEGRLFQVEYAIEAIKLGSTAIGVKTKEGVVLAVEKRITSPLLEPSSVEKIMEIDDHIGCAMSGLIADARTLVEHARVETQNHRFSYGEPMTVESTTQALCDLALRFGEGEEESMSRPFGVSLLIAGHDENGPSLYYTDPSGTFWQCNAKAIGSGSEGADSSLQEQFNKDITLQEAETIAVSILKQVMEEKVTPNNVDIAKVAPAYHLYTPQEVEAVISRL

SEQ ID NO: 9911 - protein, 237 aa, Triphysaria pusilla
MFLTRTEYDRGVNTFSPEGRLFQVEYAIEAIKLGSTAIGIKTKEGVVLAVEKRITSPLLEPSSVEKIMEIDAHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLTLKEAETTALSILKQVMEEKVTPNNVDIAKVSPTYHLYSPSEVEAVIGRL

SEQ ID NO: 9912 - protein, 237 aa, Triphysaria pusilla
MFLTRTEYDRGVNTFSPEGRLFQVEYAIEAIKLGSTAIGIKTKEGVVLAVEKRITSPLLEPSSVEKIMEIDAHIGCAMSGLIADARTLVEHARVETQNHRFSYGEPMTVESTTQALCDLALRFGEGDEESMSRPFGVSLLIAGHDENGPSLFYTDPSGTFWQCNAKAIGSGSEGADSSLQEQFNKDLTLKEAETIALSILKQVMEEKVTPNNVDIAKVSPTYHLYSPSEVEAVIGRL

SEQ ID NO: 9913 - protein, 237 aa, Solanum lycopersicum
MFLTRTEYDRGVNTFSPEGRLFQVEYAIEAIKLGSTAIGIKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQFNKDLTLKEAETIALSILKQVMEEKVTPNNVDIARVSPTYHLYSPSEVEDVISRL

SEQ ID NO: 9914 - protein, 237 aa, Triphysaria pusilla
MFLTRTEYDRGVNTFSPEGRLFQVEYAIEAIKLGSTAIGIKTKEGVVLAVEKRITSPLLEPSSVEKIMEIDAHIGCAMSGLIADARTLVEHARVETQNHRFSYGEPMTVESTTQALCDLALRFGEGDEESMSRPFGVSLLIAGHDENGPSLFYTDPSGTFWQCNAKAIGSGSEGADSSLQEQFNKDLTLKEAETTALSILKQVMEEKVTPNNVDIAKVSPTYHLYSPSEVEAVIGRL

SEQ ID NO: 9915 - protein, 230 aa, Arachis hypogaea
MFLTRTEYDRGVNTFSPEGRLFQVEYAIEAIKLGSTAIGLKTKHGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGRDENGPSLYYTDPSGTFWQCNAKAIGSGSEGADSSLQEQYNKDLTLEEAETIALSILKQVMEENVTPNNVDIAKVSEKYHLYTPAEV

SEQ ID NO: 9916 - protein, 77 aa, Chenopodium quinoa
MFLTRTEYDRGVNTFSPEGRLFQVEYAIEAIKLGSTAIGIRTNEGVVLAVEKRITSPLLEPSSVEKSWKLMSILGVL

SEQ ID NO: 9917 - protein, 170 aa, Chenopodium quinoa
MEIDEHIGCAMSGLIADARTLVEHARVETQNHRFSYGEPMNVESTTQALCDLALRFGEGDEESMSRPFGVSLLIAGHDENGPSLYHTDPSGTFWQCSAKAIGSGSEGADSNLQEQYRKDLTFQEAETIALSTLKQVMEEKVTPNNVDIAKVSPTYHLYTPAEVEAVIARL

SEQ ID NO: 9918 - protein, 237 aa, Chenopodium quinoa
MFLTRTEYDRGVNTFSPEGRLFQVEYAIEAIKLGSTAIGIRTNEGVVLVVEKRITSPLLEPSSVEKIMEIDEHIGCAMSGLIADARTLVEHARVETQNHRFSYGEPMNVESTTQALCDLALRFGEGDEESMSRPFGVSLLIAGHDENGPSLYHTDPSGTFWQCSAKAIGSGSEGADSNLQEQYRKDLTFQEAETIALSTLKQVMEEKVTPNNVDIAKVSPTYHLYTPAEVEAVIARL

SEQ ID NO: 9919 - protein, 218 aa, Echinacea purpurea
RLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDLSLKEAETIALSILKQVMEEKVTPNNVDIAKVAPTYHLYTPAEVEAVISRL

SEQ ID NO: 9920 - protein, 237 aa, Physcomitrella patens
MFLTRSEYDRGVNTFSPEGRLFQVEYAIEAIKLGSTAVGLKTKEGVVLAVEKRITSVLLEPTSVEKIMEIDEHIGCAMSGLTADARTLVEHGRVETQNHRFSYNEPMSVESTTQALCDLALRFGEGDEESMSRPFGVSLLIAGHDESGPCLYHTDPSGTFWQCDAKAIGSGSEGADTSLQEHFNKNMTLEEAETLALSTLKQVMEEKVTSSNVDIAKVAPKYHLYSPEEVEAVIQRL

SEQ ID NO: 9921 - protein, 237 aa, Physcomitrella patens
MFLTRSEYDRGVNTFSPEGRLFQVEYAIEAIKLGSTAVGLKTKEGVVLAVEKRITSVLLEPTSVEKIMEIDEHIGCAMSGLTADARTLVEHGRVETQNHRFSYNEPMSVESTTQALCDLALRFGEGDEESMSRPFGVSLLIAGHDESGPCLYHTDPSGTFWQCDAKAIGSGSEGADTSLQEHFNKNMTLEEAETLALSTLKQVMEEKVTSCNVDIAKVAPKYHLYTPEEVEVVIQRL

SEQ ID NO: 9922 - protein, 201 aa, Festuca arundinacea
MFLTRTEYDRGVNTFSPEGRLFQVEYAIEAIKLGSTAIGLKTKDGVVLAVEKRVTSPLLEPSSVEKIMEIDEHVGCAMSGLIADARTLVEHARVETQNHRFSYGEPMTVESTTQAICDLALRFGEGEEESMSRPFGVSLLIAGHDENGPSLYYTDPSGTFWQCNAKAIGSGSEGADSSLQEQFNKELTLEEAESIALSILK

SEQ ID NO: 9923 - protein, 200 aa, Nuphar advena
  misc_feature (194)..(194): Xaa can be any naturally occurring amino acid
MFLTRTEYDRGVNTFSPEGRLFQVEYAIEAIKLGSTAIGIKTKDGVVLAVEKRITSPLLEPSSVEKIMEIDEHIGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKDISLLEAEXIALSIL

SEQ ID NO: 9924 - protein, 198 aa, Acacia harpophylla
MFLTRTEYDRGVNTFSPEGRLFQVEYAIEAIKLGSTAIGLKTKEGVVLAVEKRITSPLLEPSSVEKITEIDQHMGCAMSGLIADARTLVEHARVETQNHRFSYGEPMTVESTTQALCDLALRFGEGDEESMSRPFGVSLLIAGHDENGPSLYYTDPSGTFWQCNAKAIGSGSEGADSSLQEQYNKELTLQEAEAIALS

SEQ ID NO: 9925 - protein, 386 aa, Arabidopsis lyrata
MAALQYLESLKNAHPELGEWYNSLADLYQKKLWHQLTLKLEQFIALAVFQAGDALIQFYHNFITDFETKINLLKLAHFAVVVSRQYSEKEAAVSYLESVIEKLRATKEPRITEPIIYIETQKALFKLEQGDQKECKKILDDGKSSLDSMTDIDPSVYANFYWVSSQYHKSRQEFSDFYKSALLYLAYTSVEDLSESFKLDLAFDLSLSALLGENIYNFGELLAHPILKSLLGTNVEWLYHILQAFNHGDLVQYQELCRVHNASLIAQPALVENEKKLLEKINILCLIEIIFSRPAEDRTIPLSIIAERTKLSIEDVEHLLMKSLSVHLIEGIIDQVNGTVYVSWAQPRVLGIPQIKALRDQLDSWVDKVHTTLLSVEAETPDLVAA

SEQ ID NO: 9926 - protein, 386 aa, Eutrema halophilum
MAALQYLESQKNAHPELGEWYNSLADLYQKKLWHQLTLKLEQFIALAVFQAGDALIQFYNNFITDFETKINLLKLAHFAVVVSRQYPEKEAAVNYLEGVIEKLRATKEPRITEPIIYIETQKALFKLEQGDQKECKKILDDGKSSLDSMTDIDPSVYANFYWVSSQYHKFRQEFSDFYKSALLYLAYTSVEALSESFKLDLAFDLSLSALLGENIYNFGELLAHPILKSLLGTNVEWLYHILQAFNHGDLVQYQELCRVHHASLIAQPALVENEQRLLEKINILCLIEIIFSRPAEDRTIPLSVIAERTKLSIEDVEHLLMKSLSVHLIEGIIDQVNGTVYVSWAQPRVLGIPQIKSLRDQLDSWVDKVHTTLLSVEAETPDLVAA

SEQ ID NO: 9927 - protein, 386 aa, Eutrema parvulum
MAALQYLESLKNANPELGEWYNSIADLYQKKLWHQLTLKLEQFIALAVFQAGDALIQFYNNFITDFETKINLLKLAHFAVVVSRQYPEKEAAVSYLEGVIEKLRATKEPRITEPIIYIETQKALFKLEQGDQKECKKILDDGKSSLDSMTDIDPSVYANFYWVSSQYHKFRQEFSDFYKSALLYLAYTSVEALSESFKLDLAFDLSLSALLGENIYNFGELLAHPILKSLLGTNVEWLYHILQAFNHGDLVQYQELCRVHHASLIAQPALVENEKKLLEKINILCLIEIIFSRPAEDRTIPLSVIAERTKLSIEDVEHLLMKSLSVHLIEGIIDQVDGTVYVSWAQPRVLGIPQIKSLRDQLDNWVDKVHTTLLSVEAETPDLVAA

SEQ ID NO: 9928 - protein, 386 aa, Eutrema parvulum
MAALQYLESLKNANPELGEWYNSIADLYQKKLWHQLTLKLEQFIALAVFQAGDALIQFYHNFITDFETKINLLRLAHFAVVVSRQYSEKEAAVGYLEGVIEKLKATKEPRITEPIIYIETQKALFKLEQGDQKECKKILDDGKTSLDSMTDIDPSVYANFYWVSSQYHKFRQEFSDFYKSALLYLAYTSVEALSESFKLDLAFDLSLSALLGENIYNFGELLAHPILKSLLGTNVEWLYHILQAFNHGDLVQYQELCRVHHASLIAQPALVENEKKLLEKINILCLIEIIFSRPAEDRTIPLSVIAERTKLSIEDVEHLLMKSLSVHLIEGIIDQVDGTVYVSWAQPRVLGIPQIKSLRDQLDNWVDKVHTTLLSVEAETPDLVAA

SEQ ID NO: 9929 - protein, 386 aa, Brassica napus
MAALQYLESLKSSHPELNEWYDSLSDLYQKKLWHQLTLKLEQFIALSVFQAGDALIQFYHNFITDFETKINLLKLAHFAVVVSRQYSEKEAAVSYLEGVIEKLKATKEPRITEPIVYIETQKALFKLEQGDQKECKKVLDDAKTSLDSMTDIDPSVYANFYWVSSQYHKCRQEFSDFYKSALLYLAYTSVEALSESFKLDLAFDLSLSALLGENIYNFGELLAHPILKSLLGTNVEWLYHILQAFNHGDLVQYQELCRVHHASLIAQPALVENEKKLLEKINILCLIEIIFSRPAEDRTIPLTVIAERTKLSIEDVEHLLMKSLSVHLIEGIIDQVNGTVYISWAQPRVLGIPQIKSLRDQLDSWVDKVHTTLLSVEAETPDLVAA

SEQ ID NO: 9930 - protein, 386 aa, Brassica rapa
MAALQYLESLKSSHPELNEWYDSLSDLYQKKLWHQLTLKLEQFIALSVFQAGDALIQFYHNFITDFETKINLLKLAHFAVVVSRQYSEKEAAVSYLEGVIEKLKATKEPRITEPIVYIETQKALFKLEQGDQKECKKVLDDAKTSLDSMTDIDPSVYANFYWVSSQYHKCRQEFSDFYKSALLYLAYTSVEALSDSFKLDLAFDLSLSALLGENIYNFGELLAHPILKSLLGTNVEWLYHILQAFNHGDLVQYQELCRVHHASLIAQPALVENEKKLLEKINILCLIEIIFSRPAEDRTIPLTVIAERTKLSIEDVEHLLMKSLSVHLIEGIIDQVNGTVYISWAQPRVLGIPQIKSLRDQLDSWVDKVHTTLLSVEAETPDLVAA

SEQ ID NO: 9931 - protein, 386 aa, Eutrema parvulum
MAALQYLESQKNAHPELGEWYNSLADLYQKKLWHQLTLKLEQFIALSVFQAGDALIQFYNNFITDFETKINLLKLAHFAVVVSRQYPEKEAAVSYLEGVIEKLRATKESRISEPISYIETQIALFKLEQGDQKECKKILDDGKSALDSMTDIDPSVYANFFWVSSQYHKFRQEFSDFYKNALLYLAYTSVESLSESFKLDLAFDLSLSALLGDNIYNFGELLAHPILKSLLGTNVEWLYHILQAFNHGDLVQYQELCRVHNASLSAQPALVENEKKLLEKINILCLIEIIFSRPAEDRTIPLSVIAERTKLSIEDVEHLLMKSLSVHLIEGIIDQVDGTVHVSWAQPRVLGIPQIKSLRDQLDSWVDKVHTTLLSVEAETPDLVAA

SEQ ID NO: 9932 - protein, 386 aa, Brassica napus
MAALQYLESLKNSHPELNEWYDSLSDLYQKKLWHQLTLKLEQFIALSVFQAGDALIQFYHNFITDFETKINLLKLAHFAVVVSRQYAEKEAAVSYLEGVIEKLKATKEPRITEPIVYIETQKALFKLEQGDQKECKKILDDAKTFLDSMTDIDPSVHANFYWVSSQYHKFRQEFSDFYKSALLYLAYTSVEALSDSFKLDLAFDFSLSALLGENIYNFGELLAHPILKSLLGTNVEWLYHILQAFNHGDLVQYQELCRVHHASLIAQPALVENEKKLLEKINILCLIEIIFSRPAEDRTIPLTVIAERTKLSIEDVEHLLMKSLSVHLIEGIIDQVNGTVYISWAQPRVLGIPQIKSLRDQLDSWVDKVHTTLLSVEAETPDLVAA

SEQ ID NO: 9933 - protein, 386 aa, Eutrema halophilum
MAALQYLESQKNAHPELGEWYNSLADLYQKKLWHQLTLKLEQFIALSVFQAGDALIQFYNNFITDFETKINLLKLAHFAVVVSRQYPEKEAAVGYLEGVIEKLRATKESRINEPISYIETQIALFKLEQGDQKECKKILDDGKSSLDSMTDIDPSVYANFYWVSSQYHKFRQEFSDFYKNALLYLAYTSVESLSESFKLDLAFDLSLSALLGDNIYNFGELLAHPILKSLLGTNVEWLYHILQAFNHGDLVQYQELCRVHNAALSAQPALVENEKKLLEKINILCLIEIIFSRPAEDRTIPLSVIAERTKLSIEDVEHLLMKSLSVHLIEGILDQVDGTVHVSWAQPRVLGIPQIKSLRDQLDSWVDKVHTTLLSVEAETPDLVAA

SEQ ID NO: 9934 - protein, 386 aa, Raphanus sativus
  misc_feature (303)..(303): Xaa can be any naturally occurring amino acid
MAALQYLESLKTSHPELNEWYNSLADLYQKKLWHQLTLKLEQFIALSVFQAGDALVQFYHNFITDFETKINLLKLAHFAVVVSRQYSEKEAAVGYLEGVIEKLKATKEPRITEPIVYIETQKALFKLEQGDQKECKKVLDDAKTSLDSMTDIDPSVHANFYWVSSQYHKFRQEFSDFYKSALLFLAYTSVEALSESFKLDLAFDLSLSALLGENIYNFGELLAHPILKSLLGTNVEWLYHILQAFNHGDLVQYQELCRVHHASLIAQPALVENEKKLLEKINILCLIEIIFSRPAEDRTIPLXVIAERTKLSIEDVEHLFMKSLSVHLIEGIIDQVNGTVYISWAQPRVLGIPQIKSLRDQLDSWVDKVHTTLLSVEAETPDLVSA

SEQ ID NO: 9935 - protein, 386 aa, Raphanus sativus
  misc_feature (311)..(311): Xaa can be any naturally occurring amino acid
  misc_feature (378)..(378): Xaa can be any naturally occurring amino acid
MAALQYLESLKTSHPELNEWYDSLADLYQKKLWHQLTLKLEQFIALSVFQAGDALVQFYHNFITDFETKINLLKLAHFAVVVSRQYAEKEAAVGYLEGVIEKLKATKEPRITEPIVYIETQKALFKLEQGDQKECKKVLDDAKTSLDSMTDIDPSVYANFYWVSSQYHKFRQEFSDFYKSALLYLAYTSVEALSESFKLDLAFDLSLSALLGENIYNFGELLAHPILKSLLGTNVEWLYHILQAFNHGDLVQYQELCRVHHASLIAQPALVENEKKLLEKINILCLIEIIFSRPAEDRTIPLTVIAERTKXSIEDVEHLLMKSLSVHLIEGIIDQVNGTVYISWAQPRVLGIPQIKSLRDQLDSWVDKVHTTLLSVEXETPDLVAA

SEQ ID NO: 9936 - protein, 249 aa, Raphanus sativus
MAALQYLESLKTSHPELNEWYNSLADLYQKKLWHQLTLKLEQFIALSIFQAGDALIQFYHNFITDFETKINLLKLAHFAVVVSRQYSEKEAAVGYLEGVIEKLKATKEPRITEPIVYIETQKALFKLEQGDQKECKKVLDDAKTSLDSMTDIDPSVHANFYWVSSQYHKFRQEFSDFYKSALLFLAYTSVEALSESFKLDLAFDLSLSALLGENIYNFGELLAHPILKSLLGTNVEWLYTFSRRSTMVI

SEQ ID NO: 9937 - protein, 386 aa, Arabidopsis thaliana
MAALQYLESQKNAHPELGEWYNSLADLYQKKLWHQLTLKLEQFIALSVFQAGDALIQLYNNFITDFETRINLLKLAHFAVVVSRQYPEKEAAVSYLEGVIEKLKATKESRINEPISYIETQIALFKLEQGDQKECKKILDDGKSLLDSMTDIDPSVYANFFWVSSQYHKVRQEFSEFYKNALLYLAYTSVDSLSESFKLDLAFDLSLSALLGENIYNFGELLAHPILKSLLGTNVEWLYHILQAFNHGDLVQYQELCRVHNASLSAQPALVENEKKLLEKINILCLIEIIFSRPAEDRTIPLSVIAERTKLSIEDVEHLLMKSLSVHLIEGILDQVNGTVYVSWAQPRVLGIPQIKSLRDQLDSWVDKVHTTLLSVEAETPDLVAA

SEQ ID NO: 9938 - protein, 386 aa, Arabidopsis lyrata
MSALQYLESQKNAHPELGEWYNSLADLYQKKLWHQLTLKLEQFIALSVFQAGDALIQLYNNFITDFETRINLLKLAHFAVVVSRQYPEKEAAVSYLEGVIEKLKATKESRINEPISYIETQIALFKLEQGDQKECKKILDDGKSLLDSMTDIDPSVYANFFWVSSQYHKFRQEFSEFYKNALLYLAYTSVESLSESFKLDLAFDLSLSALLGDNIYNFGELLAHPILKSLLGTNVEWLYHILQAFNHGDLVQYQELCRVHNASLSAQPALVENEKKLLEKINILCLIEIIFSRPAEDRTIPLSVIAERTKLSIEDVEHLLMKSLSVHLIEGILDQVNGTVYVSWAQPRVLGIPQIKLLRDQLDSWVDKVHTTLLSVEAETPDLVAA

SEQ ID NO: 9939 - protein, 386 aa, Raphanus sativus
MAALQYLESQKNSHPDLTEWYNSLADLYQKKLWHQLTLKLEQFIALSVFQAGDALIQLYNNFITDFETKINLLKLAHFAVVVSRQYPEKEAAVSYLQGVIEKLRATKESRISEPVSYVETQIALFKLEQGDQKECKKILDDVKSSLDSMTDIDPSVYANFYWVSSQYHKFRQEFSDFYKNALLYLAYTSVESLSESFKLDLAFDLSLSALLGENIYNFGELLAHPVLKSLLGTNVEWLYHILQAFNHGDLVQYQELCRVHNAALSAQPALVENEKKLLEKINILCLIEIIFSRPAEDRTIPLSVIAERTKLSIEDVEHLLMKSLSVHLIEGIIDQVDGTVHVSWAQPRVLGIPQIKSLRDQLDSWVDKVHTTLLSVEAETPDLVAV

SEQ ID NO: 9940 - protein, 386 aa, Raphanus sativus
MAALQYLESQKNSHPELTEWYNSLADLYQKKLWHQLTLKLEQFIALSVFQAGDALIQLYNNFITDFETKINLLKLAHFAVVVSRQYPEKEAAVSYLQGVIEKLRATKESRISEPVSYVETQIALFKLEQGDQKECKKILDDVKSSLDSMTDIDPSVYANFFWVSSQYHKFRQEFSDFYKNALLYLAYTSVESLSESFKLDLAFDLSLSALLGENIYNFGELLAHPVLKSLLGTNVEWLYHILQAFNHGDLVQYQELCRVHNAALSAQPALVENEKKLLEKINIFCLIEIIFSRPAEDRTIPLSVIAERTKLSIEDVEHLLMKSLSVHLIEGIIDQVDGTVHVSWAQPRVLGIPQIKSLRDQLDSWVDKVHTTLLSVEAETPDLVAA

SEQ ID NO: 9941 - protein, 386 aa, Brassica napus
MAALQYLESQKNAHPELTEWYNSLADLYQKKLWHQLTVKLEQFIALPVFQAGDALIQLYNNFITDFETKINLLKLAHFAVVVSRQYPEKEAAVSYLQGVIEKLRATKESRISEPVSYVETQIALFKLEQGDQKECKKILDDVKTSLDSMTDIDPSVYANFFWVSSQYHKFRQEFSDFYKNALLYLAYTSVESLSESFKLDLAFDLSLSALLGENIYNFGELLAHPVLKSLLGTNVEWLYHILQAFNHGDLVQYQELCRVHNAALSAQPALVENEKKLLEKINILCLIEIIFSRPAEDRTIPLSVIAERTKLSIEDVEHLLMKSLSVHLIEGIIDQVDGTVHVSWAQPRVLGIPQIKSLRDQLDSWVDKVHTTLLSVEAETPDLVAA

SEQ ID NO: 9942 - protein, 386 aa, Brassica rapa
MAALQYLESQKNAHPELTEWYNSLADLYQKKLWHQLTLKLEHFIALSVFQAGDALIQLYNNFITDFETKINLLKLAHFAVVVSRQYPEKEAAVSYLQGVIEKLRATKESRISEPVSYVETQIALFKLEQGDQKECKKILDDVKTSLDSMTDIDPSVYANFFWVSSQFHKFRQEFSDFYKNALLYLAYTSVESLSESFKLDLAFDLSLSALLGENIYNFGELLAHPVLKSLLGTNVEWLYHILQAFNHGDLVQYQELCRVHNAALSAQPALVENEKKLLEKINILCLIEIIFSRPAEDRTIPLSVIAERTKLSIEDVEHLLMKSLSVHLIEGIIDQVDGTVHVSWAQPRVLGIPQIKSLRDQLDSWVDKVHTTLLSVEAETPDLVAA

SEQ ID NO: 9943 - protein, 386 aa, Brassica napus
MAALQYLESQKNAHPELTEWYNSLADLYQKKLWHQLTLKLEHFIALSVFQAGDALIQLYNNFITDFETKINLLKLAHFAVVVSKQYPEKEAAVSYLQGVIEKLRATKESRISEPVSYVETQIALFKLEQGDQKECKKILDDVKTSLDSMTDIDPSVYANFFWVSSQFHKFRQEFSDFYKNALLYLAYTSVESLSESFKLDLAFDLSLSALLGENIYNFGELLAHPVLKSLLGTNVEWLYHILQAFNHGDLVQYQELCRVHNAALSAQPALVENEKKLLEKINILCLIEIIFSRPAEDRTIPLSVIAERTKLSIEDVEHLLMKSLSVHLIEGIIDQVDGTVHVSWAQPRVLGIPQIKSLRDQLDSWVDKVHTTLLSVEAETPDLVAA

SEQ ID NO: 9944 - protein, 386 aa, Cleome spinosa
MAALQYLESQRNAHPELGEWYNSLADLYQKKLWHQLTLKLEQFIALAVFQAGDALIQLYNNFITDFETKINLLKLAHFAVVVSRQYPEKEAAISYLEGVIEKLKATKEQRINEPVIYIKMQMALFKLEQGDQKECKKILEDGKSSIDSMTDIDPSVYASYYWVSSQYHKYRQEFSDFYKNALLYLAYTSVESLSESFKLDLAFDLSLSALLGDNIYNFGELLAHPIIKSLLGTNVEWLYHMLQAFNHGDLVQYQELCRVHNASLRAQPALVENEKKLLEKINILCLIEIIFSRPAEDRTIPLTVIAERTKLSVEDVEHLLMKGLSVHLIEGIIDQVEGTVHVSWAQPRVLGIQQIKSLRDRLDNWADKVHTTLLSVEAETPDLVAA

SEQ ID NO: 9945 - protein, 386 aa, Vigna unguiculata
MAALQYLESLRNAHPELAEWYNSLADLYQKKLWHQLTLKLEQFVALAVFQAGDALIQLYHNFITDFETKINLLKLAHFAVIVSRQYSEKEAAVGYLEGVIEKLQATREQRIKEPILYIKMQIAIFKLEQGDQKECKKLLEDGKTTLDSMTDIDPSVYANYYWVSSQYHKTRQEFAEFYKSALLYLAYTSVESLSESFKLDLAFDLSLSALLGDNIYNFGELLAHPIIKSLLGTKVEWLYYILQAFNSGDLVRYQELCRVHNAALRAQPALVQNEQKLLEKINILCLMEIIFSRPSEDRTIPLSVIAERTKLSIENVEHLLMKSLSVHLIEGIIDQVEGTVHVSWVQPRVLGIQQIKSLRDRLDSWTEKVHTALLSIEAETPDLIGS

SEQ ID NO: 9946 - protein, 386 aa, Unknown
  Sequence found in Organisms: Prunus persica, Prunus mume
MAALQYLESLRNAHPELSDWYNSLADLYQKKLWHQLTLKLEQFVALAVFQAGDALIQLYHNFITDFETKINLLKLAHFAVIVSRQYPEKEAAINYLEGVIEKLQATREQRIEEPILYIKMQIAIFKLEQEDQKECKKLLEDGKSTLDSMTDIDPSVYASYYWVSSQYHKFRQEFAEFYKSALLYLAYTSVESLSESFKLDLAFDLSLSALLGDNIYNFGELLAHPIIKSLLGTKVEWLYYILQAFNSGDLVRYQELCRVHNAALRAQPALVENEKKLLEKINILCLMEIIFSRPSEDRTIPLSIIAERTKLSVEDVEHLLVKSLSVHLIEGIIDQVEETVHVSWVQPRVLGIPQIKSLRDRLDGWLDKVHTALLSIEAETPDLVAS

SEQ ID NO: 9947 - protein, 386 aa, Unknown
  Sequence found in Organisms: Citrus clementina, Citrus sinensis
MAALQYLESLRNDHPELGEWYNALADLYQKKLWHQLTLKLEQFVAHAVFQAGDALIQLYHNFITDFETKINLLKLAHFAVIVSRQYPEKQAAISYLEGVIEKLRATNEQRKEEPILYIKMQIAMFKLEQGDRKECKKLLEDGKSTLDSMTDIDPSVYANYYWVSSQYHKFHQEFAEFYKCALLYLAYTSVESLSDSFKLDLAFDLSLSALLGDNIYNFGELLAHPIINSLTGTKVEWLYYILQAFNSGDLVRYQELCRVHNAALRAQPALVENEKKLLEKINILCLMEIIFSRPSEDRTIPLSIIAERTKLSIEDVEHLLMKSLSVHLIEGIIDQVEGTVHVSWVQPRVLGIPQIKSLRDRLDSWLGKVHTALLSIEAETPDLVAS

SEQ ID NO: 9948 - protein, 386 aa, Populus trichocarpa
MAALQYLETLRNAHPELDEWYNSLADLYQKKLWHQLTLKLEQFVALAVFQAGDALIQLYHNFITDFETKINLLKLAHFAVIVSRQYTEKDAAISYLEGVIEKLRATREQRIEEPVLYIKMQIAIFKLEQGDQKECKRLLEDGKSTLDSMTDIDPSVYASYYWVSSQYYKHRQEFSEFYKSALLYLAYTSVESLSDSFKLDLAFDLSLSALLGDNIYNFGELLAHPIIKSLLGTQVEWLYYILQAFNSGDLVRYQELCRVHNAPLKAQPALVQNEPKLLEKINILCLMEIIFSRPSEDRTIPLKVIAERTKLSIEDVEHLLMKSLSVHLIEGIIDQVEGTVHVSWVQPRVLGIPQIKSLRDRLDNWLDKVHTALLSVEAETPDLVAS

SEQ ID NO: 9949 - protein, 238 aa, Cucurbita pepo
MTDIDPSVYASYYWVSSQFYKFRQEFAEFYKSALLYLAYTSVESLSDSFKLDLTFDLSLSALLGDNIYNFGELLAHPIIKSLLGTKVEWLYYILQAFNSGDLVRYQELCQVHNAALRAQPALVENEKKLLEKINILCLMEIIFSRPSEDRTIPLKVIAERTKLSIEDVEHLLMKSLSVHLIEGIIDQVEGTVHVSWVQPRVLGIPQIKSLRDRLDSWVDKVHSTLLSVEAETPDLVAS

SEQ ID NO: 9950 - protein, 386 aa, Malus domestica
MAALQYLESLRNAHPELAEWYNSLADLYQRKLWHQLTLKLEQFVALAVFQAGDALIQLYHNFITDFETKINLLKLAHFAVIVSRQYPEKEAAISYLEGVIEKLQATREQRIEEPILYIKMQIAIFKLEQQDQKECKRLLEDGKTTLDSMTDIDPSVYASYYWVSSQYHKFRQEFAEFYKSALLYLAYTSVESLSESFKLDLAFDLSLSALLGDNIYNFGELLAHPIIKSLLGTKVEWLYYILQAFNSGDLVRYQELCRVHNAALRAQPALVENEKKLLEKINILCLMEIIFSRPSEDRTIPLSIIAERTKLSVEDVEHLLVKSLSVHLIEGIIDQVEETVHVSWVQPRVLGIPQIQSLRDRLDGWLDKVHTALLSIEAETPDLVAS

SEQ ID NO: 9951 - protein, 386 aa, Cajanus cajan
MAALQYLESLRNAHPELADWYNSLADLYQKKLWHQLTLKLEQFVALAVFQAGDALIQLYHNFITDFETKINLLKLAHFAVIVSRQYSEKEAAVGYLGGVIEKLQATREQRIEEPILYIKMQIAIFKLEQGDQKECKKLLEDGKSTLDSMTDIDPSVYASYYWVSSQYHKTRQEFAEFYKSALLYLAYTSVESLSESFKLDLAFDLSLSALLGDNIYNFGELLAHPIIKSLLGTKVEWLYYILQAFNSGDLARYQELCRVHNASLRAQPALVQNEQKLLEKINILCLMEIIFSRPSEDRTIPLSVIAERTKLSIENVEHLLMKSLSVHLIEGIIDQVEGTVHVSWVQPRVLGIQQIKSLRDRLDSWTGKVHTALLSIEAETPDLIGS

SEQ ID NO: 9952 - protein, 387 aa, Castanea mollissima
MAAPLQYLETLRSAHPELGEWYASLADLYQRKLWHQLTAKLEQFVALTVFQAGDALIQLYHNFITDFETKINLLKLAHFAVIVSRQYSEKEAAINYLEGVIEKLQATREQRIEEPILYIKMQIAIFKLEQGDQKECKKLLEDGKSTLDSMTDIDPTVYANYYWVSSQYYKFRQEFAEFYKSALLYLAYTSVESLSDSFKLDLAFDLSLSALLGDNIYNFGELLAHPIIKSLLGTKVEWLYYILQAFNSGDLVRYQELCHVHNAALRAQPALVENEKKLLEKINILCLMEIIFSRPSEDRTIPLSIIAERTKLSIEDVEHLLMKSLSVHLIEGIIDQVEGTVHVSWVQPRVLGVPQIKSLRDRLDNWLDKVHTALLSVEAETPDLVAS

SEQ ID NO: 9953 - protein, 387 aa, Quercus alba
MAAPLQYLETLRSAHPELGEWYASLADLYQRKLWHQLTAKLEQFVALTVFQAGDALIQLYHNFITDFETKINLLKLAHFAVIVSRQYSEKEAAIKYLEGVIEKLHATREQRIEEPILYIKMQIAIFKLEQGDQKECKKLLEDGKSTLDSMTDIDPSVYASYYWVSSQYYKFRQEFAEFYKSALLYLAYTSVESLSDSFKLDLAFDLSLSALLGDNIYNFGELLAHPIIKSLLGTKVEWLYYILQAFNSGDLVRYQELCHVHNAALRAQPALVENEKKLLEKINILCLMEIIFSRPSEDRTIPLSIIAERTKLSIEDVEHLLMKSLSVHLIEGIIDQVEGTVHVSWVQPRVLGVPQIKSLRDRLDNWLDKVHTALLSVEAETPDLVAS

SEQ ID NO: 9954 - protein, 386 aa, Unknown
  Sequence found in Organisms: Gossypium hirsutum, Gossypium raimondii
MAALQYLESLRNEHPELADWYSSLADLYQKKLWHQLTLKLEQFVALTVFQAGDALIQLYHNFITDFETKINLLKLAHFAVIVSRQYSDKEASTSYLEGVIEKLQATKEQRIEEPIIYIKMQIAKFKLEQGDQKECKKLLDDGKSTLDSMTDIDPSVYASYYWVSSQYHKFRQEFADFYRSALLYLAYTSVASLSESFKLDLAFDLSLSALLGDNIYNFGELLAHPIITSLLGTRVEWLYHILQAFNSGDLARYQELCHVHNAALRAQPALVENEKKLSEKINILCLMEIIFSRPSEDRTIPLKVIAERTKLSIEDVEHLLMKSLSVHLIEGTIDQVEGTVHVSWVQPRVLGIPQIKSLRDRLDNWVGKVQTAWLSIEAETPDLVAA

SEQ ID NO: 9955 - protein, 386 aa, Cucurbita pepo
MAALQYLDSLRISHPELAEWYNSLADLYQKKLWHQLTLKLEQFVALTVFQAGDALIQLYHNFITDFETKINLLKLAHFAVIVSRQYAEKEAAISYLEGIIEKLRSTKEQRIEEPILYIKMQIAVFKLEQGDRKECKKLLEDGKSTLDSMTDIDPSVYASYYWVSSQFYKFRQEFAEFYKSALLYLAYTSVESLSDSFKLDLAFDLSLSALLGDNIYNFGELLAHPIIKSLLGTKVEWLYYILQAFNAGDLVRYQELCQVHNAALRAQPALVENEKKLLEKINILCLMEIIFSRPSEDRTIPLKVIAERTKLSIEDVEHLLMKSLSVHLIEGIIDQVEGTVHVSWVQPRVLGIQQIKSLRDRLDNWVDKVHSTLLSVEAETPDLVAS

SEQ ID NO: 9956 - protein, 386 aa, Gossypium raimondii
MAALQYLESLRNEHPELADWYSSLADLYQKKLWHQLTLKLEQFVALTVFQAGDALIQLYHNFITDFETKINLLKLAHFAVIVSRQYSDKEASTSYLEGVIEKLQATKEQRIEEPIIYIKMQIAKFKLEQGDQKECKKLLDDGKSTLDSMTDIDPSVYASYYWVSSQYHKFRQEFADFYRSALLYLAYTSVASLSESFKLDLAFDLSLSALLGDDIYNFGELLAHPIITSLLGTRVEWLYHILQAFNSGDLARYQELCHVHNAALRAQPALVENEKKLSEKINILCLMEIIFSRPSEDRTIPLKVIAERTKLSIEDVEHLLMKSLSVHLIEGTIDQVEGTVHVSWVQPRVLGIPQIKSLRDRLDNWVGKVQTAWLSIEAETPDLVAA

SEQ ID NO: 9957 - protein, 386 aa, Ricinus communis
MAALQYLESLRNAHPELAEWYNSLADLYQKKLWHQLTLKLEQFVALAVFQAGDALIQLYHNFISDFETKINLLKLAHFAVIVSRQYKEKEAAISYLQGVIEKLIATRELRIDEPILYIKMQLAILKLEQGDQKECKKLLEDGKSTLDSMTDIDPSVYASYYWVSSQYHKYRQEFAEFYKSSLLYLAYTSVESLSDSFKLDLAFDLSLSALLGDNIYNFGELLAHPIIKSLLGTQVEWLYYILQAFNSGDLVRYQELCRVHNASLRAQPALVENEQKLLEKINILCLMEIIFSRPSEDRTIPLTIIAERTKLSVEDVEHLLMKSLSVHLIEGIIDQVEGTVHVSWVQPRVLGIPQIKSLRDRLDNWLEKVHTALVSIESETPDLVAL

SEQ ID NO: 9958 - protein, 386 aa, Euonymus alatus
MAALQYLETLRDAHPELSEWYNSLADLYEKKLWHQLALKLEQFVALSVFQAGDALIQLYHNFITDFETKINLLKLAHFAVIVSRQYPEKEAAISYLEGVIEKLRATKESRIEEPIIYIKMQIALLKLEQGDQKECKKLLEEGKSALDSMTDIDPSVYASFYWVSSQYHKYRQEFAEFYKSALLYLAYTSVESLSDSFKLDLAFDLSLSALLGDNIYNFGELLAHPIIKCLLGTKVEWLYHILLAFNSGDLFRYQELCRVHNAALSAQPALVENEKKLLEKINILCLMEIIFSRPSEDRTIPLTAIAERTKLSIEDVEHLLMKSLSVHLIEGIIDQVEGTVHVSWVQPRVLGVQQITSLRDWLDNWLDKVHTALLSIEAETPDLVAS

SEQ ID NO: 9959 - protein, 386 aa, Flaveria ramosissima
MAALQYLDSLRNTHPELSDWYNTLADLYQRKLWHQLTLKLEQFVALAVFQAGDALIQLYHNFITDFETKINLLKLAHFAVIVSRQYSEKEAAISYLEGVIEKLRATKEMRIEEPIVYIKMQIALFNLEKGDQKECKNLLEDGKSTLDSMTDIDPSVYANYYWVSSQYHKSRQEFAEFYKNSLLYLAYTSVESLSDSFKLDLAFDLSLSALLGDNIYNFGELLAHPIIKSLIGTKVEWLYYILEAFNAGDLVRYQELCRVHAASLNAQPALVENEKKLLEKINILCLMEIIFSRPSEDRTIPLNIIAERTKLTVEDVEYLLMKSLSVHLIEGIIDQVEGTVYVSWVQPRVLGISQIKSLRDRLDNWVGKVHTALVSVEAETPDLVAS

SEQ ID NO: 9960 - protein, 386 aa, Flaveria ramosissima
MSALQYLDSLRNTHPELSDWYNTLADLYQRKLWHQLTLKLEQFVALAVFQAGDALIQLYHNFITDFETKINLLKLAHFAVIVSRQYAEKEAAISYLEGVIEKLRATKEMRIEEPIVYIKMQIAIFNLEKGDQKECKNILDDGKSTLDSMTDIDPSVYANYYWVTSQYHKARQEFAEFYKNSLLYLAYTSVESLSDSFKLDLAFDLSLSALLGDNIYNFGELLAHPIIKSLLGTQVEWLYYILEAFNNGDLVRYQELCRVHAASLNAQPALVENEKKLLEKINILCLMEIIFSRPSEDRTIPLSIIAERTKLTVEDVEYLLMKSLSVHLIEGIIDQVEGTVYVSWVQPRVLGISQIKSLRDRLDNWVGKVHTALVSVEAETPDLVAS

SEQ ID NO: 9961 - protein, 384 aa, Flaveria ramosissima
MAALQYLDSLRTTHPELSDWYNTLADLYQRKLWHQLTLKLEQFVALAVFQAGDALIQLYHNFITDFETKINLLKLAHFAVIVSRQYSEKEAAISYLEGVIEKLRATKEMRIEEPIVYIKMQIALFNLEKGDQKECKNLLEDGKSTLDSMTDIDPSVYANYYWVSSQYHKSRQEFAEFYKNSLLYLAYTSVESLSDSFKLDLAFDLSLSALLGDNIYNFGELLAHPIIKSLLGTKVEWLYYILEAFNAGDLVRYQELCRVHAASLNAQPALVENEKKLLEKINILCLMEIIFSRPSEDRTIPLSIIAERTKLTVEDVEYLLMKSLSVHLIEGIIDQVEGTVYVSWVQPRVLGISQIKSLRDRLDNWVGKVHTALVSVEAETPDLV

SEQ ID NO: 9962 - protein, 386 aa, Tripterygium wilfordii
MAALQYLETLRSAHPELSEWYNSLADLYEKKLWHQLTLKLEQFVALSVFQAGDALIQLYHNFITDFETKINLLKLAHFAVIVSRQYPEKEAAISYLEGVIEKLRATKESRIEEPILYIKMQIALLKLEQGDQKECKKLLDEGKSALDTMTDIDPSVYASFYWVSSQYHKYRQEFTEFYKSALLYLAYTSVESLSDSFKLDLAFDLSLSALLGDNIYNFGELLAHPIIKSLLGTKVEWLYHILLAFNSGDLVRYQELCRVHNAALSAQPALVENEKKLLEKINILCLMEIIFSRPSEDRTIPLTVIADRTKLSIEDVEQLLMKSLSVHLIEGIIDQVVGTVHVSWVQPRVLGVQQITSLRDRLDNWLDKVHTALLSIEAETPDLVAS

SEQ ID NO: 9963 - protein, 386 aa, Theobroma cacao
MAALEYLETLRNEHPELADWYNSLADLYQKKLWHQLTLKLEQFVALTVFQAGDALIQLYHNFITDFETKINLLKLAHFAVIVSRQYAEKEAAICYLEGVIEKLQATREQRIEEPILYIKMQIAKFKLEQGDQKECKKLLEDGKSTLDSMTDIDPSVYASYYWVSSQYYKFRQEFAEFYKSALLYLAYTSVESLSESFKLDLAFDLSLSALLGDKIYNFGELLAHPIIKSLLGTKVEWLYYILQAFNSGDLVRYQELCRVHNAALRAQPALVENEKKLLEKINILCLMEIIFSRPSEDRTIPLKVIAERTKLSIEDVEHLIMKSLSVHLIEGIIDQVEGTVHVSWVQPRVLGIPQIKSLRDRLDNWVGKVHTAWLSIEAETPDLVAS

SEQ ID NO: 9964 - protein, 386 aa, Unknown
  Sequence found in Organisms: Centaurea maculosa, Cirsium arvense
MAALQYLDSLRTTHPELSDWYNTLADLYQRKLWHQLTLKLEQFVALAVFQAGDALIQLYHNFITDFETKINLLKLAHFAVTVSRQYSEKEAAISYLEGVIEKLRATKEMRIEEPILYIKMQIAVFNLEKGDQKECKNLLDDGKSTLDSMTDIDPSVYANYYWVSSQYHKSRQEFAEFYKSSLLYLAYTSVESLSDAFKLDLAFDLSLSALLGDNIYNFGELLAHPIIKSLLGTKVEWLYYILEAFNSGDLVRYQELCRVHAASLNAQPALVENEKKLLEKINILCLMEIIFSRPSEERTIPLSIIAERTKLTVEDVEYLLMKSLSVHLIEGIIDQVDGTVYISWVQPRVLGIAQIKSLRDRLDNWVGKVHTALISVEAETPDLVAS

SEQ ID NO: 9965 - protein, 386 aa, Phaseolus vulgaris
MAALQYLESLRNAHPELAEWYNSLADLYQKKLWHQLTLKLEQFVALAVFQAGDALIQLYHNFITDFETKINLLKLAHFAVIVSRQYSEKEAAVAYLGGVIEKLEATREQRIEEPILYIKMQIAIFKLEQGDQKESKKLLEDGKTTLDSMTDIDPSVYANYFWVSSQFHKTRQEFAEFYKSALLYLAYTSVESLSESFKLDLAFDLSLSALLGDNIYNFGELLAHPIIKSLLGTKVEWLYYILQAFNSGDLERYQELCRVHNAALRAQPALVQNEKKLLEKINILCLMEIIFSRPSEDRTIPLSVIAERTKLSIENVEHLLMKSLSVHLIEGIIDEVEGTVHVSWVQPRVLGIQQIKSLRDRLDSWTGKVHTALLSIEAETPDLIGS

SEQ ID NO: 9966 - protein, 386 aa, Manihot esculenta
MAALQYLESLRNAHPEHAEWYNSLADLYQKKLWHQLTLKLEQFVAFAVVQAGDTLIQLYHNFISDFETKINLLKLAHFAVIVSKQYKEKDAAVSYLEGVIEKLRTTKEQHIEEPILYIKMQLAIFKLEQGDQKECKKLLEDGKSTLDSMTDIDPTVYANYYWVSSQYHKYRQEFAEFYKSALLYLAYTSVESLSEPFKLDLAFDLSLSALLGDNIYNFGELLAHPVINSLLGTQVEWLYYILQAFNSGDLVRYQELCRVHNASLRSQPALVENEQKLLEKINILCLMEIIFSRPSEDRTIPLSVIAERTKLSIEDVEHLLMKSLSVHLIEGIIDQVEGTVHVSWVQPRVLGIPQIKSLRDRLDNWLDKVHTALLSIEAETPDLVAS

SEQ ID NO: 9967 - protein, 386 aa, Cucumis melo
MAALQYLDSLRNSHPELAEWYNTLADLYQKKLWHQLTLKLEQFVALTVFQAGDALIQLYHNFITDFETKINLLKLAHFAVIVSRQYAEKEAAISYLEGIIEKLRSTKEQRIEEPILYIKMQIAIFKLEQGDRKECKKLLEDGKSTLDSMTDIDPSVYASYYWVSSQFYKFRQEFAEFYKSALLYLAYTSVESLSDSFKLDLAFDLSLSALLGDNIYNFGELLGHPIIKSLLGTKVEWLYYILQAFNSGDLVRYQELCQVHNAALRAQPALVENEKKLLEKINILCLMEIIFSRPSEDRTIPLKVIAERTKLSIEDVEHLLMKSLSVHLIEGIIDQVEETVHVSWVQPRVLGIQQIKSLRDRLDNWVDKVHSTLLSVEAETPDLVAS

SEQ ID NO: 9968 - protein, 386 aa, Fragaria vesca
MAALQYLESSRNAHPELAEWYNSLADLYQKKLWHQLTLKLEQFVALAVFQAGDALIQLYHNFITDFETKINLLKLAHFAVIVSRQYPEKEAAINYLEGVIEKLHTTREQRIEEPILYIKMQIAIFKLEQQDQKECKKLLEDGKSTLDNMTDIDPSVYASYYWVSSQYYKFRQEFAEFYKSALLYLAYTSVESLSDSFKLDLAFDLSLSALLGDNIYNFGELLAHPIIKSLLGTKVEWLYYILQAFNSGDLGCYQELCRVHNAALSAQPALVENEKKLLEKINILCLMEIIFSRPSEDRTIPLSIIAERTKLSIEDVEHLLVKSLSVHLIEGIIDQVEGTVHVSWVQPRVLGVPQIKSVRDRLDGWLDKVHTALLSIEAETPDLVAS

SEQ ID NO: 9969 - protein, 386 aa, Tripterygium wilfordii
MAALQYLESLRNTHPELSEWYNSLADLYEKKLWHQLTLKLEQFVALAVFQAGDALIQLYNNFITYFETKINLLKLAHFAVVVSRQYPDKDAAISYLEGVIEKLRVTKENRIEEPILYIKMQIALFKLEQGDQKECKRLLEEGKSALDSMTDIDPSVYASFYWVSCQYHKYRQEFAEFYRSALLYLAYTSVESLSDSFKLDLAFDLSLSALLGDNIYNFGELLAHPIIKSLLGTKVEWLYHNLLAFNSGDLVRYQELCRVHNAALSAQPALVENEKKLLEKINILCLMEIIFSRPSEDRTIPLTAIAERTKLSIEDVEHLLMKSLSVHLIEGIIDQVEGTVHVSWVQPRVLGVQQITSLRDRLDNWLDKVHTALLSIEAETPDLVAS

SEQ ID NO: 9970 - protein, 386 aa, Phaseolus vulgaris
MAALQYLESLRNSQPELAEWYNSLADLYQKKLWHQLTLKLEQFVALAVFQAGDALIQLYHNFITDFETKINLLKLAHFAVIVSRQYSEKEAAIGYLGAVIEKLQATREQRIEEPILYIKMQIAIFKLEQGDQKESKKLLEDGKTTLDSMTDIDPSVYANYYWVSSQFHKTRQEFAEFYKSALLYLAYTSVESLSESFKLDLAFDLSLSALLGDNIYNFGELLAHPIIKSLLGTKVEWLYYILQAFNSGDLVRYQELCRVHNAALRAQPALVQNEQKLLEKINILCLMEIIFSRPSEDRTIPLNVIAERTKLSIENVEHLLMKSLSVHLIEGIIDQVEGTVHVSWVQPRVLGIQQIKSLRDRLDSWTGKVHTALLSIEAETPDLIGS

SEQ ID NO: 9971 - protein, 385 aa, Cannabis sativa
MAALQYLESLRSAHPELGDWYNSLADLYQKKLWHQLTLKLEEFVALAVFQAGDALIQLYNNFITDFETKINLLKLAHFAVIVSRQYPEKETAIGYLEGVIEKLRATREQRIEEPVLYIKMQIAIFKLEQDQKECKNLLEDGKSTLDSMTDIDPSVYAIYYWVSSQYHKFRQEFAEFYKSALLYLAYTSVESLSESFKLDLAFDLSLSALLGDNIYNFGELLAHPIIKSLLGTKVEWLYYILQAFNTGDLVRYQELCRVHNSALSAQPALVENEKKLVEKINILCLMEIIFSRSSDDRTIPLSIIAERTKLSIEDVEHLLMKSLSVHLIEGIIDQVDGTVHVSWVQPRVLGIPQIKSLRDRLDNWLDKVHTALVSIEAETPDLVAS

SEQ ID NO: 9972 - protein, 386 aa, Cirsium arvense
MAALQYLDSLRSTHPELSDWYNTLADLYQRKLWHQLTLKLEQFVALAVFQAGDALIQLYHNFITDFETKINLLKLAHFAVTVSRQYAEKEAAISYLEGVIEKLRATKEMRIEEPILYIKMQIAVFNLEKGDQKECKNLLDDGKSTLDSMTDIDPSVYANYYWVSSQYHKSRQEFAEFYKSSLLYLAYTSVESLSDSFKLDLAFDLSLSALLGDNIYNFGELLAHPIIKSLIGTKVEWLYYILEAFNSGDLVRYQELCRVHSASLNAQPALVENEKKLLEKINILCLMEIIFSRPSEERTIPLSIIAERTKLTVEDVEYLLMKSLSVHLIEGIIDQVDGTVYISWVQPRVLGITQIKSLRDRLDNWVGKVHTALISVEAETPDLVAS

SEQ ID NO: 9973 - protein, 385 aa, Humulus lupulus
MAALQYLESLRSTHPELGDWYNSLADLYQKKLWHQLTLKLEEFVALAVFQAGDALIQLYHNFITDFETKINLLKLAHFAVIVSRQYPEKEAAIGYLEGVIEKLRATQEQRIEEPVLYIKMQIAIFKLEQDQKECKILLEDGKTTIDSMTDIDPSVYAIYYWVSSQYHKFRQEFAEFYKSALLYLAYTSVESLSESFKLDLAFDLSLSALLGDNIYNFGELLAHPIIKSLLGTKVEWLYYILQAFNAGDLVRYQELCRVHNAALRAQPALVENEKKLLEKINILCLMEIIFSRSSDDRTITLSIIADRTKLSIENVEHLLMKSLSVHLIEGIIDQVDGTVHVSWVQPRVLGIPQIKSLRDRLDNWLDKVHTALVSIEAETPDLVAS

SEQ ID NO: 9974 - protein, 386 aa, Populus trichocarpa
MAALQYLETQRNAHPELDEWYNSLADLYQKKLWHQLTLKLEQFVALAVFQAGDALIQFYHNFITDFETKINLLKLAHFAVIVSRRYAEKEAAISYLEGVIEKLRATREQRIEEPVLYIKMQIAIFKLEQGDQKECKKLLEDGKSTLDSMTDIDPSVYASYYWVSSQNYKHRQEFAEFYKSALLYLAYTAVESLSDSFKLDLAFDLSLSALLGDNIYNFGELLAHPIIKSLLGTQVEWLYYILQAFNSGDLVRYQELCRVHNTALRAQPALVQNEQKLLEKINILCLMEIIFSRPSENRTIPLNVIAERTKLSIEDVEHLLIKSLSVHLIEGIIDQVEGTVHVSWVQPRVLGIPQIKSLRDRLDNWLDKVHTALLSVEAETPDLVAS

SEQ ID NO: 9975 - protein, 386 aa, Tragopogon dubius
MAALQYLDSLRTTHPELSDWYNTLADLYQRKLWHQLTLKLEQFVALAVFQAGDALIQLYHNFITDFETKINLLKLAHFAVIVSRQYSEKEAAISYLEGIIEKLRATKEMRIEEPILYIKMQIAIFNLEKGDQKECKNLLEDGKSTLDSMTDIDPSVYANYYWVSSQYHKSRQEFAEFYKNSLLYLAYTSVESLSDSFKLDLAFDLSLSALLGDNIYNFGELLAHPIIKSLLGTKVEWLYHILEAFNSGDLVRYQELCRVHSASLNAQPALVENEKKLLEKINILCLMEIIFSRPSEDRTIPLSIVAERTKLTVEDVEYLLMKSLSVHLIEGIIDQVEGTVYVSWVQPRVLGVAQIKSLRDRLDNWVGKVHTALISVEAETPDLVAS

SEQ ID NO: 9976 - protein, 386 aa, Tragopogon dubius
MAALQYLDSLRSTHPELSDWYNTLADLYQRKLWHQLTLKLEQFVALAVFQAGDALIQLYHNFITDFETKINLLKLAHFAVIVSRQYSEKEAAISYLDGVIEKLRATKETRIEEPVLYIKMQIAIFNLEKGDQKECKNLLEDGKSTLDSMTDIDPSVYANYYWVSSQYHKSRQEFAEFYKSALLYLAYTSVESLSDSFKLDLAFDLSLSALLGENVYNFGELLAHPIVKSLLGTKVEWLYYILEAFNSGDLVKYQELCRVHGASLSAQPALLENEKKLLEKINILCLMEIIFSRPSEDRTIPLSIIAEQTKLRVEDVEYLVMKSLSVHLIEGIIDQVDGTVYVSWVQPRVLGISQIKSLRDRLDSWVGKVHTALISVEAETPDLVAS

SEQ ID NO: 9977 - protein, 226 aa, Lippia dulcis
MAALQYLESLRNAHPELSEWYNTLSDLYQRKLWHQLTLKLEQFVAHAVFQAGDALIQLYNNFITDFETKINLLKLAHFAVIVSRQYSEKEAAINYLEGVIEKLRNTKETRIEEPILYIKMQIGIFKLEQGDQKECKNLLDEGKSTLDSMTDIDPSVYANYYWVSSQYHKSRQEFAEFYRSALLYLAYTSVESLSDSFKLDLAFDLSLSALLGRTSTTLVNCLLIQL

SEQ ID NO: 9978 - protein, 386 aa, Centaurea maculosa
MAALEYLDSLRTTHPELSDWYNTLADLYQRKLWHQLTLKLEQFVALTVFQAGDALIQLYHNFITDFETKINLLKLAHFAVIVSRQYSEKEAAISYLEGVIEKLRATKEARIEEPVLYIKMQIAIFNLEKGDQKECKNLLEDGKSTLDSMTDIDPSVYSNYYWVSSQYHKARQEFAEFYKSALLYLAYTSVESLSDSFKLDLAFDLSLSALLGENVYNFGELLAHPIIKSLLGTKVEWLYYILEAFNSGDLIRYQELCRVHGASLSAQPALVDNEKKLLEKINILCLMEIIFSRPSEERTIPLSIIAERTNLTVEDVEHLLMKSLSVHLIEGIIDQVDGTVYVSWVQPRVLGIPQIKSLRDRLDGWVGKVHTALLSVEAETPDLVAS

SEQ ID NO: 9979 - protein, 386 aa, Echinacea purpurea
MSALQYLDSLRNTHPELSDWYNTLADLYQRKLWHQLTLKLEQFVALAVFQAGDALIQLYHNFITDFETKINLLKLAHFAVIVSRQYSEKEAAINYLEGVIEKLRATKESRIEEPIVYIKMQIAIFKLEKGDQKECKTLLEDGKSTLDSMTDIDPSVYANYYWVTSQYHKARQEFAEFYKSSLLYLAYTSVESLSDSFKLDLAFDLSLSALLGDNIYNFGELLAHPIIKSLLGTQVEWLYYILEAFNNGDLVRYQELCRVHADSLNAQPALVENEKKLLEKINILCLMEIIFSRPSGDRTIPLSIIAERTKLTVEDVEYLLMKSLSVHLIEGIIDQVEGTVYVSWVQPRVLGISQIKSLRDRLDNWVEKVHTALVSVEAETPDLVVS

SEQ ID NO: 9980 - protein, 386 aa, Panax ginseng
MAALQYLDSLRNSHPELSDWYNTLADLYQRKLWHQLTLKLEQFVALAVFQAGDALIQLYHNFITDFETKINLLKLAHFAVIVSRKYSEKEAAISYLEGVIEKLRATREMRIEEPVLYIKMQIAMFNLEKGDQKECKKLLEDGKTTLDSMTDIDPSVYASYYWNSSQYHKSRQEFAEFYKSALLYLAYTSVESLSESFKLDLAFDLSLSALLGENIYNFGELLAHPIIKSLLGTKVEWLYYILEAFNSGDLVRYQELCHVHSASLSAQPALVENERKLLEKINILCLMEIIFSRPSEDRTIPLSIIAERTKLTVEDVEYLLMKSLSVHLIEGIIDQVEGTVHVSWVQPRVLGISQIKSLRDRLDNWMDKVHTALLSVEAETPDLVAS

SEQ ID NO: 9981 - protein, 386 aa, Artemisia annua
MAALEYLESLRTSHPELSEWYTTLADLYQRKLWHQLTLKLEQFVALAVFQAGDALIQLYHNFITDFETKINLLKLAHFAVIVSRQYSEKEAAISYLEGVIEKLRATKESRIEEPILYIKMQIAVFNLEKGDQKGCKNLLEDGKTTLDSMTDIDPSVYANYYWVSSQYHKSRQEFAEFYKSALLYLAYTSVESLSDSFKLDLAFDLSLSALLGENVYNFGELLAHPIVKSLLGTKVEWLYYILEAFNAGDLVRYQELCRVHGASLSAQPALVANEQKLLEKINILCLMEIIFSRPSEERTIPLSIIAERTKLKVEDVEYLLMKSLSVHLIEGIIDQVDGTVYVSWVQPRVLGIPQIKSLRDRLDGWVGKVHTALTSVEAETPDLVAS

SEQ ID NO: 9982 - protein, 386 aa, Manihot esculenta
MAALQYLESLRNAHPEHAEWYNSLADLYQKKLWHQLTLKLEQFVAFAVVQAGDTLIQLYHNFISDFETKINLLKLAHFAVIVSKQYKEKDAAISYLEGVIEKLRETREQRNEEPILYIKMQLAIFKLEQGDQKECKKLLEDGKSTLDSMTDIDPSVYANYYWVSSQYHKFRQEFAEFYKNALLYLAYTSVESLSEPFKLDLAFDLSLSALLGDNIYNFGELLAHPIINSLLGTQVEWLYHILQAFNTGDLVRFQELCRVYNASLRAQPALVENEQKLLEKINILCLMEIIFSRPSEDRTIPLSVIAERTKLSIEDVEHLLMKSLSVHLIEGIIDQVEGTVHVSWVQPRVLGIPQIKSLRDRLDNWLEKVHTALLSIEAETPDLVAL

SEQ ID NO: 9983 - protein, 386 aa, Centaurea maculosa
MAALEYLDSLRTTHPELSEWYNTLADLYQRKLWHQLTLKLEQFVALTVFQAGDALIQLYHNFITDFETKINLLKLAHFAVIVSRQYSEKETAISYLDGVIEKLRATKETRIEEPILYIKMQIAIFNLEKGDQKECKNLLEDGKSTLDSMTDIDPSVYSNYYWVSSQYHKARQEFAEFYKSALLYLAYTSVESLSDSFKLDLAFDLSLSALLGENVYNFGELLAHPIIKSLLGTKVEWLYYILEAFNSGDLIRYQELCRVHGASLSAQPALVANEKKLLEKINILCLMEIIFSRPSEERTIPLSIIAERTNLTVEDVEHLLMKSLSVHLIEGIIDQVDGTVYVSWVQPRVLGIPQIKSLRDRLDGWVGKVHTALLSVEAETPDLVAS

SEQ ID NO: 9984 - protein, 418 aa, Centaurea maculosa
  misc_feature (6)..(6): Xaa can be any naturally occurring amino acid
  misc_feature (387)..(387): Xaa can be any naturally occurring amino acid
  misc_feature (417)..(417): Xaa can be any naturally occurring amino acid
MAALEXLDSLRTTHPELSEWYNTLADLYQRKLWHQLTLKLEQFVALTVFQAGDALIQLYHNFITDFETKINLLKLAHFAVIVSRQYSEKEAAISYLDGVIEKLRATKETRIEEPILYIKMQIAIFNLEKGDQKECKNLLEDGKSTLDSMTDIDPSVYSNYYWVSSQYHKARQEFAEFYKSALLYLAYTSVESLSDSFKLDLAFDLSLSALLGENVYNFGELLAHPIIKSLLGTKVEWLYYILEAFNSGDLIRYQELCRVHGASLSAQPALVDNEKKLLEKINILCLMEIIFSRPSEERTIPLSIIAERTNLTVEDVEHLLMKSLSVHLIEGIIDQVDGTVYVSWVQPRVLGIPQIKSLRDRLDGWVGKVHTALLSVEAETPDLVASXVFVCLFPSIPVTNYFWKPKEERAPKQNELXD

SEQ ID NO: 9985 - protein, 386 aa, Cirsium arvense
MAALEYLDSLRTTHPELSDWYNTLADLYQRKLWHQLTLKLEQFVALTVFQAGDALIQLYHNFITDFETKINLLKLAHFAVIVSRQYSEKEAAISYLDGVIEKLRATKETRIEEPILYIKMQIAIFNLEKGDQKECKNLLEDGKSTLDSMTDIDPSVYSNYYWVSSQYHKARQEFAEFYKSALLYLAYTSVESLSDSFKLDLAFDLSLSALLGENVYNFGELLAHPIIKSLLGTKVEWLYYILEAFNSGDLIRYQELCRVHGASLSAQPALVANEKKLLEKINILCLMEIIFSRPSEERTIPLSIIAERTNLTVEDVEHLLMKSLSVHLIEGIIDQVDGTVYVSWVQPRVLGIPQIKSLRDRLDGWVGKVHTALLSVEAETPDLVAS

SEQ ID NO: 9986 - protein, 386 aa, Mimulus guttatus
MAALQYLETLRNAHPELSEWYTTLSDLYQRKLWHQLTLKLEQFAALAVFQAGDALIQLYHNFITDFETKINLLKLAHFAVIVSRQYSEKVAAIAYLEEVIEKLRNTREARIEEPILYIKMQIGVFKLEQGDQKECKKLLDEGKSTLDSMTDIDPSVYANYYWVSSQYHKTRQEFADFYRSALLYLAYTSVESLSDSFKLDLAFDLSLSALLGENIYNFGELLAHPIIKSLLGTKVEWLYYILEAFNSGDLVRYQELCRVHGAALSTQPALVQNEKRLLEKINILCLMEIIFSRPSDERTIPLSIISERTKLTVEDVEYLLMKSLSVHLIEGIIDQVEGTVYVSWVQPRVLGIPQIKSLRDRLDNWVDKVHTALLSVEAETPDLVAA

SEQ ID NO: 9987 - protein, 386 aa, Carthamus tinctorius
MAALQYLDSLRSTHPELSDWYNTLADLYQRKLWHQLTLKLEQFVALTVFQAGDALIQLYHNFITDFETKINLLKLAHFAVIVSRQYSEKEAAISYLEGVIEKLRATKEMRIEEPVLYIKMQIAIFNLEKGDQKECKNLLEDGKSTLDSMTDIDPSVYSNYYWVSSQYHKARQEFAEFYKSALLYLAYTSVESLSDSFKLDLAFDLSLSALLGENVYNFGELLAHPIIKSLLGTKVEWLYYILEAFNSGDLIRYQELCRVHGASLSAQPALVDNEKKLLEKINILCLMEIIFSRPSEERTIPLSIIAERTNLAVEDVEHLLMKSLSVHLIEGIIDQVDGTVYVSWVQPRVLGIPQIKSLRDRLDGWVGKVHTALISVEAETPDLVAS

SEQ ID NO: 9988 - protein, 386 aa, Glycine max
MAALQYLESLRNSHPELSDWYNSLADLYQKKLWHQLTLKLEQFVALAVFQAGDALIQLYHNFITDFETKINLLKLAHFAVIVSRQYSEKEAAVGYLGGVIQKLQDTREQRIEEPILYIKMQIAIFKLEQGDQKECKKLLEDGKSTLDSMTDIDPSVYASYYWVSSQFHKTCQEFAEFYKSALLYLAYTSVESLSDSFKLDLAFDLSLSALLGDNIYNFGELLAHPIIKSLLGTKVEWLYYILQAFNSGDLVRYQELCRVHNAALRAQPALVQNEQKLLEKINILCLMEIIFSRPSEDRTIPLSVIAERTKLSIENVEHLLMKSLSVHLIEGIIDQVEGTVHVSWVQPRVLGIQQIKSLRDRLDSWTGKVHTALLSIEAETPDLIGS

SEQ ID NO: 9989 - protein, 386 aa, Helianthus annuus
MAALQYLDSLRTTHPELSDWYNTLADLYQRKLWHQLTLKLEQFVALAVFQAGDALIQLYNNFITDFETKINLLKLAHFAVIVSRQYSEKDAAISYLNGVIEKLRATKETRIEEPVLYIKMQIAMYNLEKGDQKECKKLLDDGKSTLDSMTDIDPSVYANYYWVSSQYHKSCQEFAEFYKSALLYLAYTSVESLSDSFKLDLAFDLSLSALLGENVYNFGELLAHPIVKSLLGTKVEWLYYILEAFNSGDLVRYQELCRVHNASLTAQPALVENEKKLLEKINILCLMEIIFSRPSEDRTIPLGVIAERTKLTVEDVEYLLMKSLSVHLIEGIIDQVDGTVYVSWVQPRVLGISQIKSLRDRLDGWVGKVHTALVSVEAETPDLVAT

SEQ ID NO: 9990 - protein, 386 aa, Panax ginseng
MAALQYLDSLRNSHPELSDWYNTLADLYQRKLWHQLTLKLEQFVALAVFQAGDALIQLYHNFITDFETKINLLKLAHFAVIVSRQYSEKEAANSYLEGVIEKLRATREMRIEEPVLYIKMQIAMFNLEKGDQKECKKLLEDGKTTLDSMTDIDPSVYASYYWNSSQYHKSRQEFAEFYKSALLYLAYTSVESLSESFKLDLAFDLSLSALLGENIYNFGELLAHPIIKSLLGTKVEWLYYILEAFNSGDLVRYQELCHVHSAALSAQPALVENERKLLEKINILCLMEIIFSRPSEDRTIPLSIIAERTKLTVEDVEYLLMKSLSVHLIEGIIDQVEGTVHVSWVQPRVLGISQIKSLRDRLDNWMDKVNTALLSVEAETPDLVAS

SEQ ID NO: 9991 - protein, 386 aa, Gossypium raimondii
MAALQYLDSLRNEHPELSDWYSSLADLYQKKLWHQLTLKLDQFVALTFFQAGDALIKLYHNFITDFETKINLLKLAHFAVIVSRQYSEKEAAISYLEGVIEKLRATKEKRIEEPILYIEMQVAKFKLELGDQKECKKLLEDGKSTLDSMDGVDPSVYASYYWVSSQYHKFRQEFAEFYKSALLYLGYTSVDSLSESFKLDLAFDLSLSALLGDNIYNFGELLAHPIVKSLLGTSVEWLYYILLAFNSGDLVHYQELCRIHNAALRTQPALVENEKRLLEKINVLCLMEIIFSRPAEDRTIPLKVIAERTKLSIEDVEHLLMKSLSVHLIEGIIDQVKGTAYISWVQPRVLGIPQIKSLRDRLDSWVGKVHTACLSIEAETPDLVAP

SEQ ID NO: 9992 - protein, 386 aa, Euphorbia peplus
MAALEYLDTLRNEHPELGEWYNSLADLYQRKLWHQLTLKLEQFVALAVFQAGDALIQLYHNFICDFETKINLLKLAHFAVIVSRQYKEKEAAIQYLEGVIDKLRATREQRIEEPVLYIKMQLAILKLEHGDQKECKTLLEDGKSTLDSMTDIDPSVYASFYWVSSQFHKYRQEFAEFYKSALLYLAYTSVESLSDSFKLDLAFDLSLSALLGDNIYNFGELLAHPILKSLLGTPVEWLYYILQAFNVGDLVRYQELCRVHNTSLRAQPALVENEQKLLEKINILCLMEIIFSRPSEDRTIPLSVIAERTKLSVEDVEHLLMKSLSVHLIEGIIDQVEGTVHVSWVQPRVLGIPQITSLRDRLDNWLGKVHGALLSIEAETPDLVAV

SEQ ID NO: 9993 - protein, 386 aa, Lactuca sativa
MAALQYLDSLRSSHPELSDWYNTLADLYQRKLWHQLTLKLEQFVALAVFQAGDALIQLYNNFITDFETKINLLKLAHFAVIVSRQYSEKEAAISYLDGVIEKLRATKETRIEEPVLYIKMQIAVFNLEKGDQKECKNLLEDGKSTLDSMTDIDPSVYANYYWVSSQYHKTRQEFAEFYKSALLYLAYTSVESLSDSFKLDLAFDLSLSALLGENVYNFGELLAHPIIKSLIGTKVEWLYYILEAFNSGDLVKYQELCRVHTAALNGQPALVENEKKLLEKINILCLMEIIFSRPSEERTIPLSIIAERTKLTVEDVEYLLMKSLSVHLIEGIIDQVDGTVYVSWVQPRVLGIAQIKSLRDRLDGWVGKVHTALLSVEAETPDLVAS

SEQ ID NO: 9994 - protein, 386 aa, Momordica charantia
MAALQYLDSLRNSHPELADWYNTLADLYQKKLWHQLTLKLEQFVALTVFQAGDALIQLYHNFITYFETKINLLKLAHFAVIVSRQYVEKEAAIGYLEGIIEKLRITKEQRLEEPILYIKMQIAIFKLEQGDRKECKKLLEDGKSTLDSMTDIDPSVYASYYWVSSQFYKFRKEFAEFYKSALLYLAYTSVESLSDSFKLDLAFDLSLSALLGDNIYNFGELLAHPIIKSLLGTKVEWLYYILQAFNSGDLVRYQELCQVHNEALRAQPALVENEKKLLEKINILCLMEIIFSRPSEDRTIPLNVIAERTKLSIEDVEHLLMKSLSVHLIEGIIDQVEGTVHVSWVQPRVLGIQQIKSLRDRLDNWVDKVHSTLLSVEAETPDLVAS

SEQ ID NO: 9995 - protein, 386 aa, Helianthus annuus
MSALQYLDSLRNTHPELSDWYNTLADLYQRKLWHQLTLKLEQFVALTVFQAGDALIQLYQNFITDFETKINLLKLAHFAVIVSRQYSEKEAAISYLEGVIEKLRATKESRIEEPIAYIKMQIAIFNLEKGDQKECKNLLDDGKSTLDSMTDIDPSVYANYYWVTSQYHKSRQEFAEFYKSSLLYLAYTSVESLSDSFKLDLAFDLSLSALLGDNIYNFGELLAHPIIKSLLGTQVEWLYYILEAFNNGDLVRYQELCRVHAASLNAQPALVENEKKLLEKINILCLMEIIFSRPSDERTIPLSIIADRTKLTVEDVEYLLMKSLSVHLIEGIIDQVEGTVHVSWVQPRVLGISQIKSLRDRLDNWVGKVHTALVSVEAETPDLVAS

SEQ ID NO: 9996 - protein, 386 aa, Helianthus annuus
MAALQYLDSLRNTHPELSDWYNTLADLYQRKLWHQLTLKLEQFVALAVFQAGDALIQLYNNFITDFETKINLLKLAHFAVIVSRQYSSKEDAISYLEGVIEKLRATKETRIEEPILYIKLQIASFNLEKGDQKECKNLLEDGKSTLDSMTDIDPSVYANYYWVSSQYHKSRQEFAEFYKNSLLYLAYTSVESLSDSFKLDLAFDLSLSALLGDNIYNFGELLAHPIIKSLLGTKVEWLYYILEAFNAGDLVRYQELCRVHAASLNAQPALVENEKKLLEKINILCLMEIIFSRPSGDRTIPLSIIAEQTKLTVEDVEYLLMKSLSVHLIEGIIDQVEGTVYVSWVQPRVLGISQIKSLRDRLDNWVGKVHTALVSVEAETPDLIAS

SEQ ID NO: 9997 - protein, 134 aa, Citrullus lanatus
MAALQYLDSLRNSHPELAEWYNTLADLYQKKLWHQLTLKLEQFVALTVFQAGDALIQLYHNFITDFETKINLLKLAHFAVIVSRQYAEKEAAISYLEGIIEKLRSTKEQRIEEPILYIKMQIAIFKLEIGHFYA

SEQ ID NO: 9998 - protein, 386 aa, Panax ginseng
MAAMQYLDSLRNSHPELSDWYNTLADLYQRKLWHQLTLKLEQFVALAVFQAGDALIQLYHNFITDFETKINLLKLAHFAVIVSRQYSEKEAAISYLEGVIEKLRATREMRIEEPVLYIKMQIAMFNLEKGDQKECKKLLEDGKSTLDSMTDIDPSVHASYYWISSQYHKSRQEFAEFYKSALLYLAYTSVESLSESFKLDLAFDLSLSALLGENIYNFGELLAHPIIKSLLGTKVEWLYYILEAFNSGDLVRYQELCHVHSAALSAQPALVENERKLLEKINILCLMEIIFSRPSEDRTIPLSIIAERTKLTVEDVEYLLMKSLSVHLIEGIIDQVEGTVHVSWVQPRVLGISQIKSLRDRLDNWMDKVNAALLSVEAETPDLVAS

SEQ ID NO: 9999 - protein, 386 aa, Panax ginseng
MAALQYLDSLRNSHPELSDWYNTLADLYQRKLWHQLTLKLEQFVALAVFQAGDALIQLYHNFITDFETKINLLKLAHFAVIVSRQYSEKEAAISYLEGVIEKLRATRKMRIEEPVLYIKMQIAMFNLEKGDQKECKKLLEDGKSTLDSMTDIDPSVHASYYWISSQYHKFRQEFAEFYKSALLYLAYTSVESLSESFKLDLAFDLSLSALLGENIYNFGELLAHPIIKSLLGTKVEWLYYILEAFNSGDLVRYQELCRVHSTALSAQPALVQNERNLLEKINILCLMEIIFSRPSEDRTIPLSIIAERTKLTVEDVEYLLMKSLSVHLIEGIIDQVEGTIHVSWVQPRVLGISQIKSLRDRLDNWMEKVHTALLSVEAETPDLVAS

SEQ ID NO: 10000 - protein, 386 aa, Panax ginseng
MAALQYLDSLRNSHPELSDWYNTLADLYQRKLWHQLTLKLEQFVALAVFQAGDALIQLYHNFITDFETKINLLKLAHFAVIVSRKYSEKEAAISYLEGVIEKLRATREMRIEEPVLYIKMQIAMFNLEKGDQKECKKLLEDGKTTLDSMTDIDPSVYASYYWNSSQYHKSRQEFAEFYKSALLYLAYTSVESLSESFKLDLAFDLSLSALLGENIYNFGELLAHPIIKSLLGTKVEWLYYILEAFNSGDLVRYQELCHVHSAALSAQPALVENERKLLEKINILCLMEIIFSRPSEDRTIPLSIIAERTKLTVEDVEYLLMKSLSVHLIEGIIDQVEGTVHVSWVQPRVLGISQIKSLRDRLDNWMDKVNAALLSVEAETPDLVAS

SEQ ID NO: 10001 - protein, 386 aa, Ambrosia trifida
MAALEYLDSLRTAHPELSDWYNTLADLYQRKLWHQLTLKLEQFVALAVFQAGDALIQLYNNFITDFETKINLLKLAHFAVIVSRQYSKKEDAIKYLEGVIEKLRATKEMRIEEPILYIKMQIAAFNLEKGDQKECKNLLDDGKSTLDSMTDIDPSVYANYYWVSSQYHKARQEFAEFYKNSLLYLAYTSVESLSDSFKLDLAFDLSLSALLGDNIYNFGELLAHPIIKSLLGTKVEWLYYILEAFNAGDLVRYQELCRVHAASLNAQPALVENEKKLLEKINILCLMEIIFSRPSGDRTIPLNIIAERTKLSVEDVEYLLMKSLSVHLIEGIIDQVEGTVYVSWVQPRVLGISQIKSLRDRLDNWVEKVHTALVSVEAETPDLVAS

SEQ ID NO: 10002 - protein, 386 aa, Arnica chamissonis
MAALQYLDSLRSTHPELSDWYNTLADLYQRKLWHQLTLKLEQFVALAVFQAGDALIQLYHNFITDFETKINLLKLAHFAVIVSRQYSEKEAAIGYLEGVIEKLRATKETRIEEPILYIKMQIAIFNLEKGDPKECKNLLEDGKSTLDSMTDIDPSVYANYYWVSSQYHKSCQEFAEFYKNSLLYLAYTSVESLSDSFKLDLAFDLSLSALLGDNIYNFGELLAHPIIKTLLGTKVEWLYYILEAFNAGDLVRYQELCRVHAASLNTQPALVENEKKLLEKINILCLMEIIFSRPSEDRTIPLSIIAERTKLTVEDVEYLLMKSLSVHLIEGIIDQVEGTVYVSWVQPRVLGISQIKSLRDRLDNWVGKVHTALVSVEAETPDLIAS

SEQ ID NO: 10003 - protein, 386 aa, Cicer arietinum
MAALQYLESLRSSHPELSDWYNSLEDLYQKKLWHQLTLKLEQFLALAVFQAGDALIQLYNNFITDFETKINLLKLAHFAVMVSRQYSEKEAAIGYLEGVIEKLQATREQRIEEPILYIKMQIALFKLEQGDQKECKSLLENGKSTLDSMTDIDPTVYASYFWVSSQYHKSRQEFAEFYKSALLYLAYTSVESLSDSFKLDLAFDLSLSALLGDNIYNFGELLAHPIIKSLLGTKVEWLYYILQAFNSGDLVRYQELCQVHNAALRAQPALVQNEQKLLEKINILCLMEIIFSRPSEDRTIPLSVIAERTKLSIEDVEHLLMKSLSVHLIEGIIDQVDGTVHVSWVQPRVLGIQQIKSLRDRLDSWTGKVHNALLSIEAETPDLIGS

SEQ ID NO: 10004 - protein, 386 aa, Cirsium arvense
MAALQYLDSLRSTHPELSDWYNTLADLYERKLWHQLTLKLEQFVALTVFQAGDALIQLYHNFITDFETKINLLKLAHFAVIVSRQYSEKEAAISYLDGVIEKLRATKETRIEEPVLYIKMQIAIFNLEKGDQKECKNLLEDGKSTLDSMTDIDPSVYSNYYWVSSQYHKSRQEFAEFYKSALLYLAYTSVESLSDSFKLDLAFDLSLSALLGENVYNFGELLAHPIIKSLLGTKVEWLYYILEAFNSGDLIRYQELCRVHGASLSAQPALVDNEKKLLEKINILCLMEIIFSRPSEERTIPLSIIAERTNLTVEDVEHLLMKSLSVHLIEGIIDQVDGTVYVSWVQPRVLGISQIKSLRDRLDGWVGKVHTALISVEAETPDLVAS

SEQ ID NO: 10005 - protein, 381 aa, Flaveria ramosissima
YLDSLRTTHPELSDWYNTLADLYQRKLWHQLTLKLEQFVALAVFQAGDALIQLYHNFITDFETKINLLKLAHFAVIVSRQYSEKEAAISYLEGVIEKLRGTKEMHIEEPIVYIKMQIALFNLEKGDQKECKNLLEDGKSTLDSMTDIDPSVYANYYWVSSQYHKSRQEFAEFYKNSLLYLAYTSVESLSDSFKLDLAFDLSLSALLGDNIYNFGELLAHPIIKSLLGTKVEWLYYILEAFNAGDLVRYQELCRVHAASLNAQPALVENEKKLLEKINILCLMEIIFSRPSEDRTIPLSIIAERTKLTVEDVEYLLMKSLSVHLIEGIIDQVEGTVYVSWVQPRVLGISQIKSLRDRLDNWVGKVHTALVSVEAETPDLVAS

SEQ ID NO: 10006 - protein, 386 aa, Gossypium raimondii
MAALQYLDSLRNEHPELGDWYNSLADLYQKKLWHQLTLKLEQFVALTVFQAGDALIKLYHNFITDFETKINPLKLAHFAVIVSQQYSEKEAAISFLEGVIEKLQATKEQRIEEPILYIKMQISKFKLEQGDQKECKKLLEDGKSTLDSMTDIDPSVYATYYWVSSQYHKFRQEFAEFYRSALLYLAYTSVESLSESFKLDLAFDLSLSALLGDNIYNFGELLAHPIIKSLLGTKVEWLYYILQSFNSGNLVRYEELCRVHNAALSAQPALVENEKKLLEKINILCLMEIIFSRPSDDRTIPLKVIAERTKLSIEDVEYLLMKSLSVRLIEGIIDQVEGTIHVSWVQPRVLGIPQIKSLRDRLDNWMGKVHNAWLSIEAETPDLVAS

SEQ ID NO: 10007 - protein, 386 aa, Gossypium raimondii
MAALQYLDSLRNEHPELSDWYSSLADLYQKKLWHQLTLKLDQFVALTFFQAGDALIKLYHNFITDFETKINLLKLAHFAVIVSRQYSEKEAAISYLEGVIEKLRATKEKRIEEPILYIEMQVAKFKLELGDQKECKKLLEDGKSTLDSMDGVDPSVYASYYWVSSQYHKFRQEFAEFYKSALLYLGYTSVDSLSESFKLDLAFDLSLSALLGDNIYNFGELLAHPIVKSLLGTSVEWLYYILLAFNSGDLVHYQELCRIHNAALRTQPALVENEKRLLEKINVLCLMEIIFSRPAEDRTIPLKVIAERTKLSIEDVEHLLMKSLSVHLIEGIIDQVKGTAYISWVQPRVLGIPQIKSLRDRLDNWVGKVHTACLSIEAETPDLVAP

SEQ ID NO: 10008 - protein, 386 aa, Lotus japonicus
MAALQYLDSLRSAHPELDDWYNSLADLYQKKLWHQLTLKLEQFLAHAVFQAGDALIQLYHNFITDFETKINLLKLAHFAVMVSRQYSEKEAAVGYLDGIIEKLQATKEQRIEEPILYIKMQIAIFKLEQGDQKECKKLLEDGKSTLDSMTDIDPTVYASYYWVSSQFHKSRQEFAEFYKSALLYLAYTAVESLSDSFKLDLAFDLSLSALLGDNIYNFGELLAHPIIKSLLGTKVEWLYYILQAFNSGDLVRYQELCRVHNAALRAQPALVQNEQRLLEKINILCLMEIIFSRPSEDRTIPLAVIAERTKLSIEDVEHLLMKSLSVHLIEGIIDQVEGTVHVSWVQPRVLGIQQIKSLRDRLDSWTGKVHTALLSIEAETPDLIGS

SEQ ID NO: 10009 - protein, 386 aa, Arachis hypogaea
MAALQYLESLRNAHPELSDWYNSLADLYQKKLWHQLTLKLEQFVALAAFQAGDALIQLYNNFITDFETKINLLKLAHFAVIVSRQYSEKEAAVGYLDGVIEKLQATREQRIEEPILYIKMRIAIIKLEQGDQKECKKLLEDGKSTLDSMTDIDPSVYASYYWVSSQYHKSRQEFAEFYKSALLYLAYTSVESLSDSFKLDLAFDLSLSALLGDNIYNFGELLAHPIIKSLLGTKVEWLYYILQAFNSGDLVRYQELCRVHSAALRAQPALVQNEQKLLEKINILCLMEIIFSRPSEDRTIPLSVIADRTRLSIENVEHLLMKSLSVHLIEGIIDQVDGTVHVSWVQPRVLGIQQIKSLRDRLDSWTGKVHTALLSIEAETPDLIGS

SEQ ID NO: 10010 - protein, 386 aa, Gossypium raimondii
MAALQYLDSLRNEHPELGDWYNSLADLYQKKLWHQLTLKLEQFVALTVFQAGDALIKLYRNFITDFETKINPLKLAHFAVIVSQQYSEKEAAISFLEGVIEKLQATKEQRIEEPILYIKMQISKFKLEQGDQKECKKLLEDGKSTLDSMTDIDPSVYATYYWVSSQYHKFRQEFAEFYRSALLYLAYTSVESLSESFKLDLAFDLSLSALLGDNIYNFGELLAHPIIKSLLGTKVEWLYYILQSFNSGNLVRYEELCRVHNAALSAQPALVENEKKLLEKINILCLMEIIFSRPSDDRTIPLKVIAERTKLSIEDVEYLLMKSLSVRLIEGIIDQVEGTIHVSWVQPRVLGIPQIKSLRDRLDNWMGKVHNAWLSIEAETPDLVAS

SEQ ID NO: 10011 - protein, 386 aa, Chenopodium quinoa
MSALQYLDTLRSAHPELAEWYNTLADLYQKKLWHQLTLELEKFVALAVFQAGDALIQLYHNFITDFETKINLLKLAHFAVIVSRQYAEKEAAIGYLEGVIEKLHATRESRIEEPVLYIKMQMALFKLEQGEQKECKKILEDGKTTLDSMTDIDPSVYASFYWVSSQYHKARQEFAEFYKNALLYLAYTSVESLSESFKLDLAFDLSLSALLGENIYNFGELLAHPILKSLLGTKVEWLYYILQAFNTGDLIRYQELCNVHKDALNAQPALVANERKLLEKINILCLMEIIFNRPAEDRTIPLKVIAERTRLSIEDVEYLLMKSLSVHLIEGIIDQVEGTVHVSWVQPRVLGIPQITSLRDRLDSWLGKVHTALLSVEAETPDLVAS

SEQ ID NO: 10012 - protein, 386 aa, Ambrosia trifida
MAALEYLDSLRTAHPELSDWYNTLADLYQRKLWHQLTLKLEQFVALAVFQAGDALIQLYNNFITDFETKINLLKLAHFAVIVSRQYSKKEDAIKYLEGVIEKLRATKEMRIEEPILYIKMQIAAFNLEKGDQKECKNLLDDGKSTLDSMTDIDPSVYANYYWVSSQYHKARQEFAEFYKNSLLYLAYTSVESLSDSFKLDLAFDLSLSALLGDNIYNFGELLAHPIIKSLLGTKVEWLYYILEAFNAGDLVRYQELCRVHAASLNAQPALVENEKKLLEKINILCLMEIIFSRPSGDRTIPLNIIAERTKLTVEDVEYLLMKSLSVHLIEGIIDQVEGTVYVSWVQPRVLGISQIKSLRDRLDNWVEKVHTALVSVEAETPDLVAS

SEQ ID NO: 10013 - protein, 386 aa, Cichorium intybus
MAALQYLDSLRTTHPELSDWYNTLADLYQRKLWHQLTLKLEQFVALAVFQAGDALIQLYNNFITDFETKINLLKLAHFAVIVSRQYSEKEAAISYLEGVIEKLRVTKETRIEEPILYIKMQIAIFNLEKGDQKECKNLLEDGKSTLDSMTDIDPSVYANYYWVSSQYHKSRQEFAEFYKNSLLYLAYTSVESLSDSFKLDLAFDLSLSALLGDNIYNFGELLAHPIIKSLLGTKVEWLYHILEAFNSGDLIRYQELCRVHSASLNAQPALVENEKKLLEKINILCLMEIIFSRASEDRTIPLSVIAERTKLTVEDVEYLLMKSLSVHLIEGIIDQVDGTVHVSWVQPRVLGVAQIKSLRDRLDNWVGKVHTALISVEAETPDLAAS

SEQ ID NO: 10014 - protein, 386 aa, Olea europaea
MAALQYLDTLRNTHPELSEWYNTLADLYQRKLWHQLTLKLEQFVALAVFQAGDALIQLYHNFITEFETKINLLKLAHFAVIVSRQYSEKEAAINYLEGVIEKLRNTKEMRIEEPILYIKMQIATFKLEQEDHKECKKLLEDGKSTLDSMTDIDPSVYASYYWVSSQLHKSCQEFADFYKSALLYLAYTSVESLSESFKLDLAFDLSLSALLGENIYNFGELLAHPIVKSLIGTKVEWLYYILEAFNSGNLVRYQELCQVHMAALSAQPALVQNEKNLLEKINILCLMETIFSRPSEDRTIPLCVIAERTKLTVEDVEYLLMKSLSVHLIEGIIDQVEETVYVSWVQPRVLGIPQIKSLRDRLDNWMEKVHTALLSVEAETPDLVAA

SEQ ID NO: 10015 - protein, 386 aa, Glycine max
MAALQYLESLRNAHPELSDWYNSLADLYQNKLWHQLTLKLEQFVALAVFQAGDALIQLYHNFITDFETKINLLKLAHFAVIVSRQYAEKEAAVGYLGGVIQKLQDTREQRIEEPILYIKMQIAILKLEQGDQKECKKLLEDGKSTLDSMTDIDPSVYASYYWVSSQFHKTRQEFAEFYKSALLYLAYTSVESLSDSFKLDLAFDLSLSALLGDNIYNFGELLAHPIIKSLMGTKVEWLYYILQAFNAGDLLQYQELCRVHNAALRAQPALVQNEQKLSEKINILCLMEIIFSRPSEDRTIPLSVIAERTKLSIENVEHLLMKSLSVHLIEGIIDQVEGTVHVSWVQPRVLGIQQIKSLRDRLDSWTGKVHTALLSIEAETPDLIGS

SEQ ID NO: 10016 - protein, 98 aa, Panax ginseng
MAALQYLDSLRNSHPELSDWYNTLADLYQRKLWHQLTLKLEQFVALAVFQAGDALIQLYHNFITDFETKINLLKLAHFAVIVSRQYSEKEAAISYLEG

SEQ ID NO: 10017 - protein, 267 aa, Panax ginseng
MQIAMFNLEKGDQKECKKLLEDGKTTLDSMTDIDPSVYASYYWNSSQYHKSRQEFAEFYKSALLYLAYTSVESLSESFKLDLAFDLSLSALLGENIYNFGELLAHPIIKSLLGTKVEWLYYILEAFNSGDLVRYQELCHVHSASLSAQPALVENERKLLEKINILCLMEIIFSRPSEDRTIPLSIIAERTKLTVEDVEYLLMKSLSVHLIEGIIDQVEGTVHVSWVQPRVLGISQIKSLRDRLDNWMDKVNTALLSVEAETPDLVAS

SEQ ID NO: 10018 - protein, 278 aa, Ambrosia trifida
MRIEEPILYIKMQIAAFNLEKGDQKECKNLLDDGKSTLDSMTDIDPSVYANYYWVSSQYHKARQEFAEFYKNSLLYLAYTSVESLSDSFKLDLAFDLSLSALLGDNIYNFGELLAHPIIKSLLGTKVEWLYYILEAFNAGDLVRYQELCRVHAASLNAQPALVENEKKLLEKINILCLMEIIFSRPSGDRTIPLNIIAERTKLTVEDVEYLLMKSLSVHLIEGIIDQVEGTVYVSWVQPRVLGISQIKSLRDRLDNWVEKVHTALVSVEAETPDLVAS

SEQ ID NO: 10019 - protein, 281 aa, Gossypium hirsutum
MAALQYLDSLRNEHPELGDWYNSLADLYQKKLWHQLTLKLEQFVALTVFQAGDALIKLYHNFITDFEMKINPLKLAHFAVIVSQQYSEKEAAISFLEGVIEKLQATKEQRIEEPILYIKMQISKFKLEQGDQKECKKLLEDGKSTLDSMTDIDPSVYATYYWVSSQYHKFRQEFAEFYRSALLYLAYTSVESLSESFKLDLAFDLSLSALLGDNIYNFGELLAHPIIKSLLGTKVEWLYYILQSFNSGNLVRYEELCRVHNAALSAQPALVENEKKLLGKN

SEQ ID NO: 10020 - protein, 238 aa, Salvia sclarea
MTDIDPSVYASYYWISSQYHKARQEFAEFYRSALLYLAYTSVETLSDSFKLDLAFDLSLSALLGDNIYNFGELLAHPIIKSLMGTKVEWLYYILEAFNSGDLVRYQELCRVHGAALSSQPALVQNEKKLLEKINILCLMEIIFSRPSEDRTIPLSAIAERTKLTVEDVEYLLMKSLSVHLIEGIIDQVEGTVYVSWVQPRVLGIPQIRSLRDRLDNWVDKVHTALLSVEAETPDLVAA

SEQ ID NO: 10021 - protein, 389 aa, Trigonella foenum-graecum
MAALQYLESLRSSHPELGEWYNSLADLYQKKLWHQLTLKLEQFLALKVFQKLQAGDALIQLYNNFITDFETKINLLKLAHFAVMVSRQYSEKEAAIGYLEGVIEKLQATREQRIEEPILYIKMQIALFKLEQGDQKECKNLLENGKSTLDSMTDIDPTVYASYYWVSSQYHKSRQEFAEFYKSALLYLAYTSVESLSDSFKLDLAFDLSLSALLGDNIYNFGELLAHPIIKSLLGTKVEWLYYILEAFNSGDLVRYQELCQVHNDSLLAQPALVQNEQKLLEKINILCLMEIIFSRPSEDRTIPLKVIAERTKLSIENVEHLLMKSLSVHLIEGIIDQVDGTVHVSWVQPRVLGIEQIKSLRDRLDSWTGKVHTALLSIEAETPDLIGS

SEQ ID NO: 10022 - protein, 386 aa, Panax ginseng
MAAMQYLDSLRNSHPELSDWYNNLADLYQRKLWHQLTLKLEQFVALAVFQAGDALIQLYHNFITDFETKINLLKLAHFAVIVSRQYSEKEAAISYLEGVIEKLRATREMRIEEPVLYIKMQIAMFNLEKGDQKECKKLLEDGKSTLDSMTDIDLSVHASYYWISSQYHKSRQEFAEFYKSALLYLAYTSVESLSESFKLDLAFDLSLSALLGENIYNFGELLAHPIIKSLLGTKVEWLYYILEAFNSGDLVRYQELCRVHSTALSAQPALFQNERNLLEKINILCLMEIIFSRPSEDRTIPLSIIAERTKLTVEDVEYLLMKSLSVHLIEGIIDQVEGTIHVSWVQPRVLGISQIKSLRDRLDNWMEKVHTALLSVEAETPDLVAS

SEQ ID NO: 10023 - protein, 386 aa, Chenopodium quinoa
MSALQYLDTLRSAHPELAEWYNTLADLYQKKLWHQLTLELEKFVALAVFQAGDALIQLYHNFITDFETKINLLKLAHFAVIVSRQYAEKEAAIGYLEGVIEKLQATRESRIEEPVLYIKMQMALFKLEQGEQKECKKILEDGKTTLDSMTDIDPSVYASFYWVSSQYHKARQEFAEFYKNALLYLAYTSVESLSESFKLDLAFDLSLSALLGENIYNFGELLAHPILKSLLGTKVEWLYYILQAFNTGDLIRYQELCNVHKDALNAQPALVANERKLLEKINILCLMEIIFNRPAEDRTIPLKVIAERTRLSIEDVEYLLMKSLSVHLIEGIIDQVEGTVHVSWVHPRVLGIPQITSLRDRLDSWLGKVHTALLSVEAETPDLVAS

SEQ ID NO: 10024 - protein, 100 aa, Ambrosia trifida
MEIIFSRPSGDRTIPLNIIAERTKLTVEDVEYLLMKSLSVHLIEGIIDQVEGTVYVSWVQPRVLGISQIKSLRDRLDNWVEKVHTALVSVEAETPDLVAS

SEQ ID NO: 10025 - protein, 386 aa, Vaccinium corymbosum
MAAIQYLDSLRNTHPELAEWYNTLSDLYHKKLWHQLTLKLEQFVALAVFQAGDALIQLYHNFITDFETKINLLKLAHFAVIVSRQYSEKEAAISYLEDVIEKLRATREMRIEEPILYIKMQIAVFNIEKGSQKECKKLLEDGKSTLDTMTDIDPSVYASYYWVSSQYHKSRQEFAEFYKSALLYLAYTSVESLSDSFKLDLAFDLSLAALLGENIYNFGELLAHPIIKSLLGTKVEWLFYILEAFNSGDLVRYQELCQVHRAALSAQPALVENEKKLLEKINILCLMEIIFSRPSEDRTIPLHIIAECTKLNVEDVEYLLMKSLSVHLIEGIIDQVEGNVHISWVQPRVLGFPQIKSLRDRLDNWVDKVHTALLSVEAETPDLVAS

SEQ ID NO: 10026 - protein, 386 aa, Gossypium hirsutum
MAALQYLDSLRNEHPELSDWYSSLADLYQKKLWHQLTLKLDQFVALTFFQAGDALIKLYHNFITDFETKINLLKLAHFAVIVSRQYSEKEGAISYLEGVIEKLRATKEKRIEEPILYIEMQVAKFKLELGDQKECKKLLEDGKSTLDSMDGVDPSVYASYYWVSSQYHKFRQEFAEFYKSALLYLGYTSVDSLSESFKLDLAFDLSLSALLGDNIYNFGELLAHPIVKNLLGTSVEWLYYILLAFNSGDLVHYQELCRIHNAALRTQPALVENEKRLLEKINVLCLMEIIFSRPAEDRTIPLKVIAERTKLSIEDVEHLLMKSLSVHLIEGIIDQVKGTAYISWVQPRVLGIPQIKSLRDRLDNWVGKVHTACLSIEAETPDLVAP

SEQ ID NO: 10027 - protein, 386 aa, Eschscholzia californica
MAALQYLESQRNAQPELADWYNTLADLYEKKLWHQLTLKLDQFVALAVFQAGDTLIQLYHNFITEFETKINLLKLAHFAVIVSRQYPEKEAAIAYLEGVIEKLRATRELRIEEPVLYAKMQIAAFRLEQGEQKECKKLLDDGKTTLDSMTDIDPSVYASYHWVSSQYHKSRQEFAEFYKSALLYLAYTSVESLSETFKLDLAFDLSLSALLGDNIYNFGELLAHPIIKSLLGTKVEWLYYILQAFNSGDLVRYQELCVVHGASLSAQPALVQNEKKLLEKINILCLMEIIFSRPSEDRTIPLSIIAERTKLSVEDVEHLLMKSLSVHLIEGIIDQVEATVHVSWVQPRVLGIPQIKSLRDRLDNWLGKVHTALLSVEAETPDLVAS

SEQ ID NO: 10028 - protein, 386 aa, Fagopyrum esculentum
MSALQYLESQRNAHPELSEWYSTLADLYQKKLWHQLTQKLEQFVALAVFQAGDALIQFYHNFITDFETKINLLKLAHFAVIVSRQYAEKNAAISYLEGVIEKLRETREIRIEEPILYIKMQIASFKLEHGEPKECKKLLDDGKTTLDSMTDIDPSVYASYYWVSSQYYKSHQEFADFYKNALLYLAYTSVDSLSDSFKLDLAFDLSLSALLGENIYNFGELLAHPIVKSLLGTKVEWLYYILQAFNSGDLVRYQELCRVHGEALNAQPALVANEKKLLEKINILCLMEIIFSRPSEDRTIPLSVIAERTKLSVEDVEYLLMKSLSVHLIEGIIDQVEGTVHVSWVQPRVLGIPQIKSLRDRLDNWMGRVHTALLSVEAETPDLVAS

SEQ ID NO: 10029 - protein, 377 aa, Flaveria ramosissima
LRNTHPELSDWYNTLADLYQRKLWHQLTLKLEQFVALAVFQAGDALIQLYHNFITDFETKINLLKLAHFAVIVSRQYAEKEAAISYLEGVIEKLRATKEMRIEEPNVYIKMQIAIFNLEKGDQKECKNILDDGKSTLDSMTDIDPSVYANYYWVTSQYHKARQEFAEFYKNSLLYLAYTSVESLSDSFKLDLAFDLSLSALLGDNIYNFGELLAHPIIKSLLGTQVEWLYYILEAFNNGDLVRYQELCRVHAASLNAQPALVENEKKLLEKINILCLMEIIFSRPSEDRTIPLSIIAERTKLTVEDVEYLLMKSLSVHLIEGIIDQVEGTVYVSWVQPRVLGISQIKSLRDRLDNWVGKVHTALVSVEAETPDLVAS

SEQ ID NO: 10030 - protein, 386 aa, Medicago truncatula
MAALQYLESLRSSHPELGEWYNSLADLYQKKLWHQLTLKLEQFLALTVFQAGDAIIQLYNNFITDFETKINLLKLAHFAVMVSRRYAEKEAAIGYLEGVIEKLQATREQRIEEPILYIKMQIALFKLEQGDQKECKNLLENGKSTLDSMTDIDPTVYASYYWVSSQYHKSRQEFAEFYKSALLYLAYTSVESLSDSFKLDLAFDLSLSALLGDNIYNFGELLAHPIIKSLLGSKVEWLYYILQAFNSGDLVRYQELCQVHNAALSAQPALVQNEQKLLEKINILCLMEIIFSRPSEDRTIPLSVIAERTKLSIENVEHLLMKSLSVHLIEGIIDQVEGTVHVSWVQPRVLGIEQIKSLRDRLDGWTGKVHTALLSIEAETPDLIGS

SEQ ID NO: 10031 - protein, 386 aa, Orobanche aegyptiaca
MAALQYLDTLRNAHPELSEWYNTLSDLYQRKLWHQLTLKLEQFVALAVFQAGDALIQLYNNFISEFETKINLLKLAHFAVIVSRQYSEKEAAINYLEGVIEKLLNTREPRIEEPILYIKMQISLCKLEQGDQKECKKLLEEGKITLDSMTDIDPSVYASYYWVSSQYHKSHQEFADFYRSALLYLAYTSVESLSESFKLDLAFDLSLSALLGENIYNFGELLAHPIVKSLMGTRAEWLYYLLEAFNSGDLVRYQELCRVHGAALSTQPALVQNEKKLLEKINILCLTEIIFSRPSEDRTIPLSIIAERTKLTVEDVEYLLMKSLSVHLIEGIIDQVEGTVYVSWVQPRVLGIPQIKSLRDRLDNWVDKVHSALLSVEAETPDLVAA

SEQ ID NO: 10032 - protein, 386 aa, Solanum phureja
MAALQYLESLRNDHPELSDWYTTLADLYQRKLWHQLSLKLEQFVALAVFQAGDTLIQLYHNFITDFETKINLLKLAHFAVIVSRQYSEKDAAIGYLEGVAEKLQNTKETRIEEPILYIKLQIALFKLEQGDQKECKKLLEQGNATLDSMTDVDPSVYASYYWVSSQYHKTRQEFAEFYKSALLYLAYISVDSLSESFKLDLAFDLSLSALLGDNVYNFGELLAHPIIKSLVGTQVEWLYHILEAFNTGDLVRYQELCRVHQAALSAQPALLQNEKKLLEKINILCLMEIIFSRPAEDRTIPLSAIAERTKLSVEDVEHLLMKSLSVHLIEGIIDQVEGTVHVSWVQPRVLGIPQIKSLRDRLDNWVDKVHTALLSVEAETPDLVSS

SEQ ID NO: 10033 - protein, 138 aa, Ambrosia trifida
MSALEYLDSLRNTHPELSDWYNTLADLYQRKLWHQLTLKLEQFVALTVFQAGDALIQLYQNFITDFETKINLLKLAHFAVIVSRQYSEKEKAIEYLEGVIEKLRATKESRIEEPIVYIKMQIAILILKKEIKRSARIF

SEQ ID NO: 10034 - protein, 386 aa, Tropaeolum majus
MAALQYLETMRNAHPELAEWYNSFADLYEKKLWHQLTLKLEQFVALAVFQAGDALIQLYHNFIADFETKINLLKLAHFAVIVSRQYSEKEAAVSYLEGVIEKLRDTKRHKIEEPIVYIKMQITLIKLEQGDQKECKNLLESGRSTLDGITDIDPSVYASFYWVSSQYHKFRQEFAEFYKNALLYLAYVSVESLSESFKLDLAFDLSLSALMGDNIYNFGELLAHPIIKSLLGSKVEWLYYLLEAFNTGDLVRYQELCRVHNTALGAQPALVENEKKLLEKINILCLMEIIFSRPSEDRTIPLNIIAERTKLSIEDVEHLLMKSLSVHLIEGIIDQVDGTVHVSWVQPRVLGIPQIKSLRDRLDNWLGKVHGALLSIEAETPDLVAS

SEQ ID NO: 10035 - protein, 386 aa, Tropaeolum majus
MAALQYLENMRNAQPELAEWYNSLADLYEKKLWHQLTLKLEQFVALTVFQAGDALIQLYHNFITDFETKINLLKLAHFAVIVSRQYSEKDAAVSYLEGVIEKLRDAREQHTEQPIVYIKMQIALFKLEQGDQKECKKLLESGKSTLDSRTDIDPSVYASFYWISSQYYKFRQEFAEFYKNALLYLAYTSVESLSESFRLDLAFDLSLSALLGDNIYNFGELLAHPVIKSLIGTKVEWLYYILQAFNAGDLVRYQELCQVHNAALSAQPALVANEKKLLEKINILCLMEIIFSRPSEDRTIPLNIIAERTKLSIEDVERLLMKSLSVHLIEGIIDQVEGTVHVSWVQPRVLGIPQVKSLRDRLDNWLDKVHTALISIEAETPDLVAS

SEQ ID NO: 10036 - protein, 386 aa, Triphysaria pusilla
MAALQYLETLQNSHPELSEWYSSLSDLYQRKLWHQLTLKLEQFVALAVFQAGDALIQLYNNFISDFETKINLLKLAQFSVIVSRQYSEKAAAISYLEGVIEKLRDTRESRIEEPILYIKMQIATCKLEQGDKKECKNLLEEGKSALDSMTDIDPSVYASYYWVSSQYHKSHQEFAEFYRSALLYLAYTSVESLSESFKLDLAFDLSLSALLGENIYNFGELLAHPIIKSLLGTKVEWLYYVLEAFNSGNLVRYQELCRVHGAALSSQPALVQNEKNLLEKINILCLMEIIFSRPSEERTIPLSIIAERTKLTVEDVEYLLMKSLSVHLIEGIIDQVEGTVYVSWVQPRVLGIPQIKSLRDRLDNWVDKVHTALLSVEAETPDLVAA

SEQ ID NO: 10037 - protein, 213 aa, Cynara scolymus
  misc_feature (201)..(201): Xaa can be any naturally occurring amino acid
  misc_feature (204)..(204): Xaa can be any naturally occurring amino acid
  misc_feature (206)..(207): Xaa can be any naturally occurring amino acid
MAALQYLDSLRSTHPELSDWYNTLADLYQRKLWHQLTLKLEQFVALAVFQAGDALIQLYHNFITDFETKINLLKLAHFAVTVSRQYSEKEAAISYLEGVIEKLRATKEMRIEEPILYIKMQIAVFNLEKGDQKECKNLLDDGKSTLDSMTDIDPSVYANYYWVSSQYHKSRQEFAEFYKSSLLYLAYTSVESLSDSFKLDXAFXTXXICIAGR

SEQ ID NO: 10038 - protein, 232 aa, Ambrosia trifida
MTDIDPSVYANYYWVTSQYHKSRQEFAEFYKSSLLYLAYTSVESLSDSFKLDLAFDLSLSALLGDNIYNFGELLAHPIIKSLLGTQVEWLYYILEAFNNGDLVRYQELCRVHAASLNAQPALVENEKKLLEKINILCLMEIIFSRPSDERTIPLSIIADRTKLTVEDVEYLLMKSLSVHLIEGIIDQVEGTVHVSWVQPRVLGISQIKSLRDRLDNWVGKYTLLWCRLSRNT

SEQ ID NO: 10039 - protein, 226 aa, Nuphar advena
  misc_feature (195)..(195): Xaa can be any naturally occurring amino acid
MAALKYLESQSSAQPELAEWYNSLADLYQRKLWHQLTLKLEQFVALAVFQAGDRLIQLYHNFITDFETKINLLKLAHFAVIVSRQYTEREAAISYLEGVIEKLRATREMRIEEPILYVRMQIAAFKLEQGDQKECKKLLDEGKNALDSMTDIDPSVYASYHWISSQYHKSRQEFAEFYKSALLYLAYTTVETLSXPFKLDLAFDLSLAALLGDTSITSESFLHIQL

SEQ ID NO: 10040 - protein, 386 aa, Vaccinium corymbosum
MAALQYLENLRNAHPGLDDWFNTLSDLYQKKLWHQLTLKLEQFVSLPAFQGGDSLIQLYHNFIADFETKINLLKLAHFAVIVSRQYPEKEAAISFLEGVIEKLRATREMRIEEPILYIKMQIAIFNIEKGDQKECKKLLDDGKTTLDSMTDIDPSVYASYYWVSSQYYKSRQEFAEFYKSALLYLAYTSVESISESFKLDLAFDLSLAALLGENIYNFGELLAHPIIKSLLGTKVEWLYHILEAFNSGDLVRYQELCHVHSASLNAQPALVENGKKLLEKINILCLMEIIFSRPSEDRTIPLSVIAERTKLTVEDVEYLLMKSLSVHLIEGIIDQVQGTVHVSWVQPRVLGISQIKSLRDRLDNWVDKVHTALLSVEAETPDLVAA

SEQ ID NO: 10041 - protein, 386 aa, Euonymus alatus
MAALQYLETLRNVHPELSEWYNSLADLYEKKLWHQLTLKLEQFVALAVFQAGDALIQLYNNFITYFETKINLLKLAHFAAIVSRQYLDKDAAISYLEGVIEKLQVSREYRIEEPILYIKMQIALFKLEQGDQKECKRLLEEEKSALDSMTDIDPSVYASFYWVSSQYHKYLQEFAEFYKNTLLYLAYTSVESLSDSFKLDLAFDLSLSALLGDNIYNFGELLAHPIIKSLLGTKVEWLYHILRAFNSGDLVHYQELCRVHNAALSAQPALVENEKKLLEKINILCLMEIIFSRPSEDRTIPLTAIAERTKLSIEDVEHLLMKSLSVHLIEGIIDQVEGTVHVSWVQPRVLGVQQITSLRDRLDNWSDKVRTALLSIEAETPDLVVS

SEQ ID NO: 10042 - protein, 386 aa, Sarracenia psittacina
MAALQYLETLRSAHPELSDWYNTLSDLYQKKLWHQLTLKLEQFVALAVFQAGDALIQLYHNFITDFETKINLLKLAHFAVIVSRQYSEKEAAISYLEGVIEKLRATRETRIEEPILYIKMQIAIVNVEKGDQKECKKLLEDGKSTLDSMTDIDPSVYACYYWVSSQYHKARQEFAEFYKSALLYLAYTSVESLSESFKLDLAFDLSLAALLGENIYNFGELLAHPIVKSLLGTKVEWLYYILEAFNSGNLVRYQELCNVHRAALSAQPALVENEKKLLEKINILCLMEIIFSRPSEDRTIPISIIAERTKLTVEDVEYLLMKSLLFISLRGVIDQVEGTVHVSWVQPRVLGIPQIKSLRDRLDNWVGKVHTALLSVEAETPDLVAS

SEQ ID NO: 10043 - protein, 388 aa, Plantago ovata
MAAAPLQYLESLRNAHPELSEWYTTLSDLYQRKLWHQLSLKLEQFVALTVFQAGDALIQLYHNFITDFETKINLLKLAHFAVIISRQYSEKEAAISYLEGLIEKLRNTKEMRIEEPILYIKMQIATFRLEQGDPKECKKLLDEGKSSLDSMTDIDPSVYASYYWVSSQYHKSIPDFAEFYKSALLYLAYTSVESLSDSFKQDLAFDLSLSALLGENIYNFGELLAHPILKSLLGTRVEWLYYILEAFNSGDLARYQELCRVHKAALLDQPALVKNEKNLVEKINILCLMETIFSRPAEDRTIPLSIIAERTRLTVEDVEHLLMKSLSVHLIEGIIDQVDGTVYVSWVQPRVLGISQIKSLRGRLDNWVDKVNETLNSVEAETPDLVAA

SEQ ID NO: 10044 - protein, 385 aa, Cynara scolymus
MAALQYLDSLRSTHPELSDWYNTLADLYQRKLWHQLTLKLEQFVALTVFKAGDALIQLYHNFITDFETKINLLKLAHFAVIVSRQYSEKEAAISYLDGVIEKLQATKETRIEEPVLYIKMQIAIFNLEKGDQKECKNLLEDGKSTLDSMTDIDPSVYSNYYWVSSQYHKSRQEFAEFYKSALLYLAYTSVESLSDSFKLDLAFDLSLSALLGENVYNFGELLAHPIIKSLLGTKVEWLYYILEAFNSGDLIRYQTMSCHGASLSAQPALVDNEKKLLEKINILCLMEIIFSRPSEERTIPLSIIAERTNLTVEDVEHLLMKSLSVHLIEGIIDQVDGTVYVSWVQPRVLGISQIKSLRDRLDGWVGKVHTALISVEAETPDLVAS

SEQ ID NO: 10045 - protein, 386 aa, Nicotiana benthamiana
MAALEYLDSLRNAHPELSDWYNTLSDLYQRKLWHQLSLKLEQFVALAVFQAGDALIQLYHNFISDFETKINLLKLAHFAVIVSRQYAEREAAIGYLEGVIEKLQNTKETRIEEPILYIKLQIALFKLEQGDQKDCKILLEEGKTTLDSMTDIDPSVYASYYWVSSQFHKARLEFAEFYRSALLYLAYTSVESLSESFKLDLAFDLSLSALLGDNIYNFGELLAHPIVNSLLGTKVEWLYHILEAFNTGDLICYQELCRVHQAALNAQPALVQNEKKLLEKINILCLIEIIFSRAAEDRTIPMNVIAERTKLGVEDVEYLLMKSLSVHLIEGIIDQVEGTIHVSWVQPRVLGIPQIKSLRDRLDNWVEKVHTTLLSVEAETPDLVAS

SEQ ID NO: 10046 - protein, 386 aa, Solanum tuberosum
MAALQYLESFCNAHSQLSDWYTTLADLYQRKLWHQLTLKLEQFVALPVFQAGDGLIQLYHNFITDFETKINLLKLAHFAVIVSRQYPEKEAAIGFLEGVTEKLHNTKEIRIEEPILYIKMQIALFKLEQEDPKECQKLLDEGKTTLDSMTDIDPSVYASYYWVSSQYHKTRQEFAEFYKSALLYLAYTSVESLSESFKLDLAFDLSLSALLGDNIYNFGELLAHPIIKSLIGTKVEWLYYILEAFNTGDLVHYQKLCHVHQAALTAQPALVQNEKKLLEKINILCLMEIIFSRPADDRTIPLSVIAERTKLTVEDVEYLLMKSLSVHLIEGIIDQVEGTVHVSWVQPRVLGIPQIKSLRDRLDNWVDKVHTALLSVEAETPDLVAA

SEQ ID NO: 10047 - protein, 386 aa, Tabernaemontana elegans
MAALQYLDSLRNTHPELSDWYNTLADLYQRKLWHQLTQKLEQFVALAVFQVGDALIQFYHNFIADFETKINLLKLAHFAVIVSRQYAEKEAAISYLEGVIEKLRNTRELRIEEPILYIKMQMAYLKLQQGDQKECKKLLEEGKSTLDSMTDIDPSVYASYYWVSSQCHKSRQEFAEFYKSALLFLAYTSVESLSESFKLDLAFDLSLSALLGENIYNFGELLAHPIIKSLLGAKVEWLYYILEAFNTGDLVRYQELCNVHRAALSSQPALVENESKLLEKINILCLMEIIFSRPSEDRTIPLSVISERTKLSVEDVEYLLMKSLSVHLIEGIIDQVEGTVHVSWVQPRVLGISQIKSLRDRLNSWVDKVQTALVSVESEAPDLVAS

SEQ ID NO: 10048 - protein, 386 aa, Solanum lycopersicum
MAALQYLESLRNDHPELSDWYTTLADLYQRKLWHQLSLKLEQFVALAVFQAGDTLIQLYHNFITDFETKINLLKLAHFAVIVSRQYSEKDAGIGYLEGVAEKLQNTKETRIEEPILYIKLQIALFKLEQGDQKECKRLLEQGNATIDSMTDVDPSVYASYYWVSSQYHKTRQEFAEFYKSALLYLAYVSVDSLSESFKLDLAFDLSLSALLGDNVYNFGELLAHPIIKSLVGTQVEWLYHILEAFNTGDLVRYQELCRVHKAALSAQPALLQNEKKLLEKINILCLMEIIFSRPAEDRTIPLSAIAERTKLSVEDVEYLLMKSLSVHLIEGIIDQVEGTVHVSWVQPRVLGIPQIKSLRDRLDNWVDKVHTALLSVEAETPDLVSS

SEQ ID NO: 10049 - protein, 386 aa, Solanum lycopersicum
MAALQYLESLRNDHPELSDWYTTLADLYQRKLWHQLSLKLEQFVALAVFQAGDTLIQLYHNFITDFETKINLLKLAHFAVIVSRQYSEKDAGIGYLEGVAEKLQNTKETRIEEPILYIKLQIALFKLEQGDQKECKRLLEQGNATIDSMTDVDPSVYASYYWVSSQYHKTRQEFAEFYKSALLYLAYVSVDSLSESFKLDLAFDLSLSALLGDNVYNFGELLAHPIIKSLVGTQVEWLYHILEAFNTGDLVRYQELCRVHQAALSAQPALLQNEKKLLEKINILCLMEIIFSRPAEDRTIPLSAIAERTKLSVEDVEYLLMKSLSVHLIEGIIDQVEGTVHVSWVQPRVLGIPQIKSLRDRLDNWVDKVHTALLSVEAETPDLVSS

SEQ ID NO: 10050 - protein, 386 aa, Valeriana officinalis
MAALQYLDSLRNSHPELSDWYNTLSDLYQRKLWHQLTLKLEQFLALTVFQAGDALIQLYNNFITDFETKINLLKLAHFAVIVSRQYSDKDAAIGYLEGVIEKLRATRELRIEEPVLYIKMQRALFELERGNQKECKKLLEDGKSTLDSMTDVDPSVYASYYWVSSQYYKSRQEFADFYKSALLYLAYTSDDSLSESFKLDLAFDLSLSALLGESIYNFGELLAHPIVKSLTGTKVEWLYYILEAFNTGDLVRYQELCQVHRASLSAQPALVQNEKKLLEKINILCLMEIIFSRPSEDRTIPLSIIAERTKLTVEDVEYLLMKSLSVHLIEGIIDQVEGTVHVSWVQPRVLGIPQIKSLRDRLDNWMEKVHTALISVEAETPDLVAS

SEQ ID NO: 10051 - protein, 197 aa, Vaccinium corymbosum
MAALQYLENLRNAHPGLDDWFNTLSDLYQKKLWHQLTLKLEQFVSLPAFQGGDSLIQLYHNFIADFETKINLLKLAHFAVIVSRQYPEKEAAISFLEGVIEKLRATREMRIEEPILYIKMQIAIFNIEKGDQKECKKLLDDGKTTLDSMTDIDPSVYASYYWVSSQYYKSRQEFAEFYKKRSSLLGIHFSGVYIRII

SEQ ID NO: 10052 - protein, 393 aa, Cucumis sativus
MAALQYLDTLRNSHPELAEWYNTLADLYQKKLWHQLTLKLEQFVALTVFQAGDALIQLYHNFITDFETKINLLKLAHFAVIVSRQYAEKEAAISYLEGIIEKLRSTKELRIEEPILYIKMQIAIFKLEQGDQKECKKLLEDGKSTLDSMTDIDPSVYASYYWVSSQFYKSRKEFAEFYKSALLYLAYTSVESLSDSFKLDLAFDLSLSALLGDNIYNFGELLGHPIIKSLSGTKVEWLYYILQAFNSGDLVRYQELCQVHNAALRAQPALVDNEKKLLEKINILCLMEIIFRHAGLAPFRPSEDRTIPLKVIEERTKLSTEDVEHLLMKSLSVHLIEGIIDQVEGTVHVSWVQPRVLGIQQIKSLRDRLDNWVEKVHTALLSVEAETPDLVAS

SEQ ID NO: 10053 - protein, 387 aa, Capsicum annuum
ARGALQYLESQRSEHPELSEWYSTLADLYQRKLWHQLSLKLEQFVALAVFQAGDTLIQLYHNFITDFETKINLLKLAHFAVIVSRQYSEKEAAIGYLEGVAEKLQNTKETRIEEPILYIKLQIALFKLEQGDQKECKKLLEQGNATLDSMTDVDPSVYASYYWVSSQYHKTRQEFAEFYKSALLYLAYISVDSLSESFKLDLAFDLSLSALLGDNIYNFGELLAHPIIKSLVGTQVEWLYYILEAFNTGDLVRYQELCRVHQAALSAQPALLQNEKKLLEKINILCLMEIIFSRPAEDRTIPLSAIAERTKLSVEDVEYLLMKSLSVHLIEGIIDQVEGTVHVSWVQPRVLGISQVKSLRDRLDNWVDKVHTALLSVEAETPDLVAS

SEQ ID NO: 10054 - protein, 301 aa, Nicotiana tabacum
  misc_feature (137)..(137): Xaa can be any naturally occurring amino acid
  misc_feature (141)..(141): Xaa can be any naturally occurring amino acid
  misc_feature (191)..(191): Xaa can be any naturally occurring amino acid
  misc_feature (231)..(231): Xaa can be any naturally occurring amino acid
  misc_feature (289)..(289): Xaa can be any naturally occurring amino acid
  misc_feature (294)..(294): Xaa can be any naturally occurring amino acid
MAALEYLDSLRNAHPELSDWYNTLSDLYQRKLWHQLSLKLEQFVALAVFQAGDALIQLYHNFITDFETKINLLKLAHFAVIVSRRYAEKEAAIGYLEGVIEKLQNTKETRIEEPILYIKLQIALFKLEQGDQKDCKXLLEXGKTTLDSMTDIDPSVYASYYWVSSQYHKARQEFAEFYRSALLYLAYTSVXSLSESFKLDLAFDLSLSALLGDNIYNFGELLAHPIVNSLXGTKVEWLYHILEAFNTGDLIHYQELCHVHQAALNAQPALVQNEKKLLEKINILCLMEXSSVAXQKIELSH

SEQ ID NO: 10055 - protein, 386 aa, Aristolochia fimbriata
MSALQYLEAQRNKQPELADWYNSLADLYQRKLWHQLTLKLEQFVALAVFQAGDALIQLYHNFITDFETKINLLKLAHFAVIVSRQYSEKDAAISYLEGLIEKLRATKEMRIEEPVLYVKMQIAAFNIEKGEQKECKKLLEEGKIILDSMTDIDPSVYANYHWVSSQYHKSHQEFAEFYKSALLYLAYTTVESLSDSFKLDLAFDLSLSALLGDNIYNFGELLAHPIIKSLLGTPVEWLYYILQAFNSGDLVRYQELCRVHQAALTAQPALVQNEKKLLEKINILCLMEIIFSRPSEDRTIPLSVIAERTKLSIEDVEYLLMKSLSVHLIEGIIDQVEGTVHVSWVQPRVLGIPQIKSLRSRLDNWLEKVHTALLSVESEIPDLVAS

SEQ ID NO: 10056 - protein, 386 aa, Nicotiana benthamiana
MAALEYLDSLRNAHPELSDWHNTLSDLYQRKLWHQLSLKLEQFVALAVFQAGDALIQLYHNFITDFETKINLLKLAHFAVIVSRRYAEKEAAIGYLEGVIEKLQNTKETRIEEPILYIKLQIALFKLEQGDQKDCKFLLEEGKTTLDSMTDIDPSVYASYYWVSSQYHKARQEFAEFYRSALLYLAYTSVESLSESFKLDLAFDLSLSALLGDNIYNFGELLAHPIVNSLLGTKVEWLYHILEAFNTGDLIRYQELCRVHQAALNAQPALVQNKKKLLEKINILCLMEIIFSRAAEDRTIPMNVIAERTKLGVEDVEYLLMKSLSVHLIEGIIDQVEGTIHVSWVQPRVLGIPQIKSLRDRLDNWVEKVHTTLLAVEAETPDLVAS

SEQ ID NO: 10057 - protein, 386 aa, Olea europaea
MAALQYLDILRSTHPELSEWYNTLADLYQRKLWHQLTLKLEKFVALAVFQAGDALIQLYHNFITDFETKINLLKLAHFAVIVSRQYSEKEAAINYLEGVIEKLCNTKEMRVEEPILYIKMQIASFKLEQGYQKECKKLLENGKTTLDSMTDIDPSVYASYYWVSSQFHKSRQEFAEFYKSSLLYLAYTSVKSLSESFKLDLAFNLSLSALLGENIYNFGELLAHPIVKSLIGTKVEWLYYILEAFNSGDLVRYQELCQVHRAALSSQPALVQNEKNLLEKINILCLMETIFSRPSEDRTIALSVIAEGTKLTVEDVEHLLMKSLSVHLIEGIIDQVEGTVYVSWVQPRVLGIPQIKSLRGRLDNWMDKVHTALLSVEAETPDLVAA

SEQ ID NO: 10058 - protein, 386 aa, Capsicum annuum
MAALQYLESFCNANPQLNEWYTTLSDLYNRKLWHQLTLKLEQFVLLPLFQAGDGLIQLYHNFITDFETKINLLKLAHFAVVVSRQYPEKEAAIAFLEGVTEKLHNTKETRIEEPILYIKMQIALFKLEKGDPKECQKLLDKGKTTLDSMTDIDPSVYASYYWVSSQYHKARQEFADFYKSALLYLAYTSVESLSESFKLDLAFDLSLSALLGDNIYNFGELLAHPIIKSLIGTKVEWLYYILEAFNTGDLVHYQKLCNVHQAALNAQPALVQNEKKLLEKINILCLMEIIFSRPADDRTIPLSVIAQRTRLSVEDVEYLLMKSLSVHLIEGIIDQVEGTVHVSWVQPRVLGIPQIKSLRDRLDSWVDKVHTALLSVEAETPDLVAA

SEQ ID NO: 10059 - protein, 386 aa, Solanum phureja
MAALQYLESFCNAHSQLSDWYTTLADLYQRKLWHQLTLKLEQFVALPVFQAGDGLIQLYHNFITDFETKMNLLKLAHFAVIVSRQYPEKEAAIGFLEGVTEKLHNTKEIRIEEPILYIKMQIALFKLEQEDPKECQKLLDEGKTTLDSMTDIDPSVYASYYWVSSQYHKTRQEFAEFYKSALLYLAYTSVESLSESFKLDLAFDLSLSALLGDNIYNFGELLAHPIIKSLIGTKVEWLYYILEAFNTGDLVHYQKLCHVHQAALTAQPALVQNEKKLLEKINILCLMEIIFSRPADDRTIPLSVIAERTKLTVEDVEYLLMKSLSVHLIEGIIDQVEGTVHVSWVQPRVLGIPQIKSLRDRLDNWVDKVHTALLSVEAETPDLVAA

SEQ ID NO: 10060 - protein, 386 aa, Solanum lycopersicum
MAALQYLESFCNAPSQLSDWYTTLADLYQRKLWHQLTLKLEQFVALPVFKAGDGLIQLYHNFITDFETKINLLKLAQFAVIVSRQYPEKEAAIGFLEGVTEKLHNTKEIRIEEPILYIKMQIALFKLEQGDPKECQKLLDEGKTTLDSMTDIDPSVYASYYWVSSQYHKTRQEFAEFYKSALLYLAYTSVESLSESFKLDLAFDLSLSALLGDNIYNFGELLAHPIIKSLIGTKVEWLYYILEAFNTGDLVHYQKLCHVHQAALTAQPALVQNEKKLLEKINILCLMEIIFSRPAYDRTIPLSVIAERTKLSVEDVEYLLMKSLSVHLIEGIIDQVEGTVHVSWVQPRVLGIPQIKSLRDRLDNWVDKVHTALLSVEAETPDLVAA

SEQ ID NO: 10061 - protein, 387 aa, Elaeis guineensis
MAGALQYLESQRNAQPELADWYNALADLYQRKLWHQLTLKLEQFVALAVVQAGDALIQLYHNFITDFETKINLLKLAHFAVVVSRQYSEKEAAISYLEGVIEKLHATKDLRIEEPILYVKMQIAAFNLEKGNKKECKKLLEEGKATLDSMTDVDPSVHASYYWISSQYHKSCQEFAEFYKSALLYMAYTTVDSLSEAFKLDLAFDLSLSALLGDNIYNFGELLAHPIINSLLGTKVEWLYHILQAFNTGNLIRYQELCHVHNAALSAQPALVENEKKLLEKINILCLMEIIFSRPSEDRTIPLSIIAERTRLSIEDVEYLLMKSLSVHLIEGIIDQVEGTIHVSWVQPRVLGILQIKSLRDRLDAWIGKVHTTLLSVEAETPDLVAS

SEQ ID NO: 10062 - protein, 386 aa, Amsonia hubrichtii
MAALQYLDSLRNAHPELSDWYNTLADLYQRKLWHQLTQKLEQFVALAVFQAGDALIQFYHNFIADFETKINLLKLAHFAVIVSRQYAEKEAAISYLEGVIEKLRNTRELRIEEPILYIKMQMAYLKLQQGDQKECKKLLEEGKSTLDSMTDIDPSVYASYYWVSSQYHKARQEFAEFYKSALLFLAYTSVESLSDSFKLDLAFDLSLSALLGENIYNFGELLAHPIIKSLLGTKVEWLYYILEAFNSGDLVRYQELCNVHRAALSSQPALVQNENKLLEKINILCLMEIIFSRPSEDRTIPLRVISERTKLSVENVEYLLMKSLSVHLIEGIIDQVEGTVHVSWVQPRVLGISQIKSLRDRLDNWVDKVQTALVSVESEAPDLVAS

SEQ ID NO: 10063 - protein, 386 aa, Catharanthus roseus
MAALQYLDSLRNTHPELADWYNTLADLYQRKLWHQLTQKLEQFVALAVFQAGDALIQFYHNFIADFETKINLLKLAHFAVIVSRRYAEKEAAISYLEGVIEKLRNTRELRIEEPILYIKLQMAYLKLQQGDEKECKKLLEEGKSTLDSMTDIDPSVYASYYWVSSQYHKSRQEFAEFYKSALLFLAYTSVESLSESFKLDLAFDLSLSALLGENIYNFGELLSHPIIKSLLGSKVEWLYYILEAFNAGDLVRYQELCNVHQAALSSQPALVQNESKLLEKINILCLMEIIFSRPSEDRTIPLSVISERTKLSVENVEYLLMKSLSVHLIEGIIDQVEGTVHVSWVQPRVLGISQIKSLRDRLDSWVDKVQTALVSVESEAPDLVAS

SEQ ID NO: 10064 - protein, 386 aa, Aquilegia formosa
MAGLQYLESQRNAQPELAEWYNSLADLYQRKLWHQLTLKLDQFVALAVFQAGDALIQLYNNFITEFETKINLLKLAHFAVIVSRQYAERESAFSYLEGVIEKLQATKELRIEEPILYVKLQIAAFKLEKGDQKECKKILDDGKTTLDSMTDVDPSVYASFHWVSSQYHKFHREFSEFYRSSLLYLAYTSVESLSDTFKLDLAFDLSLSALLGDNIYNFGELLSHPIIKSLLGTKVEWIYYILQAFNAGDLVRYKELCSVHKAALVSQPALVENEKKLLEKINILCLMEIIFSRPSEDRTIPLNVIAERTKLSVEDVEYLLMKSLSVHLIEGIIDQVEGTVHVSWVQPRVLGIPQVKSLRDRLDNWLDKVHTALLSVEAETPDLVAS

SEQ ID NO: 10065 - protein, 386 aa, Olea europaea
MAAFEYLESLRNAHPELSEWYNTLADLYQRKLWHQLTLKLEQFVALPVFQAGDALIQLYNNFITDFETKINLLKLAHFAVVVSRQYTEKDAAINYLQGIIEKLRNTKEMRIEEPILYIKMQIAVYKLEQEDKKECQNLLEDGKSTLDSMTDIDPSVYACYYWISSQYHKSRQEFAEFYKNALLYLAYTSVQSLSESFKLDLAFDLALSALLGENIYNFGELLAHPIIKSLLGTKVEWLYYILEAFNSGDLVRYQELCRVHGAALSAQPALVQNDKKLLEKINILCLMEIIFSRPSEDRTIPLSVIAKRTKLTVEDVEYLLMKSLSVHLIEGIIDQVEETVHVSWVQPRVLGIPQIKSLRDRLVNWMDKVHTALLSVEAETPDLVAA

SEQ ID NO: 10066 - protein, 386 aa, Picea glauca
MAALKYLETQRAAQPELAEWYNSLADLYERKLWHQLTLKLEQFVALAVFQAGDALIQLYHNFITDFETKINLLKLAHFAVIVSRQYTEREAAISYLEGVIEKLRATRDIRLEEPILYVRMQIAALKLEQSEQKECKKLLDDGKNTLDSMTDIDPSVYASYHWVSSQYHKSRQEFAEFYKSALLFLAYTTVESLSEPFKLDLAFDLSLAALLGDNIYNFGELLAHPIVKSLLGTSVEWLYYILQAFNAGDLARYQELCHVHRAALNAQPALVENEKKLLEKINILCLMEIIFSRPSEDRTVPLSIIADRTKLSIEDVEYLLMKSLSVHLIEGVIDQVDGTVHVSWVQPRVLGIPQIKSLRDKLDNWLQKVHTTLLAVEAETPDLVAS

SEQ ID NO: 10067 - protein, 387 aa, Amorphophallus konjac
MAGALQYLESQRNAQPELAEWYSTLADLYQRKLWHQLTLKLEKFVALAVVQAGDELIQLYHNFITDFEMKINLLKLAHFAVIVSRQYSEKDAAISYLEGVIEKLRATRELRIEEPILYVKMQIATFNLEKGDQKECKKLLEDGKSTLDSMTDIDPSVHASYYWVSSQYHKSRQEFAEFYKNALLYLAYTTVESLSETFKLDLAFDLSLSALLGDNIYNFGELLAHPIINSLLGTNVEWLYYILQAFNTGNLVRYQELCRVHNAALSAQPSLVQNEKKLLEKINILCLMEIIFSRPSEDRTIPLSAIAERTSLSIEDVEYLLMKSLSVHLIEGVINQVEGTVHVSWVQPRVLGIPQIKALRDRLDDWLNKVHTALRSVEAETPDLAES

SEQ ID NO: 10068 - protein, 386 aa, Pseudotsuga menziesii
MAALKYLETQRASQPELSEWYNSLADLYERKLWHQLTLKLEQFVALAVFQAGDALIQLYHNFITDFETKINLLKLAHFAVIVSRQYTEREAAISYLEGVIEKLRATRDMRIEEPILYVRMQIAALKLEQTEQKECKKLLDDGKLTLDSMTDIDPSVYARYHWVSSQYHKSRQEFAEFYKSALLFLAYTTVESLSEPFKLDLAFDLSLAALLGDNIYNFGELLAHPIVKSLLGTSVEWLYYILQAFNAGDLARYQELCHVHRDALNAQPALVENEKKLLEKINILCLMEIIFSRPSEDRTVPLSIIADRTKLSIEDVEYLLMKSLSVHLIEGVIDQVDSTVHVSWVQPRVLGIPQIKSLRDKLDNWLQKVHTTLLAVEAETPDLVAS

SEQ ID NO: 10069 - protein, 386 aa, Silene vulgaris
MSAMEYLETQRNSHPELAEWYNVISDLYQKKLWHQLTLKLDNFLSLSLFQSGDSLIQLYHNFITDFETKINPLKLAHFAVIVSRQYGEKEAAVGYLEGIIEKLRATKETRIEEPILYIKMQISLFKLEQGEHKECKKLLEDGKTTLDSMTDIDPSVYATFFWVSSQYHKSRQEFAEFYKNALLYLAYTSVESLSDSFKLDLAFDLSLSALLGENIYNFGELLAHPILRSLLGTKVEWLYYILQAFNSGDLVRYQELCNVHKDALNAQPALVANERKLLEKINILCLMEIIFSRPAEDRTIPLSVIAERTKLSTEDVEYLLMKSLSVHLIEGIIDQVEGTVHVSWVQPRVLGVSQIKSLRDRLDSWVGKVHTALLSVEAETPDLVAS

SEQ ID NO: 10070 - protein, 386 aa, Abies balsamea
MAALKYLETQRAAQPELAEWYNSLADLYERKLWHQLTLKLEQFVALAVFQAGDALIQLYHNFITDFETKINLLKLGHFAVIVSRQYTEREAAISYLEGVIEKLRATRDMRIEEPILYVRMQIAALKLEQGEQKECKRLLDDGKTTLDSMTDIDPSVYASYHWVSCQYHKSRQEFAEFYKSALLFLAYTTVESLSEPFKLDLAFDLSLAALLGDNIYNFGELLAHPIVKSLLGTSVEWLYYILQAFNAGDLARYQELCHVHMAALNAQPALVENEKKLLEKINILCLMEIIFSRPSEDRTVPLSIIADRTKLSIEDVEYLLMKSLSVHLIEGVIDQVDGTVHVSWVQPRVLGIPQIKSLRDKLDNWLHKVHSTLLAVEAETPDLVAS

SEQ ID NO: 10071 - protein, 386 aa, Nicotiana benthamiana
MAALQYLESVCNANPELSDWYTTLSDLYQRKLWHQLTLKLDQFVSLPLFQAGDPLIQLYDNFITDFETKINLLKLAHFAVIVSRQYPEKEAAIGYLEGVTEKLRNTKETRIEEPILYIKMQIALFKLEQGDQKECQKLLDEGKTALDSMTDIDPSVYASYYWVSSQYHKARQDFAEFYKSSLLYLAYTSVESLSESFKLDLAFDLSLSALLGDNIYNFGELLAHPIIQSLVGTKVEWLYYILEAFNTGDLVRYQQLCHVHQAALSAQPALVQNEKRLLEKVNILCLMEIIFSRPADDRTIPLSVIAERTKLSVEDVEYLLMKSLSVHLIEGIIDQVEGTVHVSWVQPRVLGIPQIKSLRDRLDNWVDKVHTALLSVEAETPDLVAT

SEQ ID NO: 10072 - protein, 245 aa, Vinca minor
MAALQYLDSLRNSHPELSEWYNSLADLYQRKLWHQLTQKLDQFVALAVFQAGDALIQFYHNFIADFETKINLLKLAHFAVIVSRQYAEKEAAISYLEAVIEKLRNTRELRIEEPILYIKMQMAYLKLQQGDPKESKKLLEEGKSTLDSMTDIDPSVYASYYWVSSQYYKSRQEFAEFYKSALLFLAYTSVESLSESFKMDLAFDLSLSALLGENIYNFGELLAHPIIKSLTGSKVEWLYYILEAF

SEQ ID NO: 10073 - protein, 386 aa, Pinus pinaster
MAALKYLETQRAAQPELAEWYNALADLYERKLWHQLTLKLEQFVALAVFQAGDALIQLYHNFITDFETKINLLKLAHFAVIVSRQYTEREAAISYLEGVIEKLRATRDTRIEEPILYVRMQIAALKLEQSEQKECKKLLDEGKHTLDSMTDIDPSVYASYHWVSSQYHKSRQEFAEFYKSALLFLAYTTVESLSEPFKLDLAFDLSLAALLGDNIYNFGELLAHPIVKSLLGTSVEWLYYILQAFNAGDLARYQELCHVHRDALNAQPALVENEKKLLEKINILCLMEIIFSRPSEDRTVPLSIIADRTKLSIEDVEYLLMKSLSVHLIEGVIDQVDATVHVSWVQPRVLGIPQIKSLRDKLDNWLQKVHTTLLAVEAETPDLVAS

SEQ ID NO: 10074 - protein, 386 aa, Papaver somniferum
MAALQYLESQRSSQPELAEWYTSLIDLYQKKLWHQLTLKLDQFVALAVFQAGDTLIQLYHNFITEFETKINLLKLAHFAVIVSRQYAEKEASIGYLEGIIEKLRATRETRIEEPILYIKMQIAAFRLEKGEQKECKNLLDDGKTTLDSMTDIDPSVYASYYWVSSQYHKSRQEFAEFYNSGLLYLAYTPVESLSETFKLDLAFDLSLAALLGDNIYNFGELLAHPIIKSLLGTKVEWLYYLLQAFNSGDLVRYQELCAVHKAALNAQPALVQNEKKLLEKINILCLMEIIFSRPAEDRTIPLSIIAERTKLSVEDVELLLMKSLSVHLIEGIIDQVEATVHVSWVQPRVLGITQIESLRARLDSWVGKVHEALKSVEAETPDLVAS

SEQ ID NO: 10075 - protein, 386 aa, Papaver somniferum
MAALQYLESQRSAQPELAEWYTSLIDLYQKKLWHQLTLKLDQFVALAVFQAGDTLIQLYHNFITEFETKINLLKLAHFAVIVSRQYAEKEAAIGYLEGIIEKLRATRETRIEEPVLYIKMQIAAFRLEKGEQKECKNLLDDGKTTLDSMTDIDPSVYASYYWVSSQYHKSRQEFAEFYNSGLLYLAYTPVESLSETFKLDLAFDLSLAALLGDNIYNFGELLAHPIIKSLLGTKVEWLYYLLQAFNSGDLVRYQELCAVHKAALNAQPALVQNEKKLLEKINILCLMEIIFSRPAEDRTIPLRIIAERTKLSVEDVELLLMKSLSVHLIEGIIDQVEATVHVSWVQPRVLGISQIESLRARLDSWVGKVHTALQSVEAETPDLVAS

SEQ ID NO: 10076 - protein, 386 aa, Pinus taeda
MAALKYLETQRAAQPELAEWYNALADLYERKLWHQLTLKLEQFVALAVFQAGDALIQLYHNFITDFETKISLLKLAHFAVIVSRQYTEREAAISYLEGVIEKLRATRDTRIEEPILYVRMQIAALKLEQSEQKECKKLLDEGKHTLDSMTDIDPSVYASYHWVSSQYHKSRQEFAEFYKSALLFLAYTTVESLSEPFKLDLAFDLSLAALLGDNIYNFGELLAHPIVKSLLGTSVEWLYYILQAFNAGDLARYQELCHVHRDALNAQPALVENEKKLLEKINILCLMEIIFSRPSEDRTVPLSIIADRTKLSIEDVEYLLMKSLSVHLIEGVIDQVDATVHVSWVQPRVLGIPQIKSLRDKLDNWLQKVHTTLLAVEAETPDLVAS

SEQ ID NO: 10077 - protein, 355 aa, Ambrosia trifida
MASTHSQTRAIRPPSTVFQAGDALIQLYQNFITDFETKINLLKLAHFAVIVSRQYSEKEKAIEYLEGVIEKLRATKESRIEEPIVYIKMQIANFNLEKGDQKECKNLLEDGKSTLDSMTDIDPSVYANYYWVTSQYHKSRQEFAEFYKSSLLYLAYTSVESLSDSFKLDLAFDLSLSALLGDNIYNFGELLAHPIIKSLIGTQVEWLYYILEAFNNGDLVRYQELCRVHAASLNAQPALVENEKKLLEKINILCLMEIIFSRPSDERTIPLSIIADRTKLTVEDVEYLLMKSLSVHLIEGIIDQVEGTVHVSWVQPRVLGISQIKSLRDRLDNWAGKVHTALVSVEAETPDLVAS

SEQ ID NO: 10078 - protein, 274 aa, Brassica oleracea
MKLDTSGFETSMPTIGFESSNDMLDGFSTVPSFDLPRTTDFDGFQKEAVQMVKPAKGTTTLAFIFKEGVMVAADSRASMGGYISSQSVKKIIEINPYMLGTMAGGAADCQFWHRNLGIKCRLHELANKRRISVSGASKLLANMLYSYRGMGLSVGTMIAGWDETGPGLYYVDNEGGRLKGDRFSVGSGSPYAYGVLDSGYKFDMSVEEASELARRSIYHATFRDGASGGVASVYHVGPNGWKKLSGDDVGELHYHYYPVPPAIAEQVMEEAAAE

SEQ ID NO: 10079 - protein, 274 aa, Brassica napus
MKLDTSGFETSMPTIGFGSSNDMLDGFSTVPSFDLPRTTDFDGFQKEAVQMVKPARGTTTLAFIFKEGVMVAADSRASMGGYISSQSVKKIIEINPYMLGTMAGGAADCQFWHRNLGIKCRLHELANKRRISVSGASKLLANMLYSYRGMGLSVGTMIAGWDETGPGLYYVDNEGGRLKGDRFSVGSGSPYAYGVLDSGYKFDMSVEEASELARRSIYHATFRDGASGGVASVYHVGPNGWKKLSGDDVGELHYHYYPVPPAIAEQVMEEAAAE

SEQ ID NO: 10080 - protein, 274 aa, Brassica napus
MKLDTSGFETSMPTIGFGSSNDMLDGFSTVPSFDLPRTTDFDGFQKEAVQMVKPAKGTTTLAFIFKEGVMVAADSRASMGGYISSQSVKKIIEINPYMLGTMAGGAADCQFWHRNLGIKCRLHELANKRRISVSGASKLLANMLYSYRGMGLSVGTMIAGWDETGPGLYYVDNEGGRLKGDRFSVGSGSPYAYGVLDSGYKFDMTVEEASELARRSIYHATFRDGASGGVASVYHVGPNGWKKLSGDDVGELHYHYYPVPPAIAEQVMEEAAAE

SEQ ID NO: 10081 - protein, 274 aa, Brassica napus
MKLDTSGFETSMPTVGFGSSNDMLDGFSTVPSFDLPRTTDFDGFQKEAVQMVKPAKGTTTLAFIFKEGVMVAADSRASMGGYISSQSVKKIIEINPYMLGTMAGGAADCQFWHRNLGIKCRLHELANKRRISVSGASKLLANMLYSYRGMGLSVGTMIAGWDETGPGLYYVDNEGGRLKGDRFSVGSGSPYAYGVLDSGYKFDMSVEEASELARRSIYHATFRDGASGGVASVYHVGPNGWKKLSGDDVGELHYHYYPVPPAIAEQVMEEAAAE

SEQ ID NO: 10082 - protein, 274 aa, Brassica rapa
MKLDTSGFETSMPTIGFGSSNDMLDGFSTVPSFDLPRTTDFDGFQKEAVQMVKPAKGTTTLAFIFKEGVMVAADSRASMGGYISSQSVKKIIEINPYMLGTMAGGAADCQFWHRNLGIKCRLHELANKRRISVSGASKLLANMLYSYRGMGLSVGTMIAGWDETGPGLYYVDNEGGRLKGDRLSVGSGSPYAYGVLDSGYKFDMTVEEASELARRSIYHATFRDGASGGVASVYHVGPNGWKKLSGDDVGELHYHYYPVPPAIAEQVMEEAAAE

SEQ ID NO: 10083 - protein, 274 aa, Brassica rapa
MKLDTSGFETSMPTIGFGSSNDMLDGFSTVPSFDLPRTTDFDGFQKEAVQMVKPAKGTTTLAFIFIEGAMVAAASRASMGGYISSQSVKKIIEINPYMLGTMAGGAADCQFWHRNLGIKCRLHELANKRRISVSGASKLLANMLYSYRGMGLSVGTMIAGWDETGPGLYYVDNEGGRLKGDRFSVGSGSPYAYGVLDSGYKFDMSVEEASELARRSIYHATFRDGASGGVASVYHVGPNGWTKLSGDDVGELHYHYYPVPPAIAEQVMEEAAAE

SEQ ID NO: 10084 - protein, 274 aa, Raphanus sativus
MKLDTSGFETSMPTIGFGSSDDTLDGFSTVPSFDLPRTTDFDGFQKEAVQMVKPAKGTTTLAFIFKEGVMVAADSRASMGGYISSQSVKKIIEINPYMLGTMAGGAADCQFWHRNLGIKCRLHELANKRRISVSGASKLLANMLYSYRGMGLSVGTMIAGWDETGPGLYYVDNEGGRLKGDRFSVGSGSPYAYGVLDSGYKFDMSVEEASELARRSIYHATFRDGASGGVASVYHVGPNGWTKLSGDDVGELHYHYYPVPPATAEQVMEEAAAE

SEQ ID NO: 10085 - protein, 274 aa, Eutrema parvulum
MKLDTSGFETSMPTIGFGSSNDMLDGFSSVPSFDLPRTTDFDGFQKEAVQMVKPAKGTTTLAFIFKEGVMVAADSRASMGGYISSQSVKKIIEINPYMLGTMAGGAADCQFWHRNLGIKCRLHELANKRRISVSGASKLLANMLYSYRGMGLSVGTMIAGWDETGPGLYYVDNEGGRLKGDRFSVGSGSPYAYGVLDSGYKFDMSVEEASELARRSIYHATFRDGASGGVASVYHVGPNGWKKLSGDDVGELHYHYYPVAPATAEQVMEEAAAE

SEQ ID NO: 10086 - protein, 274 aa, Brassica rapa
MKLDTSGFETSMPTIGFGSSNDMLDGFTTVPSFDLPRTTDFDGFQKEAVQMVKPAKGTTTLAFIFKEGVMVAADSRASMGGYISSQSVKKIIEINPYMLGTMAGGAADCQFWHRNLGIKCRLHELANKRRISVSGASKLLANMLYSYRGMGLSVGTMIAGWDETGPGLYYVDNEGGRLKGDRFSVGSGSPYAYGVLDSGYKFDMSVEEASELARRSIYHATFRDGASGGVASVYHVGPNGWKKLSGDDVGELHYHYYPVPPSTAEQVMEEAAAE

SEQ ID NO: 10087 - protein, 274 aa, Brassica napus
MKLDTSGFETSMPTIGFESSNDMLDGFSTVPSFDLPRTTDFDGFQKEAVQMVKPAKGTTTLAFIFKEGVMVAADSRASMGGYISSQSVKKIIEINPYMLGTMAGGAADCQFWHRNLGIKCRLHELANKRRISVSGASKLLANMLYSYRGMGLSVGTMIAGWDETGPGLYYVDNEGGRLKGDRFSVGSGSPYAYGVLDSGYKFDMSVEEASELARRSIYHATFRDGASGGVASVYHVGPNGWKKLSGDDVGELHYHYYPVPPSTAEQVMEEAAAE

SEQ ID NO: 10088 - protein, 271 aa, Brassica juncea
DTSGFETSMPTIGFGSSNDMLDGFSTVPSFDLPRTTDFDGFQKEAVQMVKPAKGTTTLAFIFKEGVMVAADSRASMGGYISSQSVKKIIEINPYMLGTMAGGAADCQFWHRNLGIKCRLHELANKRRISVSGASKLLANMLYSYRGMGLSVGTMIAGWDETGPGLYYVDNEGGRLKGDRFSVGSGSPYAYGVLDSGYKFDMTVEEASELARRSIYHATFRDGASGGVASVYHVGPNGWKKLSGDDVGELHYHYYPVPPAIAEQVMEEAAAE

SEQ ID NO: 10089 - protein, 270 aa, Brassica napus
TSGFETTMPTIGFGSSNDMLDGFSTVPSFDLPRTTDFDGFQKEAVQMVKPAKGTTTLAFIFKEGVMVAADSRASMGGYISSQSVKKIIEINPYMLGTMAGGAADCQFWHRNLGIKCRLHELANKRRISVSGASKLLANMLYSYRGMGLSVGTMIAGWDETGPGLYYVDNEGGRLKGDRFSVGSGSPYAYGVLDSGYKFDMTVEEASELARRSIYHATFRDGASGGVASVYHVGPNGWKKLSGDDVGELHYHYYPVPPAIAEQVMEEAAAE

SEQ ID NO: 10090 - protein, 274 aa, Eutrema halophilum
MKLDTSGFETSMPLIGFGSSNDMLDGFSSVPSFDLPRTTDFDGFQKEAVQMVKPAKGTTTLAFIFKGGVMVAADSRASMGGYISSQSVKKIIEINPYMLGTMAGGAADCQFWHRNLGIKCRLHELANKRRISVSGASKLLANMLYSYRGMGLSVGTMIAGWDETGPGLYYVDNEGGRLKGDRFSVGSGSPYAYGVLDSGYKYDMSVEEASELARRSIYHATFRDGASGGVASVYHVGPNGWKKLSGDDVGELHYHYYPVAPATAEQVMEEAATE

SEQ ID NO: 10091 - protein, 273 aa, Eutrema halophilum
MKLDTSGFETTMPMIGFGSSSEMLDGFSSVPSFDLPRTTDFDGFQKEAVQMVKPAKGTTTLAFIFKEGVMVAADSRASMGGYISSQSVKKIIEINPYMLGTMAGGAADCQFWHRNLGIKCRLHELANKRRISVSGASKLLANMLYSYRGMGLSVGTMIAGWDETGPGLYYVDNEGGRLKGDRFSVGSGSPYAYGVLDSGYKFDMSVEEASELARRSIYHATFRDGASGGVASVYHVGPNGWKKLSGDDVGELHYHYYPVVPATAEQEMEEATE

SEQ ID NO: 10092 - protein, 273 aa, Eutrema parvulum
MKLDTSGFETTMPMIGFGSSSEMLDGFSSVPSFDLPRTTDFDGFQKEAVQMVKPAKGTTTLAFIFKEGVMVAADSRASMGGYISSQSVKKIIEINPYMLGTMAGGAADCQFWHRNLGIKCRLHELANKRRISVSGASKLLANMLYSYRGMGLSVGTMIAGWDETGPGLYYVDNEGGRLKGDRFSVGSGSPYAYGVLDSGYKFDMSVEEASELARRSIYHATFRDGASGGVASVYHVGPKGWKKLSGDDVGELHYHYHPVVPATAEQVMEEAAE

SEQ ID NO: 10093 - protein, 273 aa, Eutrema parvulum
MKLDTSGLETTMPMIGFGSNNEMLDGFSSVPSFDLPRTTDFDGFQKEAVQMVKPAKGTTTLAFIFKEGVMVAADSRASMGGYISSQSVKKIIEINPYMLGTMAGGAADCQFWHRNLGIKCRLHELANKRRISVSGASKLLANMLYSYRGMGLSVGTMIAGWDETGPGLYYVDNEGGRLKGDRFSVGSGSPYAYGVLDSGYKFDMSVEEASELARRSIYHATFRDGASGGVASVYHVGPKGWKKLSGDDVGELHYHYHPVVPATAEQVMEEAAE

SEQ ID NO: 10094 - protein, 274 aa, Arabidopsis lyrata
MKLDTSGFETSMPMIGFGSSSDMLDELSSVPSFDLPRTKEFDGFQKEAKDMLKHAKGTTTLAFIFKGGVMVAADSRASMGGYISSQSVKKIIEINPYMLGTMAGGAADCQFWHRNLGIKCRLHELANKRRISVSGASKLLANMLYSYRGMGLSVGTMIAGWDETGPGLYYVDNEGGRLKGDRFSVGSGSPYAYGVLDSGYKYDMSVEEASELARRSIYHATFRDGASGGVASVYHVGPEGWTKLSGDDVGELHYHYYPVAPAIAEQVMEEATAE

SEQ ID NO: 10095 - protein, 273 aa, Arabidopsis lyrata
MKLDTSGLETTMPVIGFGSNSEMLDGFSSVPSFDLPRTTDFDGFQKKAVEMVKPAKGTTTLAFIFKEGVMVAADSRASMGGYISSQSVKKIIEINPYMLGTMAGGAADCQFWHRNLGIKCRLHELANKRRISVSGASKLLANMLYSYRGMGLSVGTMIAGWDETGPGLYYVDNEGGRLKGDRFSVGSGSPYAYGVLDSGYKFDMSVEEASELARRSIYHATFRDGASGGVASVYHVGPQGWKKLSGDDVGELHYHYYPVTPVTAEHVMEEAAE

SEQ ID NO: 10096 - protein, 273 aa, Arabidopsis thaliana
MKLDTSGLETTMPVIGFGSNSEMLDGFSSAPSFDLPRTTDFDGFQKKAVEMVKPAKGTTTLAFIFKEGVMVAADSRASMGGYISSQSVKKIIEINPYMLGTMAGGAADCQFWHRNLGIKCRLHELANKRRISVSGASKLLANMLYSYRGMGLSVGTMIAGWDETGPGLYYVDNEGGRLKGDRFSVGSGSPYAYGVLDSGYKFDMSVEEASELARRSIYHATFRDGASGGVASVYHVGPQGWTKLSGDDVGELHYHYYPVAPITAEHVMEEAAE

SEQ ID NO: 10097 - protein, 274 aa, Arabidopsis thaliana
MKLDTSGFETSMPMIGFGSSSDMLDELSSVPSFDLPRTKEFDGFQKKAKDMLKHAKGTTTLAFIFKGGVMVAADSRASMGGYISSQSVKKIIEINPYMLGTMAGGAADCQFWHRNLGIKCRLHELANKRRISVSGASKLLANMLYSYRGMGLSVGTMIAGWDETGPGLYYVDNEGGRLKGDRFSVGSGSPYAYGVLDSGYKYDMSVEEASELARRSIYHATFRDGASGGVASVYHVGPEGWTKLSGDDVGELHYHYYPVAPATAEQVMEEATAE

SEQ ID NO: 10098 - protein, 271 aa, Cleome gynandra
MKLDTSGFESAVPMFGGSSENEMLDGLSAVPSFDLPLTTDFDGFQKEAVQMVKPAKGTTTLAFIFKEGVMVAADSRASMGGYISSQSVKKIIEINPYMLGTMAGGAADCQFWHRNLGIKCRLHELANKRRISVSGASKLLANMLYSYRGMGLSVGTMIAGWDETGPGLYYVDNEGGRIKGDRFSVGSGSPYAYGVLDSGYKFDMTVEEAAELARRSIYHATFRDGASGGVASVYHVGPNGWKKLSGDDVGELHYKYYPVTPITTEQVMAEA

SEQ ID NO: 10099 - protein, 246 aa, Brassica juncea
MKLDTSGFETSMPTIGFGSSNDMLDGFSTVPSFDLPRTTDFDGFQKEAVQMVKPAKGTTTLAFIFKEGVMVAADSRASMGGYISSQSVKKIIEINSYMLGTMAGGAADCQFWHRNLGIKCRLHELANKRRISVSGASKLLANMLYSYRGMGLSVGTMIAGWDETGPGLYYVDNEGGRLKGDRFSVGSGSPYAYGVLDSGYKFDMSVEEASELARRSIYHATFRDGASGGVASVYHVGPNGWKKLSG

SEQ ID NO: 10100 - protein, 272 aa, Manihot esculenta
MKLDTSGLESAAPLFGVTSELVDGFSTVPSFELPVTTDFDGFQKEAIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGTRFSVGSGSPYAYGVLDSGYRYDLSIEEAAELARRAIYHATFRDGASGGVASVYHVGPNGWKKLSGDDVGELHYKYYPVMPSTVEQEMVEVAGA

SEQ ID NO: 10101 - protein, 273 aa, Lactuca sativa
MKLDFSGLESSAPLYGGSDDLLSDGFSDAPSFDLPVTSDFDGFQKNSIQMVKPAKGTTTLAFIFKEGVMVAADSRASMGGYISSQSVKKIIEINPYMLGTMAGGAADCQFWHRNLGIKCRLHELANKRRISVTGASKMLANILYSYRGMGLSVGTMIAGWDEKGPGLYYVDSEGGRLKGTKFSVGSGSPYAYGVLDSGYQYDMSIEEAAELARRSIYHATFRDGASGGVASVYHVGPTGWTKLSGDDVGELHYSYYPVEPAIVEQEMTEAVAA

SEQ ID NO: 10102 - protein, 272 aa, Theobroma cacao
MKLDTSGLESAAPVWAAFNELADGFSAAPSFELPNTTDFDGFQKEAIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGMRFSVGSGSPYAYGVLDSGYRYDMSVEEAAELARRAIYHATFRDGASGGVASVYHVGPNGWKKLSGDDVGELHYKYYPVMPSTVEQEMVEVAGA

SEQ ID NO: 10103 - protein, 272 aa, Theobroma cacao
MKLDTSGLESAEPVWATFNELADGFSAAPSFELPNTTDFDGFQKEAIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGMRFSVGSGSPYAYGVLDSGYRYDMSVEEAAELARRAIYHATFRDGASGGVASVYHVGPNGWKKLSGDDVGELHYKYYPVMPSTVEQEMVEVAGA

SEQ ID NO: 10104 - protein, 272 aa, Glycyrrhiza uralensis
MKLDTSGLESFPTLIAPGNDVVGDFSAPPSFELPNSKDFDGFLKEAIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGTRFSVGSGSPYAYGVLDSGYKYDMSVEEAAELARRAIYHATFRDGASGGVASVYHVGPNGWKKLSGDDVGELHYHYYPVTPSTVEQEMVEATGA

SEQ ID NO: 10105 - protein, 86 aa, Ambrosia trifida
MKLDFSGLESSAPLYGGSNELLCDGFSAAPSFDLPVTSDFDGFQKNSIQMVKPAKGTTTLAFIFKEGVMVAADSRASMGAISHLNP

SEQ ID NO: 10106 - protein, 272 aa, Vitis vinifera
MKLDTSGLESTVPLFGANSELLGGFSAAPSFELPNTTDFDGFQKDAIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGTRFSVGSGSPYAYGVLDNGYRYDMSVEEAAELARRSIYHATFRDGASGGVASVYYVGPNGWKKLSGDDVGELHYKYYPVMPSTVEQEMVEVAGA

SEQ ID NO: 10107 - protein, 273 aa, Ambrosia trifida
MKLDFSGLESSAPLYGGSNELLCDGFSAAPSFDLPVTSDFDGFQKNSIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGTKFSVGSGSPYAYGVLDSGYKYDLTIDEAAELARRAIYHATFRDGASGGVASVYHVGPNGWTKLSGDDVGELHYSYYPVEPAIVEQEMTEAVAA

SEQ ID NO: 10108 - protein, 272 aa, Fagus grandifolia
MKLDTSGLESTVPPFASSSGLLDGFSAAPSFELPTTIDFDGFQKDAIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGTRFSVGSGSPYAYGVLDNGYRYDMSIEEAAELARRSIYHATFRDGASGGVASVYYVGPEGWKKLSGDDVGELHYHYYPVTPSTVEQEMIEVAGT

SEQ ID NO: 10109 - protein, 273 aa, Flaveria ramosissima
MKLDFSGLESSAPLYGENNELLCDGFSAAPSFDLPVTSDFDGFQKNSIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGTKFSVGSGSPYAYGVLDSGYKYDLSIDEAAELARRAIYHATFRDGASGGVASVYHVGPNGWTKLSGDDVGELHYSYYPVEPAIVEQEMTEAVAA

SEQ ID NO: 10110 - protein, 272 aa, Gossypium raimondii
MKLDTTGMESAAPVWGSHNELVDGFSAAPSFELPNTTDFDGFQKEAIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDNEGGRLKGMRFSVGSGSPYAYGVLDNGYRYDMSVEEAAELARRAIYHATFRDGASGGVASVYYVGPNGWKKLSGDDVGELHYRYYPVMPSTVEQEMAEVTGA

SEQ ID NO: 10111 - protein, 272 aa, Carica papaya
MKLDTSGLESATPLFCARSENVDGFSTNPSFDLPQTTDFDGFQKEAIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDNEGGRLKGTRFSVGSGSPYAYGVLDNGYRYDMSIEEAAELARRAIYHATFRDGASGGVASVYYVGPDGWKKLSGDDVGELHYKYYPVMPSTVEQEMVEVAGA

SEQ ID NO: 10112 - protein, 273 aa, Ambrosia trifida
MKLDFSGLESSAPLYGGSNELLCDGFSAAPSFDLPVTSDFDGFQKNSIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGTKFSVGSGSPYAYGVLDSGYKYDLTIDEAAELARRAIYHATFRDGASGGVASVYHVGPNGWTKLSGDDVGELHYSYYPVEPAVVEQEMTEAVAA

SEQ ID NO: 10113 - protein, 273 aa, Tragopogon dubius
MKLDFSGLDSSAPLYGGSNDLLSDGFSAAPSFDLPVTSDFDGFQKSSIQMVKPAKGTTTLAFIFKDGVMVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGTKFSVGSGSPYAYGVLDSGYRYDMTIDEAAELARRSIYHATFRDGASGGVASVYHVGPTGWTKLSGDDVGELHYSYYPVEPAIVEQEMTEAVAA

SEQ ID NO: 10114 - protein, 272 aa, Unknown
  Sequence found in Organisms: Gossypium hirsutum, Gossypium raimondii
MKLDTSGLESAAPVWGAPSELVDGFSAAPSFDLPNTTDFDGFQKEAIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGMRFSVGSGSPYAYGVLDNGYRYDMSVEEAAELARRAIYHATFRDGASGGVASVYYVGPNGWKKLSGDDVGELHYKYYPVMPSTVEQEMVEVGGA

SEQ ID NO: 10115 - protein, 272 aa, Gossypium raimondii
MKLDTTGMESAAPVWGSHNELVDGFSAAPSFELPNTTDFDGFQKEAIQMVKPAKGTTTLAFIFKEGVMVAADSRASMGGYISSQSVKKIIEINPYMLGTMAGGAADCQFWHRNLGTKCRLHELANKRRISVTGASKLLANILYSYRGMGLSVGTMIAGWDETGPGLYYVDNEGGRLKGMRFSVGSGSPYAYGVLDNGYRYDMSVEEAAELARRAIYHATFRDGASGGVASVYYVGPNGWKKLSGDDVGELHYRYYPVMPSTVEQEMVEVTGA

SEQ ID NO: 10116 - protein, 90 aa, Fagus grandifolia
MKLDTSGLESTVPPFASSSGLLDGFSAAPSFELPTTIDFDGFQKDAIQMVKPAKGTTTLAFIFKEGVMVAADSRASMGGYISSQSSKENH

SEQ ID NO: 10117 - protein, 90 aa, Fagus grandifolia
MKLDTSGLESTAPLFGTRSELLDGFSATPSFELPNTINFDGFQKEAIQMVKPAKGTTTLAFIFKEGVMVAADSRASMGGYISSQSSKENH

SEQ ID NO: 10118 - protein, 272 aa, Gossypium hirsutum
MKLDTTGMESAAPVWGSHNELVDGFSAAPSFELPNTTDFDGFQKEAIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDEMGPGLYYVDNEGGRLKGMRFSVGSGSPYAYGVLDNGYRYDMSVEEAAELARRAIYHATFRDGASGGVASVYYVGPNGWKKLSGDDVGELHYRYYPVMPSTVEQEMAEVTGA

SEQ ID NO: 10119 - protein, 272 aa, Gossypium raimondii
MKLDTSGLESAAPVSGAPSELVDGFSAAPSFDLPNTTDFDGFQKEAIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGMRFSVGSGSPYAYGVLDNGYRYDMSVEEAAELARRAIYHATFRDGASGGVASVYYVGPNGWKKLSGDDVGELHYKYYPVMPSTVEQEMVEVGGA

SEQ ID NO: 10120 - protein, 272 aa, Prunus mume
MKLDTSGLESAAPLVGASSGFLDGFADAPSFEVPTTNDFDGFQKEAIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGMRFSVGSGSPYAYGVLDNGYRYDMSVEEAAELARRAIYHATFRDGASGGVASVYHVGPNGWKKLSGDDVGELHYHYYPVVQGAVEQEMVEVAGA

SEQ ID NO: 10121 - protein, 272 aa, Prunus persica
MKLDTSGLESAAPLVGASSGFLDGFADAPSFEVPTTNDFDGFQKEAIQMVKPAKGTTTLAFIFKDGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGMRFSVGSGSPYAYGVLDDGYRYDMSVEEAAELARRAIYHATFRDGASGGVASVYHVGPNGWKKLSGDDVGELHYHYYPVVEGAVEQEMVEVAAA

SEQ ID NO: 10122 - protein, 273 aa, Arnica chamissonis
MKLDFSGLESSAPLYGGNNELLSDGFSAAPSFDLPVTSDFDDFQKNSIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGTKFSVGSGSPYAYGVLDSGYKYDMSIDEAAELARRAIYHATFRDGASGGVASVYHVGPTGWTKLSGDDVGELHYSYYPVEPAIVEHEMTEAVAV

SEQ ID NO: 10123 - protein, 273 aa, Cichorium intybus
MKLDFSGLESHAPLYGGSNDLLSDGLSDAPSFDLPVTSDFDGFQKNSIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGTKFSVGSGSPYAYGVLDSGYRYDMTIDEAAELARRSIYHATFRDGASGGVASVYHVGPTGWTKLSGDDVGELHYSYYPVAPAIVEQEMTEAVVA

SEQ ID NO: 10124 - protein, 273 aa, Cichorium intybus
MKLDFSGLESHAPLYGGSNDLLSDGLSDAPSFDLPVTSDFDGFQKNSIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGTKFSVGSGSPYAYGVLDSGYRYDMTIDEAAELARRSIYHATFRDGASGGVASVYHVGPTGWTKLSGDDVGELHYSYYPVAPAIVEQEMSEAVVA

SEQ ID NO: 10125 - protein, 273 aa, Cirsium arvense
MKLDFGGLESSAPLYGGNDDLLSDGFSTAPSFDLPVTSDFDGFQKNSIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGTKFSVGSGSPYAYGVLDSGYHYDMTIDEAAELARRSIYHATFRDGASGGVASVYHVGPTGWTKLSGDDVGELHYSYYPVEPAIVEQEMTEAVVA

SEQ ID NO: 10126 - protein, 273 aa, Euphorbia peplus
MKLDTSRFESVTPFGAPSELVDGFGFSTAPSFELPVTTDFDGFQKEAVQMVKPAKGTTTLAFIFKDGIMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGMRFSVGSGSPYAYGVLDSGYKFDMSIDEAAELARRSIYHATFRDGASGGVASVYYVGPDGWKKLSGDDVGELHYKYYPVTPSTVEQEMVEVTGA

SEQ ID NO: 10127 - protein, 273 aa, Flaveria ramosissima
MKLDFSGLESSAPLYGENNELLCDGFSAAPSFDLPVTSDFDGFQKNSIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGTKFSVGSGSPYAYGVLDSGYKYDLTIDEAAELARRAIYHATFRDGASGGVASVYHVGPNGWTKLSGDDVGELHYSYYPVEPAIVEQEMTEAVVA

SEQ ID NO: 10128 - protein, 273 aa, Flaveria ramosissima
MKLDFSGLESSAPLYGENNELLCDGFSEAPSFDLPVTSDFDGFQKNSIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGTKFSVGSGSPYAYGVLDSGYKYDLTIDEAAELARRAIYHATFRDGASGGVASVYHVGPNGWTKLSGDDVGELHYSYYPVEPAIVEQEMTEAVVA

SEQ ID NO: 10129 - protein, 266 aa, Guizotia abyssinica
MKLDFSGLESSAPLYGGSNELLSDGFSAAPSFDLPVTSDFDDFQKNSIQMVKPAKGTTTLAFIFKEGVMVAADSRASMGGYISSQSVKKIIEINPYMLGTMAGGAADCQFWHRNLGIKCRLHELANKRRISVTGASKLLANLLYSYRGMGLSVGTMIAGWDEKGPGLYYVDSEGGRLKGKKFSVGSGSPYAYGVLDSGYKYDMTIDEAAELARRAIYHAHSVMELVAVLLVFTMWAQLDGQSYRVTMLVNFTTITTLLNPPLLNKK

SEQ ID NO: 10130 - protein, 270 aa, Malus domestica
MKLDTSGLESHAPHLFGESSGFLDGVSGPPSFEVPTTNDFDGFQKEAIQMVKPAKGTTTLAFIFKDGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGMRFSVGSGSPYAYGVLDNGYRYDMSVEEAAELARRAIYHATFRDGASGGVASVYHVGPNGWKKLSGDDVGELHYHYYPVVAGSVEQEMVEV

SEQ ID NO: 10131 - protein, 272 aa, Gossypium hirsutum
MKLDTTGMESAAPVWGSHNEFVDEFSAAPSFELPNTTDFDGFQKEAIQMVKPAKGTTTLAFIFKEGVMVAADSRASMGGYISSQSVKKIIEINPYMLGTMAGGAADCQFWHRNLGTKCRLHELANKRRISVTGASKLLANILYSYRGMGLSVGTMIAGWDETGPGLYYVDNEGGRLKGMRFSVGSGSPYAYGVLDNGYRYDMSVEEAAELARRAIYHATFRDGASGGVASVYYVGPNGWKKLSGDDVGELHYRYYPVMPSTVEQEMVEVTGA

SEQ ID NO: 10132 - protein, 273 aa, Flaveria ramosissima
MKLDFSGLESGAPLCGGNNELLCDGFSAAPSFDLPVTSDFDEFQKNSIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGTKFSVGSGSPYAYGVLDSGYKYDMTIDEAAELARRAIYHATFRDGASGGVASVYHVGPTGWTKLSGDDVGELHYSYYPVEPAIVEQEMTEAAAA

SEQ ID NO: 10133 - protein, 272 aa, Heritiera littoralis
MKLDTSGLESVAPVWGAPNELVDGLSIVPTFELPNTTDFDGFQKEAIQMVKPAKGTTTLAFIFKEGVTVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGMRFSVGSGSPYAYGVLDNGYRYDMSVEEAAELARRAIYHATFRDGASGGVASVYYVGPNGWKKLSGDDVGELHYKYYPVMPSTVEQEMVEVAGA

SEQ ID NO: 10134 - protein, 271 aa, Juglans hindsii x Juglans regia
  misc_feature (236)..(236): Xaa can be any naturally occurring amino acid
  misc_feature (257)..(257): Xaa can be any naturally occurring amino acid
  misc_feature (259)..(259): Xaa can be any naturally occurring amino acid
  misc_feature (269)..(270): Xaa can be any naturally occurring amino acid
MKLDTSGLEPTAPFGSSNELNDGFSAAPSFEIPDTIDFDGFQKEAVQMVKPAKGTTTLAFIFKEGVMVAADSRASMGGYISSQSVKKIIEINPYMLGTMAGGAADCQFWHRNLGIKCRLHELANKRRISVTGASKLLANILFSYRGMGLSVGTMIAGWDETGPGLYYVDSEGGRLKGTRFSVGSGSPYAYGVLDNGYRYDMSIEEAAELARRAIYHATFRDAASGGVASVYYVGPXGWKKLSGDDVGELHYEYYPVXPXTVEQEMVEVXXA

SEQ ID NO: 10135 - protein, 273 aa, Centaurea maculosa
MKLDFGGLESSAPLYGGNDDVLSDGFSAAPSFDLPVTSDFDGFQKNSIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGTKFSVGSGSPYAYGVLDSGYHYDMTIDEAAELARRSIYHATFRDGASGGVASVYHVGPTGWTKLSGDDVGELHYSYYPVEPAIVEQEMTEAVVA

SEQ ID NO: 10136 - protein, 273 aa, Centaurea maculosa
MKLDFGGLESSAPLYGGNDDVLADGFSAAPSFDLPVTSDFDGFQKNSIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGTKFSVGSGSPYAYGVLDSGYHYDMTIDEAAELARRSIYHATFRDGASGGVASVYHVGPTGWTKLSGDDVGELHYSYYPVEPAIVEQEMTEAIVA

SEQ ID NO: 10137 - protein, 272 aa, Glycine max
MKLDTTGLESFPTLLAPQNDVVGELSAAPSFDLPNSNDFDGFVKEAIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGTRFSVGSGSPYAYGVLDSGYRYDLSVEEAAELARRAIYHATFRDGASGGVASVYYVGPNGWKKLSGDDVGELHYHYYPVTPSTVEQEMVEATGA

SEQ ID NO: 10138 - protein, 272 aa, Malus domestica
MRLDTSGLESRAPLFGESSGFLDGVSAPPSFEVPTTNDFDGFQKEAIQMVKPAKGTTTLAFIFKDGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGMRFSVGSGSPYAYGVLDDGYRYDMSVEEAAELARRAIYHATFRDGASGGVASVYHVGANGWKKLSGDDVGELHYSYYPVVAGAVEQEMVEVAAH

SEQ ID NO: 10139 - protein, 273 aa, Artemisia annua
MKLDFSGLESSAPLYGGSNDLLFDGFSAAPAFDLPVTSNFDEYQKKSVQMVKPAKGTTTLAFIFKDGVMVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGTKFSVGSGSPYAYGVLDSGYRYDMTVDEAAELARRSIYHATFRDGASGGVASVYHVGPNGWTKLSGDDVGELHYSYYPVEPATVEQEMTEAVVA

SEQ ID NO: 10140 - protein, 273 aa, Centaurea maculosa
MKLDFGGLESSAPLYGGNDDVLADGFSAAPSFDLPVTSDFDGFQKNSIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGTKFSVGSGSPYAYGVLDSGYHYDMTIDEAAELARRSIYHATFRDGASGGVASVYHVGPTGWTKLSGDDVGELHYSYYPVEPAIVEQEMTEAVVA

SEQ ID NO: 10141 - protein, 273 aa, Taraxacum officinale
MKLDFSGLESSAPLYGGSDDLHSDALSDAPSFDLPVTSDFDGFQKSSIQMVKPAKGTTTLAFIFKEGVMVAADSRASMGGYISSQSVKKIIEINPYMLGTMAGGAADCQFWHRNLGIKCRLHELANKRRISVTGASKMLANILYSYRGMGLSVGTMIAGWDEKGPGLYYVDSEGGRLKGNKFSVGSGSPYAYGVLDSGYRYDMSIDEAAELARRSIYHATFRDGASGGVASVYHVGPNGWTKLSGDDVGELHYSYYPVQPAVVEQEMAEAVAA

SEQ ID NO: 10142 - protein, 273 aa, Flaveria ramosissima
MKLDFSGLESGAPLCGGNNELLCDEFSAAPSFDLPVTSDFDEFQKNSIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGTKFSVGSGSPYAYGVLDSGYKYDMTINEAAELARRAIYHATFRDGASGGVASVYHVGPTGWTKLSGDDVGELHYSYYPVEPAIIEQEMTEAAAA

SEQ ID NO: 10143 - protein, 272 aa, Cajanus cajan
MKLDTTGLESFPTLLAPQNDVVGDLSAAPSFDLPNSNDFDGFLKEAIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGTRFSVGSGSPYAYGVLDSGYRYDLSVEEAAELARRAIYHATFRDGASGGVASVYYVGPNGWKKLSGDDVGELHYHYYPVTPSTVEQEMVEATGA

SEQ ID NO: 10144 - protein, 273 aa, Helianthus annuus
MKLDFSGLESSAPLYGGPNELLCDGFSAAPSFDLPVTSDFDGFQKNSIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGTKFSVGSGSPYAYGVLDSGYKYDLTIDEAAELARRAIYHATFRDGASGGVASVYHVGPTGWTKLSGDDVGELHYSYYPVEPAVVEQEMTEAVAA

SEQ ID NO: 10145 - protein, 236 aa, Liriodendron tulipifera
  misc_feature (230)..(230): Xaa can be any naturally occurring amino acid
MKLDTSGLESFTPFHGGGNDLCGGFSSVPSFELPSSTNFDDFQKKAMQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGTRFSVGSGSPYAYGVLDNGYRYDMSIEEAAELARRSIYHATFRDGASGGVAXRLSRWT

SEQ ID NO: 10146 - protein, 273 aa, Unknown
  Sequence found in Organisms: Centaurea maculosa, Cirsium arvense
MKLDFGGLESGAPLYGGNDDVLSDGFSAAPSFDLPVTSDFDGFQKNSIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGTKFSVGSGSPYAYGVLDSGYHYDMTIDEAAELARRSIYHATFRDGASGGVASVYHVGPTGWTKLSGDDVGELHYSYYPVEPAIVEQEMTEAVVA

SEQ ID NO: 10147 - protein, 273 aa, Arnica chamissonis
MKLDFSGLESSAPLYGGNNGLLCDGFSDAPSFDLPVTSDFDGFQKNSIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGTKFSVGSGSPYAYGVLDSGYKYDMTIDEAAELARRAIYHATFRDGASGGVASVYHVGPTGWTKISGDDVGELHYSYYPVEPAIVEHEMTEAVVA

SEQ ID NO: 10148 - protein, 273 aa, Castanea mollissima
MKLDTSGLESTAPLFGSLSSGIHDEISAAPSFALPNTINFDGFQKEAIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGTRFSVGSGSPYAYGVLDNGYRYDMSIEEAAELARRSIYHATFRDGASGGVASVYYVGPDGWKKLSGDDVGELHYHYYPVMPSTVEQEMVEVTGA

SEQ ID NO: 10149 - protein, 273 aa, Quercus alba
MKLDTSGLESTAPLFGSLSSGIHDEISAAPSFALPNTINFDGFQKEAIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGTRFSVGSGSPYAYGVLDNGYRYDMSIEEAAELARRSIYHATFRDGASGGVASVYYVGPDGWKKLSGDDVGELHYHYYPVMPSTVEQEMVEVTGQ

SEQ ID NO: 10150 - protein, 272 aa, Lupinus angustifolius
MKLDTSGLESFSTQLGIQSNIIGEISSSTSFDLPNSNDFDGFVKEAIQMVKPAKGTTTLAFIFKDGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGTRFSVGSGSPYAYGVLDSGYKYDMSIEEASELARRAIYHATFRDGASGGVASVYYVGPNGWKKLSGDDVGELHYHYYPVIPSTVEQEMTEAPGV

SEQ ID NO: 10151 - protein, 273 aa, Artemisia annua
MKLDFSGLESSAPLYGGNDNLLSDGFSDAPSFDLPVTSDFDGFQKNSIQMVKPAKGTTTLAFIFKDGVMVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGTKFSVGSGSPYAYGVLDSGYNYDMSIDEAAELARRAIYHATFRDGASGGVASVYHVGPTGWTKLSGDDVGELHYSYYPVEPAVVEHEMTEAVTA

SEQ ID NO: 10152 - protein, 272 aa, Vaccinium corymbosum
MKFDTSGLESHVLHSGVSDDLLSGFPTAPSFEIPSATDFDGFQKEAIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGMRFSVGSGSPYAYGVLDSGYRYDMSVEEAAELARRSIYHATFRDGASGGVASVYHVGPDGWKKLSGDDVAELHYNYYPVEATVVEHEMAETSAA

SEQ ID NO: 10153 - protein, 272 aa, Cicer arietinum
MKLDTSGLESFPSLISHGNDVVGEFEAPPSFELPNSNDFDGFLKEAIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGTRFSVGSGSPYAYGVLDSGYKYDMSIEEASELARRAIYHATFRDGASGGVASVYYVGPTGWKKLSGDDVGELHYHYNPVTPSTVEQEMVEATGP

SEQ ID NO: 10154 - protein, 272 aa, Humulus lupulus
MKLDTSGLESSAPLFGVSNELVDGLSTAPSFDLPSNVDLDGFLKDTIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGTRFSVGSGSPYAYGVLDDGYRYDMSIEEASELARRAIYHATFRDGASGGVASVYYVGPSGWKKLSGDDVGELHYHYYPVTAGAVEQEMVEVSGA

SEQ ID NO: 10155 - protein, 270 aa, Lotus japonicus
MKLDTTGLESFPKLVAPGNDVVGEFTAPPSFELPNSNDFDGFVKEAIQMVKPAKGTTTLAFIFKDGVMVAADSRASMGGYISSQSVKKIIEINPYMLGTMAGGAADCQFWHRNLGIKCRLHELANKRRISVTGASKMLANILYSYRGMGLSVGTMIAGWDETGPGLYYVDSEGGRLKGTRFSVGSGSPYAYGVLDSGYKYDMSVEEAAELARRAIYHATFRDGASGGVASVYHVGPNGWKKLSGDDVGELHYHYNPVVPSTVEQEMVEAA

SEQ ID NO: 10156 - protein, 274 aa, Platanus occidentalis
MKLDMSGLESVSPLFGASNELGSGFTTATAPSFELPSITDFDGFQKEAKQTLKHAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGTRFSVGSGSPYAYGVLDSGYRYDMSVEEAAELARRSIYHATFRDGASGGVASVYYVGPDGWKKLSGDDVGELHYKYYPVVPATVEQEMVEVTVA

SEQ ID NO: 10157 - protein, 266 aa, Cynara scolymus
  misc_feature (266)..(266): Xaa can be any naturally occurring amino acid
MKLDFGGLESSAPLYGGSDDVLSDGFSAAPSFDLPVTSDFDGFQKNSIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGTKFSVGSGSPYAYGVLDSGYHYDMTIDEAAELARRSIYHATFRDGASGGVASVYHVGPTGWTKLSGDDVGELHYSYYPVEPAIVEQX

SEQ ID NO: 10158 - protein, 273 aa, Eucalyptus grandis
MKLDTSGLESTMPVFGVNKELFEGFSAAPAFEIPGACDFDNFQKEAVQMVKPAKGTTTLAFIFKEGVMVAADSRASMGGYISSQSVKKIIEINPHMLGTMAGGAADCQFWHRNLGIKCRLHELANKRRISVTGASKLLANILYSYRGMGLSVGTMIAGWDETGPGLYYVDSEGGRLKGTRFSVGSGSPYAYGVLDSGYRYDMSVEEAAELARRAIYHATFRDGASGGVASVYHVGPTGWKKLSGDDVGELHYHYHPVTPSTVEQEMAEVVAAP

SEQ ID NO: 10159 - protein, 305 aa, Flaveria ramosissima
TLSDSRSSFSVFPIESTYQRSLLFFSITRRKSVKLDFSGLESGAPLCGGNNELLCDVFSAAPSFDLPVTSDFDEFQKNSIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGTKFSVGSGSPYAYGVLDSGYKYEMTIDEAAELARRAIYHATFRDGASGGVASVYHVGPTGWTKLSGDDVGELHYSYYPVEPAIVEQEMTEAAAA

SEQ ID NO: 10160 - protein, 271 aa, Aristolochia fimbriata
MKLDTSGLETFAPFHGANGDLCGELSSVPSFSLPKADNFDDFQKKAVQMVKPAKGTTTLAFIFKEGVIVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGTRFSVGSGSPYAYGVLDNGYRYDMSVEEAAELARRSIYHATFRDGASGGVASVYYVGPNGWKKLSGDDVGELHYKYYPVVPSPVEQEMAEVAS

SEQ ID NO: 10161 - protein, 272 aa, Phaseolus vulgaris
MKLDTTGLESFPSLLAPQSDVVGALSAAPSFDLPNSNDFDGFLKEAIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGTRFSVGSGSPYAYGVLDSGYRYDLSVEEAAELARRAIYHATFRDGASGGVASVYYVGPNGWKKLSGDDVGELHYHYYPVTPSTVEQEMVEAPGA

SEQ ID NO: 10162 - protein, 272 aa, Tropaeolum majus
MKLDTSGLESVAPLCDEGTENIHGFINAPSFELPNTTDFDGFVKDAVQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGPRFSVGSGSPYAYGVLDNGYRYDMSIEEAAELARRAIYHATFRDGASGGVASVYYVGSEGWKKLSGDDVGELHYHYYPVTPSTVEQEMGEVAGA

SEQ ID NO: 10163 - protein, 270 aa, Vinca minor
IDFSGLESRASILGNSNELFNGLSIAPEFQIPRTDNFDGFQKEAIQMVKPAKGTTTLAFIFKEGVVVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGNRFSVGSGSPYAYGVLDSGYKFDMSVEEAAELARRSIYHATFRDGASGGVVSVYHVGPNGWKKMSGDDVGELHYHYYPVEPTMVEQEMTEASTS

SEQ ID NO: 10164 - protein, 273 aa, Ambrosia trifida
MKLDFSGLESSAPLYGGKNELLSDGFSAAPSFDLPVTSDFDDFQKNSIQMVKPAKGTTTLAFIFKDGVMVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGTKFSVGSGSPYAYGVLDSGYKYDLTIDEAAELARRAIYHATFRDGASGGVASVYHVGPNGWTKLSGDDVGELHYSYYPVEPATVEHEMTEAVVA

SEQ ID NO: 10165 - protein, 272 aa, Vigna unguiculata
MKLDTTGLESFPTLLAPQSDVVGELSAAPSFDLPNSNDFDGFLKEAIQMVKPAKGTTTLAFIFKEGVIVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGTRFSVGSGSPYAYGVLDSGYRYDLSIEEAAELARRAIYHATFRDGASGGVASVYYVGPNGWKKLSGDDVGELHYHYYPVTPSTVEQEMVEATGA

SEQ ID NO: 10166 - protein, 269 aa, Actinidia deliciosa
MKFDTSGLESHGQLVGASDGLFSGFPTAPSFEIPNTTDFDCFQKEAIQMVKPAKGTTTLAFIFKEGVMVAADSRASMGGYISSQSVKKIIEINPYMLGTMAGGAADCQFWHRNLGIKCRLHELANKRRISVTGASKLLANILYNYRGMGLSVGTMIAGWDETGPGLYYVDSEGGRLKGMRFSVGSGSPYAYGVLDNGYRYDMSVEEAAELARRSIYHATFRDGASGGVASVYYVGPDGWKKLSGDDVAELHYSYYPVEPAVVEQVMVET

SEQ ID NO: 10167 - protein, 272 aa, Unknown
  Sequence found in Organisms: Solanum lycopersicum, Solanum tuberosum
MKIDFSGLEPSAPLRGESSELFDGISNSPSFHLPNTANFDGFQKEAIQMVKPAKGTTTLAFIFKGGVMVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGNRFSVGSGSPYAYGVLDNGYRYDLSVEEAAELARRAIYHATFRDGASGGVASVYHVGPNGWKKLSGDDVGELHYHYYPVEVAAVEQEMAEVPVA

SEQ ID NO: 10168 - protein, 268 aa, Rosa hybrid cultivar
MKFDFSSLQTTAPLLGDSGGFSAAPSFEVPVTDDFDGFQKEAIQMVKPAKGTTTLAFIFKDGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGMRFSVGSGSPYAYGVLDNGYHYDMSVEEAAELARRAIYHATFRDGASGGVASVYHVGPNGWKKLSGDDVGELHYTYYPVTPETVEQEMVEVGAA

SEQ ID NO: 10169 - protein, 272 aa, Glycine max
MKLDTTSLESFPTLIAPQNDVAGELSAAPFFDLPNSNDFDGFLKDAIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGTRFSVGSGSPYAYGVLDSGYRYDLSVEEAAELARRAIYHATFRDGASGGVASVYYVGPNGWKKLSGDDVGELHYHYYPVTPSTVEQEMVEATGA

SEQ ID NO: 10170 - protein, 272 aa, Tabernaemontana elegans
MKIDFSGIEPRASVLGNGNELLSGLSTAPEFQIPNTDNFDGFQKEAIQMVKPAKGTTTLAFIFKEGVIVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGNRFSVGSGSPYAYGVLDSGYRFDMSVEEAAELARRAIYHATFRDGASGGVVSVYHVGPNGWKKLSGDDVGELHYLYYPVEPAVVEQEMAEVPVS

SEQ ID NO: 10171 - protein, 272 aa, Trigonella foenum-graecum
MKLDTTGLESFPSLISHGINVAGEISAPPSFELPNSHDFDGFVKEAIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGTRFSVGSGSPYAYGVLDSGYKYDMSIEEASELARRAIYHATFRDGASGGVASVYYVGPTGWKKLSGDDVGELHYHYNPVTPSTVEQEMVEAAGP

SEQ ID NO: 10172 - protein, 205 aa, Flaveria ramosissima
MVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGTKFSVGSGSPYAYGVLDSGYKYDMTIDEAAELARRAIYHATFRDGASGGVASVYHVGPTGWTKLSGDDVGELHYSYYPVEPAVIEQEMTEAAAA

SEQ ID NO: 10173 - protein, 275 aa, Euonymus alatus
MKLDTSGLESPMPHFGAGSEILAGISTAQSAQSFEVPDVTNFDAFQKEATQMLKHAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGMRFSVGSGSPYAYGVLDNGYHYDMSVEEAAELARRAIYHATFRDGASGGVASVYHVGPNGWKKLSGDDVGELHYHYYPVTPSTVEQEMTEVAGA

SEQ ID NO: 10174 - protein, 275 aa, Euonymus alatus
MKLDTSGLESPMPHFGAGSEILAGISTAQSAQSFEVPDVTNFDAFQKEATQMLKHAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGMRFSVGSGSPYAYGVLDNGYRYDMSVEEAAELARRAIYHATFRDGASGGVASVYHVGPNGWKKLSGDDVGELHYHYYPVTPSTVEQEMTEVAGA

SEQ ID NO: 10175 - protein, 272 aa, Panax ginseng
MKIDFSGLESSASFCGANTELFDGFSTTPSFQIPDTTDFDGFQKDAIQMVKPAKGTTTLAFIFKEGVMVAADSRASMGGYISSQSVKKIIEINPHMLGTMAGGAADCQFWHRNLGIKCRLHELANKRRISVTGASKLLANILYSYRGMGLSVGTMIAGWDEKGPGLYYVDSEGGRLKGTRFSVGSGSPYAYGVLDSGYHYDMTIEEAAELARRSIYHATFRDGASGGTASVYYVGPNGWKKLSGDDVGELHYKYYPVEPAVVEQEMAEVSGA

SEQ ID NO: 10176 - protein, 273 aa, Ambrosia trifida
MKLDFSGLESGAPLYGGKNELLSDGFSAAPSFDLPVTSDFDDFQKNSIQMVKPAKGTTTLAFIFKDGVMVAADSRASMGGYISSQSVKKIIEINPYMLGTMAGGAADCQFWHRNLGVKCRLHELANKRRISVTGASKLLANILYSYRGMGLSVGTMIAGWDEKGPGLYYVDSEGGRLKGTKFSVGSGSPYAYGVLDSGYKYDLTIDEAAELARRAIYHATFRDGASGGVASVYHVGPNGWTKLSGDDVGELHYSYYPVEPATVEHEMTEAVAA

SEQ ID NO: 10177 - protein, 273 aa, Helianthus annuus
MKFDFSGLESSAPLYGLNNELLSDGFSAAPSFDLPVTSDFDDFQKNSIQMVKPAKGTTTLAFIFKDGVMVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGTKFSVGSGSPYAYGVLDSGYKYDLTIDEAAELARRAIYHATFRDGASGGVASVYHVGPNGWTKLSGDDVGELHYSYYPVEPATVEHEMTEAVVA

SEQ ID NO: 10178 - protein, 273 aa, Centaurea maculosa
MKLDFKGLESSTPLYGESNGMLFDGFSAAASFEVPVTSDFDEYQKKSVQMVKPAKGTTTLAFIFKDGVMVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGTKFSVGSGSPYAYGVLDSGYHYDMTIDEAAELARRSIYHATFRDGASGGVASVYHVGPNGWTKLSGDDVGELHYSYYPVEPTVVEQEMAEAVVA

SEQ ID NO: 10179 - protein, 266 aa, Flaveria ramosissima
MKLDFSGLESGAPLCGENNELLSDGFSAAPSFDLPVTSDFDEFQKNSIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGTKFSVGSGSPYAYGVLDSGYKYDMTIDEAAELARRAIYHATFRDGASGGVASVYHVGPTGWTKLSGDDVVNFTTHTILLSPPSLNRK

SEQ ID NO: 10180 - protein, 194 aa, Gerbera hybrid cultivar
MKLDFSGLESSAPLYGGSNELLFDGFSNALSFEVPVTSDFDGFQKNAIQMVKPAKGTTTLAFIFKEGVMVAADSRASMGGYISSQSVKKIIEINPYMLGTMAGGAADCQFWHRNLGIKCRLHELANKRRISVTGASKMLANILYSYRGMGLSVGTMIAGWDEKGPGLYYVDSEGGRLKGTKFSVDLVPHMPMVY

SEQ ID NO: 10181 - protein, 224 aa, Vinca minor
MVKPAKGTTTLAFIFKEGVIVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGNRFSVGSGSPYAYGVLDSGYKFDMSVEEAVELARRSIYHATFRDGASGGVVSVYHVGPNGWTKMSGDDVGELHYHYYPVDPTMVEQEMAEASTS

SEQ ID NO: 10182 - protein, 272 aa, Chenopodium quinoa
MKLDTSGLESTAPLFRRSDAVFDGLQMTPSFDLPNPTDFDGFQKEAVQMVKPAKGTTTLAFIFKHGVMVAADSRASMGGYISSQSVKKIIEINPYMLGTMAGGAADCQFWHRNLGIKCRLHELANKRRISVTGASKLLANILYNYRGMGLSVGTMIAGWDETGPGLYYVDSEGGRLKGMRFSVGSGSPYAYGVLDNGYRYDMTVEEASELARRAIYHATYRDGASGGVVSVYHVGPDGWKKLTGDDVGELHYQYNPVVPATVEQEMVEVVGA

SEQ ID NO: 10183 - protein, 273 aa, Triphysaria pusilla
MKIDFSGLDPVAPIRGNRDDDLTDEISEIPSFKLPNHVDFDGFQKASVQMVKPAKGTTTLAFIFKGGVMVAADSRASMGGYISSQSVKKIIEINPYMLGTMAGGAADCQFWHRNLGIKCRLHELANKRRISVAGASKMLANILYSYRGMGLSVGTMIAGWDEQGPGLYYVDSEGGRLKGTRFSVGSGSPYAYGVLDSGYRFDMSVEEAAELARRSIYHATFRDGASGGVASVYHVGPVGWKKLSGDDVGELHYHYYPVEAAIVEQEMSEVTIA

SEQ ID NO: 10184 - protein, 272 aa, Persea americana
MKLDTSGLESFASFRGGSEILSSDFSQVPSFELPRSADFDEFQKKAVQMVKPAKGTTTLAFIFKEGVIVAADSRASMGGYISSQSVKKIIEINPYMIGTMAGGAADCQFWHRNLGIKCRLHELANKRRISVTGASKLLANILYSYRGMGLSVGTMIGGWDETGPGLYYVDSEGGRLKGTRFSVGSGSPYAYGVLDNGYRYDMSIEEAAELARRSIYHATFRDGASGGVVSVYYVGPDGWKKLSGDDVGELHYKYYPVVPSSVEQEMAEVAAT

SEQ ID NO: 10185 - protein, 272 aa, Eschscholzia californica
MKLDSGLENSSTILLGGSNAFGTDFSAPPSFELPITHDFDDYQKKSVQMVKPAKGTTTLAFIFKEGVMVAADSRASMGGYISSQSVKKIIEINPYMLGTMAGGAADCQFWHRNLGVKCRLHELANKRRISVTGASKLLANILYSYRGMGLSVGTMIAGWDEKGPGLYYVDSEGGRLKGMKFSVGSGSPYAYGVLDNGYRYDMSVEEAAELARRAIYHATFRDAASGGVASVYHVGPNGWTKMSGDDVGELHYKYYPVVPTTVEQEMAEVPAA

SEQ ID NO: 10186 - protein, 272 aa, Unknown
  Sequence found in Organisms: Solanum tuberosum, Solanum phureja
MKIDFSGLEPRAPLRGESSELFDGISNSPSFHLPNTANFDGFQKEAIQMVKPAKGTTTLAFIFKGGVMVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGNRFSVGSGSPYAYGVLDNGYRYDLSVEEAAELARRAIYHATFRDGASGGVASVYHVGPNGWKKLSGDDVGELHYHYYPVEVAAVEQEMAEVPVA

SEQ ID NO: 10187 - protein, 272 aa, Salvia sclarea
MKIDFSGLDPAMPVKANGDDLDDEILAAPSFKLPVTVDFDGFQKAAVQMVKPAKGTTTLAFIFKDGVMVAADSRASMGGYISSQSVKKIIEINPYMLGTMAGGAADCQFWHRNLGIKCRLHELANKRRISVAGASKLLANILYSYRGMGLSVGTMIAGWDEQGPGLYYVDSEGGRLKGTRFSVGSGSPYAYGVLDSGYRFDLSVEEAAELARRAIYHATFRDGASGGVASVYHVGPSGWKKLSGDDVGELHYSYYPVEPTTVEQEMAEVAIA

SEQ ID NO: 10188 - protein, 272 aa, Silene vulgaris
MKLDTSGLESTAPLVGARHVIMDGLQMTPSFDLPNTSNFDGFQKEAIQMVKPAKGTTTLAFIFKEGVIVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGMRFSVGSGSPYAYGVLDNGYRFDMSIKEAAELARRSIYHATFRDAASGGVASVYYVGPNGWEKLSGDDVGELHFEYYPVVPATVEHEMVEVGAA

SEQ ID NO: 10189 - protein, 275 aa, Euonymus alatus
MKLDTSGLESPMQHFGAGNGILEGISTAQSAESFEVPDVTNFDAFQKETTQMLKHAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGMRFSVGSGSPYAYGVLDNGYRYDMSVEEAAELARRAIYHATFRDGASGGVASVYHVGPNGWKKLSGDDVGELHYHYYPVTPSTVEQEMTEVAGA

SEQ ID NO: 10190 - protein, 273 aa, Cirsium arvense
MKLDFKGLESNAPLYGESNGMLFDGFSAAASFEVPVTSDFDEYQKKSVQMVKPAKGTTTLAFIFKDGVMVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGTKFSVGSGSPYAYGVLDSGYHYDMTIDEAAELARRSIYHATFRDGASGGVASVYHVGPNGWTKLSGDDVGELHYSYYPVEPTVVEQEMAEAVVA

SEQ ID NO: 10191 - protein, 266 aa, Triphysaria pusilla
MKLDFSGLDPVAPIRGNRDDELTDEISDIPSFKLPSHVDFDGFQKASVQMVKPAKGTTTLAFIFKGGVMVAADSRASMGGYISSQSVKKIIEINPYMLGTMAGGAADCQFWHRNLGIKCRLHELANKRRISVAGASKMLANILYSYRGMGLSVGTMIAGWDEQGPGLYYVDSEGGRLKGTRFSVGSGSPYAYGVLDSGYRFDMSVEEAAELARRSIYHATFRDEPVVVLLACITWGQSGGKSYQVMTLENFTIITILLKLQSSNKR

SEQ ID NO: 10192 - protein, 272 aa, Chenopodium quinoa
MKLDTSGLESTAPLFRRSDAVFDGLQMTPSFDLPNPTNFDGFQKEAVQMVKPAKGTTTLAFIFKHGVMVAADSRASMGGYISSQSVKKIIEINPYMLGTMAGGAADCQFWHRNLGIKCRLHELANKRRISVTGASKLLANILYNYRGMGLSVGTMIAGWDETGPGLYYVDSEGGRLKGMRFSVGSGSPYAYGVLDNGYRYDMTVEEASELARRAIYHATYRDGASGGVVSVYHVGPDGWKKLTGDDVGELHYQYNPVVPATIEQEMVEVIGA

SEQ ID NO: 10193 - protein, 273 aa, Triphysaria pusilla
MKIDFSGLDPVAPIRGNRDDELTDEISEIPSFKLPNHVDFDGFQKASVQMVKPAKGTTTLAFIFKGGVMVAADSRASMGGYISSQSVKKIIEINPYMLGTMAGGAADCQFWHRNLGIKCRLHELANKRRISVAGASKMLANILYSYRGMGLSVGTMIAGWDEQGPGLYYVDSEGGRLKGTRFSVGSGSPYAYGVLDSGYRFDMSVEEAAELARRSIYHATFRDGASGGVASVYHVGPVGWKKLSGDDVGELHYHYYPVEAAIVEQEMSEVTTT

SEQ ID NO: 10194 - protein, 228 aa, Brassica juncea
EAVQMVKPAKGTTTLAFIFKEGVMVAADSRASMGGYISSQSVKKIIEINPYMLGTMAGGAADCQFWHRNLGIKCRLHELANKRRISVSGASKLLANMLYSYRGMGLSVGTMIAGWDETGPGLYYVDNEGGRLKGDRFSVGSGSPYAYGVLDSGYKFDMSVEEASELARRSIYHATFRDGASGGVASVYHVGPNGWKKLSGDDVGELHYHYYPVPPAIAEQVMEEAAAE

SEQ ID NO: 10195 - protein, 272 aa, Chelidonium majus
MKLDSGLENSSTILLGGSNELDTDFSAPPSFELPITTNFDDFQKKSVQMVKPARGTTTLAFIFKDGVMVAADSRASMGGYISSQSVKKIIEINPYMLGTMAGGAADCQFWHRNLGVKCRLHELANKRRISVTGASKLLANILYSYRGMGLSVGTMIAGWDEKGPGLYYVDSEGGRLKGTRFSVGSGSPYAYGVLDNGYRYDMSVEEAAELARRAIYHATFRDAASGGVASVYHVGPNGWKKLSGDDVGELHYKYYPVVPSTVEQEMTEVPIA

SEQ ID NO: 10196 - protein, 272 aa, Solanum melongena
MKIDFSGFEPSAPLRGESSELFDGISNSPSFHLPNTANFDGFQKEAIQMVKPAKGTTTLAFIFKGGVMVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGNRFSVGSGSPYAYGVLDNGYRYDLSVEEAAELARRAIYHATFRDGASGGVASVYHVGPNGWKKLSGDDVGELHYQYYPAEIAAVEQEMADVPVA

SEQ ID NO: 10197 - protein, 272 aa, Fraxinus spp
MKIDFSGLAASAPLCGNTDELNNEISTGQKFELPIADDFDGFQREAVRMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGTRFSVGSGSPYAYGVLDSGYRFDMSVEEGAELARRAIYHATFRDGASGGVASVYHVGPNGWKKLSGDDVGELHYMYYPVEPASVEQEMTEVSGS

SEQ ID NO: 10198 - protein, 272 aa, Nicotiana benthamiana
MKIDFSGLEPTAPLKGESSVLCDGILSSPSFQIPNTTNFDGFQKEAIQMVKPAKGTTTLAFIFKGGVMVAADSRASMGGYISSQSVKKIIEINPYMLGTMAGGAADCQFWHRNLGIKCRLHELANKRRISVAGASKLLANILYSYRGMGLSVGTMIAGWDEKGPGLYYVDSEGGRLKGNRFSVGSGSPYAYGVLDSGYRFDLSVEEAAELARRAIYHATFRDGASGGVASVYHVGPNGWKKLSGDDVGELHYNYYPVELESVEQEMAEVPVA

SEQ ID NO: 10199 - protein, 272 aa, Citrus sinensis
MKLDTSGLESTSPFFGSGDELCPELSAAPSFSLPLSTDFDEFQKDTKATLKHAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGTRFSVGSGSPYAYGVLDSGYKFDMSIEEAAELARRAIYHATFRDAASGGVASVYYVGPNGWKKLSGDDVGELHYHYYPVTPSTVEQEMAEVAGA

SEQ ID NO: 10200 - protein, 272 aa, Petunia hybrida
MKIDFSGLEPSAPLRGESSELFDGIQSSPSFQIPNTTNFDGFQKEAIQMVKPAKGTTTLAFIFKDGVMVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGTRFSVGSGSPYAYGVLDNGYRYDLSVEEAAELARRAIYHATFRDGASGGVASVYHVGPNGWKKLSGDDVGELHYNYYPVEAAAVEQEMAEVPVA

SEQ ID NO: 10201 - protein, 269 aa, Sarracenia psittacina
MKFDTSGLETNGMFLGSNDELFSGFPTTPSFEIPSTTDFDGFQKEAIQMVKPAKGTTTLAFIFKEGVMVAADSRASMGGYISSQSVKKIIEINPYMLGTMAGGAADCQFWHRNLGIKCRLHELANKRRISVTGASKLLANILYNYRGMGLSVGTMIAGWDETGPGLYYVDNDGGRLKGMRFSVGSGSPYAYGVLDNGYRYDMTVDEAAELARRAIYHATFRDGASGGVASVYHVGPNGWKKLSGDDVAELHYNYYPVESTVVEQEMAET

SEQ ID NO: 10202 - protein, 272 aa, Tabernaemontana elegans
MKIDFSGLDSTPRFLGNSDDLLSGISTAPAFQIADTNDFDGFQNEAIQMVKPAKGTTTLAFIFKEGVIVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGNRFSVGSGSPYAYGVLDSGYRFDMSVEDAAELARRAIYHATFRDGASGGVASVYHVGPNGWKKLSGDDVGELHYTYYPVETTPIEQEMAEVSIS

SEQ ID NO: 10203 - protein, 272 aa, Citrullus lanatus
MKLDTSGLESAAFLSGAGSADLLNGLSSAPSFDIPNATNFDGFQKEAIQMVKPAKGTTTLAFIFKEGVMVAADSRASMGRYISSQSVKKIVEINPYMLGTMAGGAADCQFWHRNLGIKCRPHELANKRRISVTGASKLLANILYSYRGMGLSVGTMIAGWDETGPGLYYVDSEGGRLKGIRFSVGSGSPYAYGVLDNGYRYDLSVEEAAELGRRAIYHATFRDGASGGVASVYYVGPNGWKKLSGDDVGELHYKYYPVVSDTVEQKMLEVAQ

SEQ ID NO: 10204 - protein, 275 aa, Tripterygium wilfordii
MKLDTSGLESPMLHFGAGNEIVEGISSAQSVESFEVPDVTNFDAFQKEATQMLKHAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGMRFSVGSGSPYAYGVLDNGYQYDMSVEEAAELARRAIYHATFRDGASGGVASVYHVGPNGWKKLSGDDVGELHYKYYPVTPGTVEQEMTEVAGA

SEQ ID NO: 10205 - protein, 272 aa, Amsonia hubrichtii
MKIDFSGLEPRASVPGNANELLNGISTAPEFQIPNTENFDGFQKEAIQMVKPAKGTTTLAFIFKEGVIVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGNRFSVGSGSPYAYGVLDSGYRFDMSVEEAVELARRAIYHATFRDGASGGVVSVYHVGPNGWKKMSGDDVGELHYMYYPVEPTVVEQEMAEVSVS

SEQ ID NO: 10206 - protein, 271 aa, Medicago truncatula
MLDTTALESFPSLISHGINVAGEISAPPSFQLPNSNDFDGFVKETIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGNRFSVGSGSPYAYGVLDSGYKYDMSVEEASELARRAIYHATFRDGASGGVASVYYVGPTGWKKLSGDDVGELHYHYNPVTPSTVEQEMVEAAGP

SEQ ID NO: 10207 - protein, 273 aa, Triphysaria pusilla
MKIDFSGLDPVAPIRGNRDDELTDEISEIPSFKLPSHVDFDGFQKASVQMVKPAKGTTTLAFIFKGGVMVAADSRASMGGYISSQSVKKIIEINPYMLGTMAGGAADCQFWHRNLGIKCRLHELANKRRISVAGASKMLANILYSYRGMGLSVGTMIAGWDEQGPGLYYVDSEGGRLKGTRFSVGSGSPYAYGVLDSGYRFDMSVEEAAELARRSIYHATFRDGASGGVASVYHVGPVGWKKLSGDDVGELHYHYYPVEPATVEQEMADVPVA

SEQ ID NO: 10208 - protein, 272 aa, Citrus clementina
MKLDTSGLESTSPFFGSGDELCPELLAAPSFALPLSTDFDEFQKDTKATLKHAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGTRFSVGSGSPYAYGVLDSGYKFDMSIEEAAELARRAIYHATFRDAASGGVASVYYVGPNGWKKLSGDDVGELHYHYYPVTPSTVEQEMAEVAGA

SEQ ID NO: 10209 - protein, 272 aa, Cucumis melo
MKLDTSGLQTTAPMFGPRMEALEGFAAAPSFEIPNSSDFDGFQKDAIQMVKPAKGTTTLAFIFKEGVMVAADSRASMGGYISSQSVKKIIEINPYMLGTMAGGAADCQFWHRNLGVKCRRHELANKRRISVAGASKLLANILYSYRGMGLSVGTMIAGWDETGPGLYYVDSEGGRLKGTRFSVGSGSPYAYGVLDNGYRYDLSVEEAAELARRAIYHATFRDGASGGVASVYYVGPNGWKKLSGDDVGELHYNYYPVTPTTVDQEMTEVTAA

SEQ ID NO: 10210 - protein, 272 aa, Nicotiana benthamiana
MKIDFSGLEPTAPIKGESSELCDGILSSPSFQIPNATNFDGFQKEAIQMVKPAKGTTTLAFIFKGGVMVAADSRASMGGYISSQSVKKIIEINPYMLGTMAGGAADCQFWHRNLGIKCRLHELANKRRISVAGASKLLANILYSYRGMGLSVGTMIAGWDEKGPGLYYVDSEGGRLKGNRFSVGSGSPYAYGVLDSGYRFDLSVEEAAELARRAIYHATFRDGASGGVASVYHVGPNGWKKLSGDDVGELHYSYYPVELESVEQEMAEVPVA

SEQ ID NO: 10211 - protein, 272 aa, Unknown
  Sequence found in Organisms: Nicotiana benthamiana, Nicotiana tabacum
MKIDFSGLEPTAPIKGESSELCDGILSSPSFQIPNATNFDGFQKEAIQMVKPAKGTTTLAFIFKGGVMVAADSRASMGGYISSQSVKKIIEINPYMLGTMAGGAADCQFWHRNLGIKCRLHELANKRRISVAGASKLLANILYSYRGMGLSVGTMIAGWDEKGPGLYYVDSEGGRLKGNRFSVGSGSPYAYGVLDSGYRFDLSVEEAAELARRAIYHATFRDGASGGVASVYHVGPNGWKKLSGDDVGELHYNYYPVELESVEQEMAEVPVA

SEQ ID NO: 10212 - protein, 270 aa, Olea europaea
MKIDFSGLEPLASLCVIKEHDEISKPLSFELPITGDFDGFQREAVQMVKPAKGTTTLAFIFKEGVMVAADSRASMGGYISSQSVKKIIEINPYMLGTMAGGAADCQFWHRNLGVKCRLHELANKRRISVTGASKLLANILYSYRGMGLSVGTMIAGWDEKGPGLYYVDSEGGRLKGTRFSVGSGSPYAYGVLDSGYRYDMSVEEAAELARRAIYHATFRDGASGGVASVYHVGPNGWTKLSGDDVGELHYKYYPVEAEVVEQEMAELPVT

SEQ ID NO: 10213 - protein, 272 aa, Sesamum indicum
MKIDFGGLDPSAPLKGNTDDLHNEILAAPSFKLPITADFDGFQKAAVQMVKPAKGTTTLAFIFKEGVMVAADSRASMGGYISSQSVKKIIEINPYMLGTMAGGAADCQFWHRNLGIKCRLHELANKRRISVAGASKLLANILYSYRGMGLSVGTMIAGWDEQGPGLYYVDSEGGRLKGTRFSVGSGSPYAYGVLDNGYRFDLSVEEAAELARRAIYHATFRDGASGGVASVYHVGPNGWKKLSGDDVGELHYKYYPVEPTAVEQEMTEVSIA

SEQ ID NO: 10214 - protein, 273 aa, Helianthus annuus
MKFDFSGLESSAPLYGGNNELLSDGFSAAPSFDLPVTSDFDDFQKNSIQMVKPAKGTTTLAFIFKDGVMVAADSRASMGGYISSQSVKKIIEINPYMLGTMAGGAADCQFWHRNLGIKCRLHELANKRRISVTGASKLLADILYSYRGMGLSVGTMIAGWDEKGPGLYYVDSEGRRLKGTKFSVGSGSPYAYGVLDSGYKYDLTIDEAAELARRAIYHATFRDGASGGVASVYHVGPNGWTKLSGDDVGELHYSYYPVEPATVEHEMTEAVVA

SEQ ID NO: 10215 - protein, 273 aa, Triphysaria pusilla
MKIDFSGLDPVAPIRGNRDDELTDEISDIPSFKLPSHVDFDGFQKASVQMVKPAKGTTTLAFIFKGGVMVAADSRASMGGYISSQSVKKIIEINPYMLGTMAGGAADCQFWHRNLGIKCRLHELANKRRISVAGASKMLANILYSYRGMGLSVGTMIAGWDEQGPGLYYVDSEGGRLKGTRFSVGSGSPYAYGVLDSGYRFDMSVEEAAELARRSIYHATFRDGASGGVASVYHVGPVGWKKLSGDDVGELHYHYYPVEPATVEQEMADVPVA

SEQ ID NO: 10216 - protein, 273 aa, Valeriana officinalis
MKIDFSGLESGAPSCGASNELFVDGITSAPAFQIPNSIDFDGFQKEAIQMVKPAKGTTTLAFIFKDGVMVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGNKFSVGSGSPYAYGVLDSGYRYDMSVEEAAELAKRSIYHATFRDGASGGVASVYHVGPNGWKKLSGDDVGELHYMYYPVEPTVVEQEMTEVAIA

SEQ ID NO: 10217 - protein, 201 aa, Beta vulgaris
MKLDTSGLESTAPLFRSSNVIFDGLQMTPSFELPNALDFDGFQKDAIQMVKPAKGTTTLAFIFKHGVIVAADSRASMGGYISSQSVKKIIEINPYMLGTMAGGAADCQFWHRNLGIKCRLHELANKRRISVTGASKLLANILYNYRGMGLSVGTMIAGWDETGPGLYYVDSEGGRLKECGSLLVLVHHMLMVFLTMGTNMI

SEQ ID NO: 10218 - protein, 273 aa, Amorphophallus konjac
MKLDTGGLNSLASFYGGDNDLGENSLSAASSFELPRTTDFDGFQKKAVEMVKPAKGTTTLAFIFKEGVIVAADSRASMGGYISSQSVKKIIEINPYMLGTMAGGAADCQFWHRNLGIKCRLHELANKRRISVTGASKLLANILYSYRGMGLSIGTMIAGWDETGPGLYYVDAEGGRLIGKRFSVGSGSPYAYGVLDSGYRYDMSIEEAAELARRAIYHATFRDGASGGVASVYHVGPDGWKKLSGDDVGELHYQYYPVIPSPVEQEMVEIPIS

SEQ ID NO: 10219 - protein, 273 aa, Amsonia hubrichtii
MVKIDFSGLDSTPQFRGNSDELLCGISTAPAFQIPHTNNFDGFQKEAIQMVKPAKGTTTLAFIFKEGVIVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGNRFSVGSGSPYAYGVLDSGYRFDMSVKEAAELARRAIYHATFRDGASGGVVSVYHVGPNGWTKLSGDDVGELHYTYYPVETTPIEQEMAEVSFS

SEQ ID NO: 10220 - protein, 273 aa, Catharanthus roseus
MLKIDFSELNSTPQFCGNSDDLLSGISAAPTFPIPHTNDFDGFQKEAIQMVKPAKGTTTLAFIFKEGVIVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGNRFSVGSGSPYAYGVLDSGYRFDMSVEEAAELARRAIYHATFRDGASGGVVSVYHVGPNGWKKLSGDDVGELHYTYYPVETTPIEQEMAEVSIS

SEQ ID NO: 10221 - protein, 274 aa, Orobanche aegyptiaca
MKIDFSGLDPSAPIKGNTDDFHDEISAIPSFKLPTTVDFDGFQKAAVQMVKPAKGTTTLAFIFEGGVMVAADSRASMGGYISSQSVKKIIEINPYMLGTMAGGAADCQFWHRNLGIKCRLHELANKRRISVAGASKLLANILYSYRGMGLSVGTMIAGWDEQGPGLYYVDSEGGRLKGTRFSVGSGSPYAYGVLDSGYRFDMSVDEAAELARRAIYHATFRDGASGGVASVYHVGPVGWKKLSGDDVGELHYHYYPVEPTTVEQEMTDVPIACP

SEQ ID NO: 10222 - protein, 298 aa, Senecio madagascariensis
RAAARAGLDFSGLESGVPHYGVHNELLSDGFSDAPSFDLPVTSDFDGFQKNSIQMVKPAKGTTTLAFIFKDGVMVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGQKFSVGSGSPYAYGVLDSGYNYDMSIDEAAELARRAIYHATFRDGDLPGVLLAFITWDLLDGQSYRVMMLVNFTTHTILLNQLLLNKKWPKHNCPSGNQLLVICYKNVFSECTL

SEQ ID NO: 10223 - protein, 86 aa, Triphysaria pusilla
MKIDFSGLDPVAPIRGNRDDELTDEISDIPSFKLPSHVDFDGFQKASVQMVKPAKGTTTLAFIFKGGVMVAADSRASMGGYISCNL

SEQ ID NO: 10224 - protein, 223 aa, Picea glauca
MVKPAKGTTTLAFIFKEGIMVAADSRASMGGYISSQSVKKIIEINPYLLGTMAGGAADCQFWHRNLGIKCRLHELANKRRISVTGASKLLANILYSYRGMGLSIGTMIAGWDETGPGLYYVDSEGGRLKGTRFSVGSGSPYAYGVLDSGYRWDMPVEEAAELARRSIYHATFRDGASGGVASVYYVGPQGWKKLSGDDVGELHFKYYPVTENVVEQEMVEVSA

SEQ ID NO: 10225 - protein, 269 aa, Panax ginseng
MKIDFSGLESSVPLCGANTELFDGFSSAPTFQIPDTTDFDGFQKEAIQMVKPAKGTTTLAFIFKEGVMVAADSRASMGGYISSQSVKKIIEINSHMLGTMAGGAADCQFWHRNLGIKCRLHELANKRKISVTGASKLLANILYSYRGMGLSVGTMIAGWDEKGPGLYYVDSEGGRLKGIRFSVGSGSPYAYGVLDSGYRYDMTIEEAAELARRSIYHATFRDGASGGTASVYYVGPNGWKKLSGDDVGELHYKYYPVEPSVVEQDMAEV

SEQ ID NO: 10226 - protein, 269 aa, Panax ginseng
MKIDFSGLESSVPLCGANTELFDGFSSAPTFQIPDTTDFDGFQKEAIQMLKPAKGTTTLAFIFKEGVMVAADSRASMGGYISSQSVKKIIEINPHMLGTMAGGAADCQFWHRNLGIKCRLHELANKRRISVTGASKLLANILYSYRGMGLSVGTMIAGWDEKGPGLYYVDSEGGRLKGTRFSVGSGSPFAYGVLDSGYRYDMTIEEAAELARRSIYHATFRDGASGGTASVYYVGPNGWKKLSGDDVGELHYKYYPVEPSVVEQDMAEV

SEQ ID NO: 10227 - protein, 273 aa, Triphysaria pusilla
MKIDFSGLDPVAPIRGNRDDELTDEISEIPSFKLPSHVDFDGFQKASVQMVKPAKGTTTLAFIFKGGVMVAADSRASMGGYISSQSVKKIIEINPYMLGTMAGGAADCQFWHRNLGIKCRLHELANKRRISVAGASKMLANILYSYRGMGLSVGTMIAGWDEQGPGLYYVDSEGGRLKGTRFSVGSGSPYAYGVLDSGYRFDMSIEEAAELARRSIYHATFRDGASGGVASVYHVGPVGWKKLSGDDVGELHYHYYPVEPATVEQEMADVPVA

SEQ ID NO: 10228 - protein, 273 aa, Musa acuminata
MKLDLSGLQSFTSIPGGAVDGLGEDLFAAPSFQLPACSDFDGFQKDAIQMVKPAKGTTTLAFIFKEGVIVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGTRFSVGSGSPYAYGVLDSGYRFDMPVEEAAELARRAIYHATFRDGASGGVASVYHVGPDGWKKLSGDDVGELHYKYYPVAPTPVEQEMTDAPAA

SEQ ID NO: 10229 - protein, 272 aa, Cucumis sativus
MKLDTSGLQTTAPLFGPTMEAMEGFAAAPSFEIPNSSDFDGFQKDAIQMVKPAKGTTTLAFIFKEGVMVAADSRASMGGYISSQSVKKIIEINPYMLGTMAGGAADCQFWHRNLGVKCRLHKLANKRRISVAGASKLLANILYSYRGMGLSVGTMIAGWDETGPGLYYVDSEGGRLKGTRFSVGSGSPYAYGVLDNGYRYDLSVEEAAELARRAIYHATFRDGASGGVASVYYVGPNGWKKLSGDDVGELHYNYYPVTPTTVDQEMTEVTAA

SEQ ID NO: 10230 - protein, 271 aa, Pinus pinaster
MKLDLSGLEPATLHQQSDDNLYDVLSPSPSFKIPNDTDFDGFQKAALQMVKPAKGTTTLAFIFKEGIMVAADSRASMGGYISSQSVKKIIEINPYLLGTMAGGAADCQFWHRNLGIKCRLHELANKRRISVTGASKLLANILYSYRGMGLSVGTMIAGWDETGPGLYYVDSEGGRLKGTRFSVGSGSPYAYGVLDSGYRWDMPVEEAAELARRSIYHATFRDGASGGVASVYYVGPQGWKKLSGDDVGELHFKYYPVTENIVEQEMVEVSA

SEQ ID NO: 10231 - protein, 270 aa, Primula obconica
MKLDTSGLQAHGPVLGGSDELFSGIPTAPSFEIPNTTNFDGFLKDAIQMVKPAKGTTTLAFIFKDGVMVAADSRASMGGYISSQSVKKIIEINPYMLGTMAGGAADCQFWHRNLGIKCRLHELANKRRISVTGASKLLANILYNYRGMGLSVGTMIAGWDETGPGLYYVDSEGGRLKGMRFSVGSGSPYAYGVLDNGYRYDMSVEEAAELARRAIYHATFRDGASGGVASVYHVGPNGWKKLSGDDVAELHYNYYPVQPALVEHEMAETS

SEQ ID NO: 10232 - protein, 271 aa, Picea glauca
MKLDLSGLEPATLHQLSNDNLCDVFSPTPSFEIPNDADFDGFQKAAVQMVKPAKGTTTLAFIFKEGIMVAADSRASMGGYISSQSVKKIIEINPYLLGTMAGGAADCQFWHRNLGIKCRLHELANKRRISVTGASKLLANILYSYRGMGLSVGTMIAGWDETGPGLYYVDSEGGRLKGTRFSVGSGSPYAYGVLDSGYRWDMPVEEAAELARRSIYHATFRDGASGGVASVYYVGPQGWKKLSGDDVAELHFNYYPVTENIVEQEMVEVSA

SEQ ID NO: 10233 - protein, 272 aa, Vinca minor
MKIDFSGLDSTPRFSGNSDELFNGNSKSPSFPIPDTNDFDGFQKEAIQMVKPAKGTTTLAFIFKEGVIVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGNRFSVGSGSPYAYGVLDSGYHFNMSVEEAAELARRAIYHATFRDGASGGVVSVYHVGANGWKKLSGDDVGELHYTYYPVETTPIEQEMAEVSIS

SEQ ID NO: 10234 - protein, 277 aa, Aquilegia formosa
MNIDFSGIGSQSSSALFNGSNEIGLGKEGFDTPPSFELPCSTDFDGFQKKAIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGTRFSVGSGSPYAYGVLDNGYRYDMSIEEAAELARRSIYHATFRDGASGGVASVYYVGPNGWKKLSGDDVGELHYMYYPVVPSTVEQEMAEVSGA

SEQ ID NO: 10235 - protein, 272 aa, Catharanthus roseus
MKIDFSELESRASFPDQANELFSGLSTAPEFQIPSTDNFDGFQKEAIQMVKPAKGTTTLAFIFKEGVIVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGNRFSVGSGSPYAYGVLDSGYRFDMSVEEAAELARRAIYHATFRDGASGGVVSVYHVGPNGWKKMSGDDVGELHYTYYPVEPTVVEQEMAEVSAS

SEQ ID NO: 10236 - protein, 272 aa, Populus trichocarpa
MKFDTSGLESTASVFGTAGSELVDGFSAAPAFELPTTTDFDGFQKEAVQMVKPAKGTTTLAFIFKDGVIVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGTRFSVGSGSPYAYGILDSGYRFDMSIEEAAELGRRAIYHATFRDGASGGVASVYYVGPDGWKKLSGDDVSELHYNYYPVVSTEASEPDRMVEA

SEQ ID NO: 10237 - protein, 271 aa, Amborella trichopoda
MRLDTSGLNSLAPAHVVNDELCEGFMSLPSFQLPNSADFDTFQKKAVQMVKPAKGTTTLAFIFKEGVMVAADSRASMGGYISSQSVKKIIEINPYLIGTLAGGAADCQFWHRNLGIKCRLHELANKRRISVTGASKLLANILYSYRGMGLSVGTMIAGWDETGPGLYYVDSEGGRLKGTRFSVGSGSPYAYGVLDSGYRYDMSCEEAAELARRSIYHATFRDGASGGVASVYYVGPNGWKKLSGDDVGELHYKYYPVPKGNVEQEMVEASS

SEQ ID NO: 10238 - protein, 273 aa, Ipomoea nil
MVRIDFSGLESTAPIRGESSELFDEIPRVPSFQIPNITDFDGFQKDAIQMVKPAKGTTTLAFIFKEGVMVAADSRASMGGYISSQSVKKIIEINPYMLGTMAGGAADCQFWHRNLGVKCRLHELANKRRISVAGASKLLANILYSYRGMGLSVGTMIAGWDEKGPGLYYVDSEGGRLKGNRFSVGSGSPYAYGVLDNGYRFDLSVEEAAELARRSIYHATFRDGASGGVASVYHVGPNGWKKLSGDDVGELHYHYYPVEAAAVEHEMTEVPIA

SEQ ID NO: 10239 - protein, 271 aa, Pinus pinaster
MKLDLSGLEPATLHQLSNDDLCDVFTPGPSFKIPNDADFDGFQKAAMQMVKPAKGTTTLAFIFKEGIMVAADSRASMGGYISSQSVKKIIEINPYLLGTMAGGAADCQFWHRNLGIKCRLHELANKRRISVTGASKLLANILYSYRGMGLSVGTMIAGWDETGPGLYYVDSEGGRLKGTRFSVGSGSPYAYGVLDSGYRWDMPVEEAAELARRSIYHATFRDGASGGVASVYYVGPQGWKKLSGDDVAELHYNYYPVTENVVEQEMVEVSA

SEQ ID NO: 10240 - protein, 272 aa, Olea europaea
MKIDFSGLAASAPLRGNTDALCNEISSGQKFELPIAADFDGFQREAVRMVKPAKGTTTLAFIFKEGVMVAADSRASMGGYISSQTVKKIIEINPYMLGTMAGGAADCQFWHRNLGIKCRLHELANKRRISVTGASKLLSNILYSYRGMGLSVGTMIAGWDETGPGLYYVDSEGGRLKGTRFSVGSGSPYAYGVLDSGYRFDMSVEEGAELARRAIYHATFRDGASGGVASVYHVGPNGWKKLSGDDVGELHYMYYPVEPASVEQEMTEVSGS

SEQ ID NO: 10241 - protein, 271 aa, Pinus taeda
MKLDLSGLEPATLHQLSNDDLCDGLTPGPSFKIPNDADFDGFQKAAMQMVKPAKGTTTLAFIFKEGIMVAADSRASMGGYISSQSVKKIIEINPYLLGTMAGGAADCQFWHRNLGIKCRLHELANKRRISVTGASKLLANILYSYRGMGLSVGTMIAGWDETGPGLYYVDSEGGRLKGTRFSVGSGSPYAYGVLDSGYRWDMPVEEAAELARRSIYHATFRDGASGGVASVYYVGPQGWKKLSGDDVAELHYNYYPVTENVVEQEMVEVSA

SEQ ID NO: 10242 - protein, 271 aa, Pinus taeda
MKLDLSGLEPATLHQQSDDNLYDVLSPSPSFKIPNDTDFDGFQKAALQMVKPAKGTTTLAFIFKEGIMVAADSRASMGGYISSQSVKKIIEINPYLLGTMAGGAADCQFWHRNLGIKCRLHELANKRRISVTGASKLLANILYSYRGMGLSIGTMIAGWDETGPGLYYVDSEGGRLKGTRFSVGSGSPYAYGVLDSGYRWDMPVEEAAELARRSIYHATFRDGASGGVASVYYVGPQGWKKLSGDDVGELHFKYYPVTENIVEQEMVEVSA

SEQ ID NO: 10243 - protein, 270 aa, Primula obconica
MMLDTSGLQAHGPVLGGSDELFSGIPTAPSFEIPNTTNFDGFLKDAIQMVKPAKGTTTLAFIFKDGVMVAADSRASMGGYISSQSVKKIIEINPYMLGTMAGGAADCQFWHRNLGIKCRLHELANKRRISVTGASKLLANILYNYRGMGLSVGTMIAGWDETGPGLYYVDSEGGRLKGMRFSVGSGSPYAYGVLDNGYRYDMSVEEAAELARRAIYHATFRDGASGGVASVYHVGPNGWKKLSGDDVAELHYNYYPVQPALVEHEMAETS

SEQ ID NO: 10244 - protein, 271 aa, Picea glauca
MKLDLSGLEPATLHQLSNDNLCDVFSPTPSFEIPNDADFDGFQKAAVQMVKPAKGTTTLAFIFKEGIMVAADSRASMGGYISSQSVKKIIEINPYLLGTMAGGAADCQFWHRNLGIKCRLHELANKRRISVTGASKLLANILYSYRGMGLSVGTMIAGWDETGPGLYYVDSEGGRLKGTRFSVGSGSPYAYGVLDSGYRWDMPVEEAAELARRSIYHATFRDGASGGVASVYYVGPQGWKKLSGDDVAELHFNYYPVTENVVEQEMVEVSA

SEQ ID NO: 10245 - protein, 271 aa, Picea glauca
MKLDLSGLEPATLHQRSDDNLCDVFSPSPSFKIPNDTDFDGFQKAALQMVKPAKGTTTLAFIFKEGIMVAADSRASMGGYISSQSVKKIIEINPHLLGTMAGGAADCQFWHRNLGIKCRLHELANKRRISVTGASKLLANILYSYRGMGLSIGTMIAGWDETGPGLYYVDSEGGRLKGTRFSVGSGSPYAYGVLDSGYRWDMPVEEAAELARRSIYHATFRDGASGGVASVYYVGPQGWKKLSGDDVGELHFKYYPVTENIVEQEMVEVSA

SEQ ID NO: 10246 - protein, 272 aa, Citrullus lanatus
MKLDTSGLQSTAPLFGLKMEVLEGFAAAPSFEIPNSSDFDGFQKDAIQMVKPAKGTTTLAFIFKEGVMVAADSRASMGGYISSQSVKKIIEINPYMLGTMAGGAADCQFWHRNLGVKCRRHELANKRRISVAGASKLLANILYSYRGMGLSVGTMIAGWDETGPGLYYVDSEGGRLKGTRFSVGSGSPYAYGVLDNGYRYDLSVEEAAELARRAIYHATFRDGASGGVASVYYVGPNGWKKLSGDDVGELHYNYYPVTPSTVDQEMAEVTVA

SEQ ID NO: 10247 - protein, 66 aa, Vaccinium corymbosum
MKFDTIGLESHVLRSGVSDDLLSEFPTAPSFEIPSATDFDGFQKEAIQMDHQQKAQRHWPLSSRKV

SEQ ID NO: 10248 - protein, 274 aa, Populus trichocarpa
MKFDTSGLESTASVFGTAGRELVDGFSAAAAPAFDLPTTKDFDGFQKEAVQMVKPAKGTTTLAFIFKEGVIVAADSRASMGGYISSQSVKKIIEINPYMLGTMAGGAADCQFWHRNLGIKCRLHELANKRRISVTGASKLLANILFSYRGMGLSVGTMIAGWDETGPGLYYVDSEGGRLKGTRFSVGSGSPYAYGILDSGYRFDMSIEEAAELGRRAIYHATFRDGASGGVASVYYVGANGWTKLSGDDVSELHYKYYPVVSAEASEPDQMVEA

SEQ ID NO: 10249 - protein, 277 aa, Fragaria vesca
MRQLDFSSLQTTAPLLGDSSGFSGGFPGDFSAAPSFEVPVTDDFDGFQKEARDMVKSKKGTTTLAFIFKDGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGMRFSVGSGSPYAYGVLDNGYRYDMSVEEASELARRAIYHATFRDGASGGVASVYHVGPNGWKKLSGDDVGELHYEYYPVTPETVEQEMVEVGAA

SEQ ID NO: 10250 - protein, 88 aa, Tripterygium wilfordii
MKLDTSGLESPMPHFGAGNETLEGISNAQSAQSFEVPDVTNFDAFQKETTQLLKHAKGTTTLAFILRRSLWLPLILELAWAAISHPSQ

SEQ ID NO: 10251 - protein, 263 aa, Centaurea maculosa
MKLDFKGLESSAPLYGESNGMLFDGFSAAASFEVPVTSDFDEYQKKSVQMVKPAKGTTTLAFIFKDGVMVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGTKFSVGSGSPYAYGVLDSGYHYDMTIDEAAELARRSIYHATFRDGASGGVASVYHVGPNGWTKLSGDDVGELHYSYYPVEPTVV

SEQ ID NO: 10252 - protein, 272 aa, Mimulus guttatus
MKIDLSGLDPSAPMKRNTDDLDNEILATPSFALPTTVDFDGFQKASIQMVKPARGTTTLAFIFKGGVMVAADSRASMGGYISSQSVKKIIEINPYMLGTMAGGAADCQFWHRNLGIKCRLHELANKRRISIAGASKMLANILYSYRGMGLSVGTMIAGWDEQGPGLYYVDSEGGRLKGTRFSVGSGSPYAYGVLDSGYRFDLSVEEAAELARRAIYHATFRDGASGGVASVYHVGPNGWEKLSGDDVGELHYKYYPVETAVVEQEMTEVAIA

SEQ ID NO: 10253 - protein, 257 aa, Carthamus tinctorius
MKLDFGGLESSAPLYGGNDDVLSDGFSAAPSFDLPVTSDFDGFQKNSIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGTKFSVGSGSPYAYGVLDSGYHYDMTIDEAAELARRSIYHATFRDGASGGVASVYHVGPTGWTKLSGDDVGELHYSYYP

SEQ ID NO: 10254 - protein, 271 aa, Abies balsamea
MKLDLSGLEPATLHQWSNDNLCDVFSPNPSFNIPNDADFDGFQKAAMQMVKPAKGTTTLAFIFKEGIMVAADSRASMGGYISSQSVKKIIEINPYLLGTMAGGAADCQFWHRNLGIKCRLHELANKKRISVTGASKLLANILYSYRGMGLSIGTMIAGWDETGPGLYYVDSEGGRLKGTRFSVGSGSPYAYGVLDSGYRWDMPVEEAAELARRSIYHATFRDGASGGVASVYYVGPQGWKKLSGDDVGELHYKYYPVTENVVEQEMVEVSA

SEQ ID NO: 10255 - protein, 271 aa, Cedrus atlantica
MKLDFSGLEPATLHQLSNDNLCDVLSPSPSFKIPNDTNFDGFQKAAMQMVKPAKGTTTLAFIFKEGIMVAADSRASMGGYISSQSVKKIIEINPYLLGTMAGGAADCQFWHRNLGIKCRLHELANKRRISVTGASKLLANILYSYRGMGLSVGTMIAGWDETGPGLYYVDSEGGRLKGTRFSVGSGSPYAYGVLDSGYRWDMPVEEAAELARRSIYHATFRDGASGGVASVYYVGPQGWKKLSGDDVGELHFNYYPVTENVVEQEMVEVSA

SEQ ID NO: 10256 - protein, 272 aa, Cucumis sativus
MKLDTSGLESATFLSGAGSTELLDGLSSAPSFGIPNARNFDGFQKEAIQMVKPAKGTTTLAFTFKEGVMVAADSRASMGGYISSQSAKKIIEINSYMLGTMAGGAADCQFWHRNLGIKCRRHELENKRRISVTGASKLLANILYSYRGMGLSVGTMIAGWDETGPGLYYVDSEGGRLKGTRFSVGSGSPYAYCVLDNGYQYDLSVEEAAELARRAIYHATFRDGASGGVASVYHVGPNGWKKLSGDDVGELHYKYYPVVHDTVEQEMIEVTV

SEQ ID NO: 10257 - protein, 271 aa, Pseudotsuga menziesii
MKLDLSGLESATLHQLSNDNLSDVFSPSPSFKIPNDADFDGFQKAAMQMVKPAKGTTTLAFIFKEGIMVAADSRASMGGYISSQSVKKIIEINPYLLGTMAGGAADCQFWHRNLGIKCRLHELANKRRISVTGASKLLANILYSYRGMGLSVGTMIAGWDETGPGLYYVDSEGGRLKGTRFSVGSGSPYAYGVLDSGYRWDMPVEEAAELARRSIYHATFRDGASGGVASVYYVGPQGWKKMSGDDVSELHYNYYPVTENVVEQEMVEVSA

SEQ ID NO: 10258 - protein, 271 aa, Picea glauca
MKLDLSGLEPATLHQRSDDNLCDVFSPSPSFKIPNDTDFDGFQKAALQMVKPAKGTTTLAFIFKEGIMVAADSRASMGGYISSQSVKKIIEINPHLLGTMAGGAADCQFWHRNLGIKCRLHELANKRRISVTGASKLLANILYSYRGMGLSIGTMIAGWDETGPGLYYVDSEGGRLKGTRFSVGSGSPYAYGVLDSGYRWDMPVEEAAELARRSIYHATFRDGASGGVASVYYVGPQGWKKLSGDDVGELHFKYYPVTENVVEQEMVEVSA

SEQ ID NO: 10259 - protein, 209 aa, Cedrus atlantica
MKLDLSGLEPATLHQRSNDNLCDVFSPSPSFKIPNDADFDGFQKAAMQMVKPAKGTTTLAFIFKEGIMVAADSRASMGGYISSQSVKKIIEINPYLLGTMAGGAADCQFWHRNLGIKCRLHELANKRRISVTGASKLLANILYSYRGMGLSVGTMIAGWDETGPGLYYVDSEGGRLKGTRFLLDLVHHMPMVSWTVGIAGICQWKKLQN

SEQ ID NO: 10260 - protein, 274 aa, Populus trichocarpa
MKFDTSGLESTSSVFGTAGRELVDGFSAAAAPAFELPTTKDFDGFQKEAVQMVKPAKGTTTLAFIFKEGVIVAADSRASMGGYISSQSVKKIIEINPYMLGTMAGGAADCQFWHRNLGIKCRLHELANKRRISVTGASKLLANILFSYRGMGLSVGTMIAGWDETGPGLYYVDSEGGRLKGTRFSVGSGSPYAYGILDSGYRFDMSIEEAAELGRRAIYHATFRDGASGGVASVYYVGANGWTKLSGDDVSELHYKYYPVVSAEASEPDQMVEA

SEQ ID NO: 10261 - protein, 272 aa, Phalaenopsis aphrodite
MKLDTSGFEALAQPSRELDVLACEFRSSPAFDLPSCTDFDGFQKNALQMVKPAKGTTTLAFIFKEGVIVAADSRASMGGYISSQTVKKIIEINPYMIGTMAGGAADCQFWHRNLGIKCRLHELANKRRISVTGASKLLANILYSYRGMGLSVGTMIAGWDETGPGLYYVDSEGGRLKGKRFSVGSGSPYAYGVLDSGYRFDLSIEEAAELARRAIYHATFRDGASGGIASVYYVGPDGWKKLSGDDVGELHYKYYPIATPSVEQEMAEAPVA

SEQ ID NO: 10262 - protein, 279 aa, Cucurbita pepo
MKLDTSGLQTSAPLFGPKMEILEGFSAAPSFEVPNSSDFDGFQKEAIQMVKPAKGTTTLAFIFKEGVMVAADSRASMGGYISSQSVKKIIEINPYMLGTMAGGAADCQFWHRNLGVKCRRHELANKRRISVAGASKLLANILYSYRGMGLSVGTMIAGWDETGPGLYYVDSEGGRLKGTRFSVGSGSPYAYGVLDNGYRYDLSVEEAAELARRAIYHATFRDGASGGVASVYYVGPNGWKKLSGDDVGELHYNYYPVTPTTVDQEMAETLIDNQSDTDI

SEQ ID NO: 10263 - protein, 161 aa, Picea glauca
MVKPAKGTTTLAFIFKEGIMVAADSRASMGGYISSQSVKKIIEINPHLLGTMAGGAADCQFWHRNLGIKCRLHELANKRRISVTGASKLLANILYSYRGMGLSIGTMIAGWDETGPGLYYVDSEGGRLKGTRFLLDLVHHMHTVSWTVGTAGICQWKKLQN

SEQ ID NO: 10264 - protein, 204 aa, Abies balsamea
MVAADSRASMGGYISSQSVKKIIEINPYLLGTMAGGAADCQFWHRNLGIKCRLHELANKRRISVTGASKLLANILYSYRGMGLSVGTMIAGWDETGPGLYYVDSEGGRLKGTRFSVGSGSPYAYGVLDSGYRWDMPVEEAAELARRSIYHATFRDGASGGVASVYYVGPQGWKKLSGDDVGELHFKYYPVTENVVEQEMVEVHA

SEQ ID NO: 10265 - protein, 205 aa, Cucurbita pepo
MVAADSRASMGGYISSQSVKKIIEINPYMLGTMAGGAADCQFWHRNLGVKCRRHELANKRRISVAGASKLLANILYSYRGMGLSVGTMIAGWDETGPGLYYVDSEGGRLKGTRFSVGSGSPYAYGVLDNGYRYDLSVEEAAELARRAIYHATFRDGASGGVASVYYVGPNGWKKLSGDDVGELHYNYYPVTPTTVDQEMAEVTAA

SEQ ID NO: 10266 - protein, 398 aa, Prunus mume
MKLDTSGLESAAPLVGASSGFLDGFADAPSFEVPTTNDFDGFQKEAIQMVKPAKGTTTLAFIFKEGVMVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGMRFSVGSGSPYAYGVLDNGYRYDMSVEEAAELARRAIYHATFLYHVGPNGWKKLSGDDVGELHYHYYPVVQGAVEQEMVEPCLQPKAQSIGSQGNVLLLFVAGICTLVVCLTTSISRSNKNLNSVSAVLISNQFSYIETNHTLSYNLTLDISLTNPCQKYFKLIDNQVFAYSQNQKFGLVTLIDRRTAFHQHPKNTTFFQNAVVEGWKTMGFEEPVLPKD

SEQ ID NO: 10267 - protein, 121 aa, Picea glauca
MKLDLSGLEPATLHQLSNDNLCDVFSPTPSFEIPNDADFDGFQKAAVQMVKPAKRATTLAFIFKEGIMVAADSRASMGGYISSQSVKKIIEINPYLLGTMAGGAADCQFWHRNPGHQVSVT

SEQ ID NO: 10268 - protein, 85 aa, Picea glauca
MKLDLSGLEPATLHQRSDDNLCDVFSPSPSFKIPNDTDFDGFQKAALQWSNQQREQQLWHLYSRRESWLLLILVPAWEDTFHHNP

SEQ ID NO: 10269 - protein, 272 aa, Eschscholzia californica
MKLDSGLENSSSILLGGSNEFGADFSAPPSFDLPTTNDFDGFQKASLKMMKHAKGTTTLAFIFKDGVMVAADSRASMGGYISSQSVQKIIEINPYMLGTMAGGAADCQFWHRNLGVKCRLHELANKRRISVTGASKLLANILYSYRGMGLSVGTMIAGWDEKGPGLYCVDSEGGRLKGMKFSVGSGSPYAYGVLDNGYRYDMSVEEAAELARRAIYHATYRDAASGGVASVYHVGPNGWTKLSGDDVGELHYKYYPVVPSTVEQEMTEVPVA

SEQ ID NO: 10270 - protein, 272 aa, Capsicum annuum
MKINFSGLEPTAPLQGEPSELFDGISNSPSFAIPNTTNFDGFQKEAIQMVKPAKGTTTLAFIFKGGVMVAADSRASMGGYISSQSVKKIIEINPYMLGTMAGGAADCQFWHRNLGIKCRLHELANKRRISVTGASKLLANILYSYRGMGLSVGTMIAGWDEKGPGLYYVDSEGGRLKGNRFSVGSGSPYAYGVLDNGYRYDLSVEEAAELARRAIYHATFRDGASGGVASVYHVGPDGWKKLSGDDVGELHYHYYPAEVAAVDHEMTEVPVA

SEQ ID NO: 10271 - protein, 275 aa, Antirrhinum majus
MKIDFGGLDPRAPIKERSDEMCDEILATPSFKLPAATDMSDFDGFQKAAVQMVKPARGTTTLAFIFKDGVMVAADSRASMGGYISSQSVKKIIEINPYMLGTMAGGAADCQFWHRNLGIKCRLHELANKRRISVAGASKMLANILYSYRGMGLSVGTMIAGWDEKGPGLYYVDSEGGRLKGTRFSVGSGSPYAYGVLDSGYRFDLSVDEAAELARRAIYHATFRDGASGGVASVYHVGPNGWKKLSGDDVGELHYHYYPVEPTTVEQEMTEVSIA

SEQ ID NO: 10272 - protein, 292 aa, Brassica juncea
GFETSMPTIGFGSSNDMLDGFSTVPSFDLPRTTDFDGFQKEAVQMVKPAKGTTTLAFIFKEGVMVAADSRASMGGYISSQSVKKIIEINPYMLGTMAGGAADCQFWHRNLGIKCRLHELANKRRISVSGASKLLANMLYSYRGMGLSVGTMIAGWDETGPGLYYVDNEGGRLKGDRFSVGSGSPYAYGVLDSGYKFDMSVEEASELARRSIYHATFRDGASGGVASVYHVGPNGWKKLSGMMLVSYTITTTPCHRPLRNKSWRRQPPSKTKILFYFQIFSLSCGIHSIKILL

SEQ ID NO: 10273 - protein, 272 aa, Plantago ovata
MKIDFSGLQPLAPNKEQADEFSDEITAAPAFKLPVAVDFDGFQKAAVQMVKPAKGTTTLAFIFKDGVMVAADSRASMGGYISSQSVKKIIEINPYMLGTMAGGAADCQFWHRNLGIKCRLHELANKRRISVAGASKMLANILYSYRGMGLSVGTMIAGWDEQGPGLYYVDSEGGRLKGKKFSVGSGSPYAYGVLDSGYRFDMPVEEAAELARRAIYHATFRDGASGGVASVYHVGPNGWKKLSGDDVGELHYKYYPVEPTTVEQEMAEVPVA

SEQ ID NO: 10274 - protein, 271 aa, Podocarpus macrophillus
MKLDLSGLEPATLHQLSNNSISDTFSQTPSFKLPNDTDFDGFQKAAIQMVKPAKGTTTLAFIFKEGIIVAADSRASMGGYISSQSVKKIIEINPHLLGTMAGGAADCQFWHRNLGIKCRLHELANKRRISVTGASKLLANILYSYRGMGLSIGTMIAGWDETGPGLYYVDSEGGRLKGTRFSVGSGSTYAYGILDSGYHWDMPVEEAAELARRAIYHATFRDGASGGVASVYYVGPEGWKKMSGDDVSELHYKYYPVTESIIEHEMAEASA

SEQ ID NO: 10275 - protein, 272 aa, Papaver somniferum
MKLDSGLENSSSIFLGGCSGLEADFSAPPSFDLPITNDFDGWQKKSVQMVKPARGTTTLAFIFKEGVMVAADSRASMGGYISSQSVKKIIEINPYMLGTMAGGAADCQFWHRNLGVKCRLHELANKRRISVTGASKLLANILYSYRGMGLSVGTMIAGWDEKGPGLYYVDSEGGRLKGTRFSVGSGSPYAYGVLDNGYKYDMSIPEAAELARRAIYHATFRDAASGGVASVYYVGPDGWKKMSGNDVGELHYSYYPVVPSVVEQEMTEVPVA

SEQ ID NO: 10276 - protein, 224 aa, Raphanus sativus
MVKPAKGTTTLAFIFKEGVMVAADSRASMGGYISSQSVKKIIEINPYMLGTMAGGAADCQFWHRNLGIKCRLHELANKRRISVSGASKLLANMLYSYRGMGLSVGTMIAGWDETGPGLYYVDNEGGRLKGDRFSVGSGSPYAYGVLDSGYKFDMSVEEASELARRSIYHATFRDGASGGVASVYHVGPNGWKKLSGDDVGELHYHYYPVPPETAEQVMEEAAAE

SEQ ID NO: 10277 - protein, 154 aa, Nicotiana benthamiana
MKIDFSGLEPTATLRGESLELFDDIPSSPSFQIPNTTNFDGFQKEAIQMVKPAKGTTTLAFIFKEGVMVAADSRASMGGYISSQSVKKIIEINPHMLGTMAGGAADCQFWHRNLGIKCRLHELANKRRISVTGASKLLANILYSYRGMGCLSEL

SEQ ID NO: 10278 - protein, 272 aa, Arachis hypogaea
MKLDTSGLESFSTLTAPGDDIVGEFSAPPSFQLPNSNDFDGFVKEAIQTVKPAKGTTTLAFIFKDGVIVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGTRFSVGSGSPYAYGILDSGYRYDLSVDEAVELGRRAIYHATFRDGASGGVVSVYHVGPEGWKKWTGDDVGDLHYQYYPVVPSTVEQEMAEATGA

SEQ ID NO: 10279 - protein, 272 aa, Arachis hypogaea
MKLDTSGLESFSTLTAPGDGVVVEFSAPPSFQLPNSNDFDGFVKEAIQMVKPAKGTTTLAFIFKDGVIVAADSRASMGGYISSQSVKKIIEINPYMLGTMAGGAADCQFWHRNLGIKCRLHELANKRRISVTGASKLLANILYSYRGMGLSVGTMIAGWDETGPSLYYVDSEGGRLKGTRFSVGSGSPYAYGVLDNGYRYDLSVEEAVELGRRAIYHATFRDGASGGVVSVYHVGPEGWKKWTGDDVGDLHYQYYPVVPSTVEQEMAEATGA

SEQ ID NO: 10280 - protein, 271 aa, Cryptomeria japonica
MKLDFSGLEPATLHQLPNDNMSDILSQAPSFKLPNDTDFDGFQKAAVQMVKPAKGTTTLAFIFKEGIIVAADSRASMGGYISSQSVKKIIEINPYLLGTMAGGAADCQFWHRNLGIKCRLHELANKRRISVTGASKLLANILYSYRGMGLSIGTMIAGWDETGPGLYYVDSEGGRLKGTLFSVGSGSTYAYGILDSGYRWDMPVEEAGELGRRAIYHATFRDGASGGVASVYYVGPQGWKKLSGDDVGELHYNYYPVTENVVEQEMAEGSA

SEQ ID NO: 10281 - protein, 271 aa, Distylium racemosum
MKLDFSGLEPATLHRLSNDNISDTFSQTPSFNLPNDADFDGFQKAAVQMVKPAKGTTTLAFIFKEGIIVAADSRASMGGYISSQSVKKIIEINPYLLGTMAGGAADCQFWHRNLGIKCRLHELANKRRISVTGASKLLANILYSYRGMGLSIGTMIAGWDETGPGLYYVDSEGGRLKGTRFSVGSGSTYAYGVLDSGYRWDMPVEEAGELARRSIYHATFRDAASGGVASVYYVGPDGWKKLSGDDVGELHFKYYPVTENVVEQEMADVSV

SEQ ID NO: 10282 - protein, 272 aa, Elaeis guineensis
MKLDTSGFESFAPLSGSIDDVCSDLSAHQFFDLPNCSDFDGFQKNAIQMVKPAKGTTTLAFVFKEGVIVAADSRASMGGYISSQTVKKIIEINPYMIGTMAGGAADCQFWHRNLGIKCRLHELANKRRISVAGASKLLANILYSYRGMGLSVGTMIAGWDETGPGLYYVDSEGGRLKGTRFSVGSGSPYAYGVLDNGYRYDMSIEEAAELARRAIYHATFRDGASGGVVSVYYVGCDGWKKLSGDDVGELHYTYYPVAPSPVEHEMAEVPPA

SEQ ID NO: 10283 - protein, 272 aa, Arachis hypogaea
MKLDTSGLESFSTLTAPGDDIVVEFSAPPSFQLPNSNDFDGFVKEAIQTVKPAKGTTTLAFIFKDGVIVAADSRASMGGYISSQSVKKIIEINPYMLGTMAGGAADCQFWHRNLGIKCRLHELANKRRISVTGASKLLANILYSYRGMGLSVGTMIAGWDETGPGLYYVDSEGGRLKGTRFSVGSGSPYAYGILDSGYRYDLSVDEAVELGRRAIYHATFRDGASGGVVSVYHVGPEGWKKWTGDDVGDLHYQYYPVVPSTVEQEMAEATGA

SEQ ID NO: 10284 - protein, 272 aa, Allium cepa
MILDTSGLESKASHPVVSDELCSDLAAPSSFDLPNCTDFDGFQKKSIQMVKPAKGTTTLAFIFKEGVIVAADSRASMGGYISSQSVKKIIEINPYMIGTMAGGAADCQFWHRHLGIKCRLHELANKRRISVTGASKLLANILFSYRGMGLSVGTMIAGWDETGPGLYYVDSEGGRLKGNKFSVGSGSPYAYGVLDKGYRYDMSIEEAAELARRSIYHATFRDGASGGVASVYYVGPTGWKKLSGDDVGELHYKYYPVVPATVEHEMADAPAA

SEQ ID NO: 10285 - protein, 250 aa, Gossypium hirsutum
MLLKASPAFSLLKNPQVETRVPLFSRNGSGVGSGAVVVCATKGANNKPLTGVIFEPFEEVKKELNLVPTVPQMSLARQKFADECEAAINEQINVEYNVSYVYHAMFAYFDRDNVALKGLAKFFKESSLEEREHAEKLMEYQNKRGGQVKLQSIIMPLSEFDHAEKGDALYAMELALSLEKLTNEKLLNLHNVAERNHDSQLTDFIEGEFLAEQVESIKKISEYVAQLRRVGKGHGVWHFDQMLLHEGAVA

SEQ ID NO: 10286 - protein, 250 aa, Gossypium hirsutum
MLLKASPAFSLLKNPQVETRVPLFSRNGSGFGSGAVVVCATKGANNKPLTGVIFEPFEEVKKELNLVPTVPQMSLARQKFADECEAAINEQINVEYNVSYVYHAMYAYFDRDNVALKGLAKFFKESSLEEREHAEKLMEYQNKRGGQVKLQSILMPLSEFDHAEKGDALYAMELALSLEKLTNEKLLNLHNVAERNHDSQLTDFIEGEFLAEQVESIKKISEYVAQLRRVGKGHGVWHFDQMLLHEGAVA

SEQ ID NO: 10287 - protein, 250 aa, Gossypium raimondii
MLLKASPAFSLLKNPQVETRVPLFSRNGSGVGSGAVVVCATKGANNKPLTGVIFEPFEEVKKELNLVPTVPQMSLARQKFADECEAAINEQINVEYNVSYVYHAMYAYFDRDNVALKGLAKFFKESSLEEREHAEKLMEYQNKRGGQVKLQSILMPLSEFDHAEKGDALYAMELALSLEKLTNEKLLNLHNVAERNHDSQLTDFIEGEFLAEQVESIKKISEYVAQLRRVGKGHGVWHFDQMLLHEGAVA

SEQ ID NO: 10288 - protein, 250 aa, Gossypium raimondii
MLLKASPAFSLLKNPQVETRVPLFSRNGSGFGSGAVVVCATKGANNKPLTGVIFEPFEEVKKELNLVPTVPQMSLARQKFADECEAAINEQINVEYNVSYVYHAMYAYFDRDNVALKGLAKFFKESSLEEREHAEKLMEYQNKRGGQVKLQSILMPCSEFDHAEKGDALYAMELALSLEKLTNEKLLNLHNVAERNHDSQLTDFIEGEFLAEQVESIKKISEYVAQLRRVGKGHGVWHFDQMLLHEGAVA

SEQ ID NO: 10289 - protein, 270 aa, Theobroma cacao
MLLKAAPAFSLLNPQVENQGSLFSSVSSSQSSLFSSFSSPTLRVSTPRNRTGAVIVCAAKGANNKPLTGVVFEPFEEVKKELDLVPKVPQVSLARQKYTDECEAAVNEQINVEYNVSYVYHAIFAYFDRDNIALKGLAKFFKESSLEERGHAEKLMKYQNKRGGKVKLQSIVMPLSEFDHAEKGDALYAMELTLSLEKLTNAKLLNLHSVAERNHDVQLTEFIEAEYLSEQVEAIKKIAEYVAQLRRVGKGHGVWHFDQMLLHEGEEAIA

SEQ ID NO: 10290 - protein, 486 aa, Arabidopsis lyrata
MASMSLSFSSSLCSSRIPEGKRRFRHRDASFVRCVLAASKSSPGSVTKKRLWKDGEFPGITEPVNPRRTPIKNVKKKLDRRSKANGWANTVTETLSDLIAKKQWLQALEVFDMLREQTFYQPKEGTYMKLLVLLGKSGQPNRAQKLFDEMLEEGLEPTVELYTALLAAYTRSNLIDDAFSILDTMKGLPQCQPDVFTYSTLLKACVDASQFDLVDSLYKEMDERLITPNTVTQNIVLSGYGRVGRFDQMEKVLSDMLVSTACKPDVWTMNIILSVFGNMGKIDMMESWYEKFRNFGIEPETRTFNILIGSYGKKRMYDKMSSVMEYMRKLEFPWTTSTYNNIIEAFADVGDAKNMELTFDQMRSEGMKADTKTFCCLINGYANAGLFHKVISSVQLAAKFEIPENTAFYNAVIAACAKADDLIEMERVYTRMKERQCVCDSRTFEIMVEAYEKEGMNDKIYYLEQERQKLMDRAVATKEMENLPAG

SEQ ID NO: 10291 - protein, 480 aa, Eutrema halophilum
MASMSLSFSSSLCSSRIPQGERRFLQRDVSFVRCVLAASKPSPGGATKKRLWKEGEFPGITEPVNPRRTPIKNVKKKLDRRSKANGWVCTVTETLSDLIAKKQWLQALEVFGMLREQPFYQPKEGTYMKLLVLLGKSGQPNRAQKLFDEMLEEGLEPTAELYTALLAAYTRNNLIDEAFSILDRMKSLPRCQPDVFTYSTLLKACVDASLFDLVDSLYKEMDERLITPNTVTQNIVLSGFGRVGRFDQMEKVLSDMLVSTSCKPDVWTMNIILSVFGNMGKIDMMESWYEKFRNFGIEPETRSFNILIGAYGKKRMYDKMSSVMEYMRKLEFPWTTSTYNNIIEAFADVGDAKNMEYTFDQMRSEGMKADTKTFCCLINGYANAGLFHKVISSVQLAAKFEIPENTSFYNAVISACAKADDLIEMERVYKRMKERECVCDSRTFEIMIEAYGKEGMNDKIYYLEQERQFAATKEEENLPG

SEQ ID NO: 10292 - protein, 485 aa, Eutrema parvulum
MASMSLSFSSSLCSSRIPEGKRRFHQRDASFVRCVLAASKSSPGGVTKKRLWKEGEFPGITEPVNPRRNPMKNVKKKLDRRSKANGWVNTVTETLSDLIAKKQWLQALEVFEMLKEQPFYQPKEGTYMKLLVLLGKSGQPNRTQKLFDEMLEEGLEPTAELYTALLGAYCRNNLIDEAFSILERMKSLPQCQPDVFTYSTLLKACVDASLFDLVESLYKEMDERLISPNTVTQNIVLSGYGRVGRFDQMEKVLSGMLVSTSCKPDVWTMNIILSVFGNMGKIDMMESWYEKFRNFGIEPETRSFNILIGAYGKKRMYDKMSSVMEYMRKLEFPWTTSTYNNIIEAFADVGDAKNMEYTFDQMRSEGMKADTKTFCCLINGYANAGLFHKVISSVQLAAKFEIPENTSFYNAVISACAKADDLIEMERVYTRMKERECVCDSRTFETMIEAYEKEGMNDKIYYLEQERQKAMDRAAATKEEENIPG

SEQ ID NO: 10293 - protein, 368 aa, Eutrema halophilum
MLREQPFYQPKEGTYMKLLVLLGKSGQPNRAQKLFDEMLEEGLEPTAELYTALLAAYTRNNLIDEAFSILDRMKSLPRCQPDVFTYSTLLKACVDASLFDLVDSLYKEMDERLITPNTVTQNIVLSGFGRVGRFDQMEKVLSDMLVSTSCKPDVWTMNIILSVFGNMGKIDMMESWYEKFRNFGIEPETRSFNILIGAYGKKRMYDKMSSVMEYMRKLEFPWTTSTYNNIIEAFADVGDAKNMEYTFDQMRSEGMKADTKTFCCLINGYANAGLFHKVISSVQLAAKFEIPENTSFYNAVISACAKADDLIEMERVYKRMKERECVCDSRTFEIMIEAYGKEGMNDKIYYLEQERQFAATKEEENLPG

SEQ ID NO: 10294 - protein, 490 aa, Brassica napus
MASMSLSFSSSLCSSRIPESKRRFHQREPIFARCVLAASKSSPGGGATAATKKRLWKEGEFPGITEPANTRRAPMKNVKKKLDRRSKANGWACTVTETLSDLIAKKQWLQALEVFEMLREQPFYQPKEGTYMKLLVLLGKSGQPHRAQKVFDEMLEEGLEPTAELYTALLGAYCRSNLIDSAFSVLERMKSLPQCQPDVYTYSTLLKACVDASLFDLVESLYREMDERLITPNTVTQNIVLSGYGRVGRFDQMEKVLSDMLVSTECKPDVWTMNIILSVFGNMGKIDMMESWYEKFRNFGIEPETRSFNILIGAYGKKRMYDKMSSVMEYMRKLEFPWTTSTYNNIIEAFADVGDAKNMEYTFDQMRSEGMKADTKTFCCLINGYANAGLFHKVISSVQLAAKFEIPENTSFYNAVISACAKADDLIEMERVYTRMKERECVRDSRTFEIMAEAYEKEGMNDKIYYLEQERQQVMDHHAAATKEEENLPG

SEQ ID NO: 10295 - protein, 491 aa, Brassica rapa
MASMSLSFSSSLCSSRLPESKRRFHQREPTFARCVLAASKSSPGGGGATATTKKRLWKEGEFPGITEHANTRRAPMKNVKKKLDRRSKANGWACTVTETLSDLIAKKQWLQALEVFEMLREQPFYQPKEGTYMKLLVLLGKSGQPHRAQKVFDEMLEEGLEPTAELYTALLGAYCRSNLIDSAFSVLERMKTLPQCQPDVYTYSTLLKACVDASLFDLVESLYREMDERLITPNTVTQNIVLSGYGRVGRFDQMEKVLSDMLVSTECKPDVWTMNIILSVFGNMGKIDMMESWYEKFRNFGIEPETRSFNILIGAYGKKRMYDKMSSVMEYMRKLEFPWTTSTYNNIIEAFADVGDAKNMEYTFDQMRSEGMKADTKTFCCLINGYANAGLFHKVISSVQLAAKFEIPENTSFYNAVISACAKADDLIEMERVYTRMKERECVRDSRTFEIMVEAYEKEGMNDKIYYLEQERQKVMDHHAAATKEEENLPG

SEQ ID NO: 10296 - protein, 488 aa, Glycine max
MASMSLSFCSCIVPSRIPHDKSNKTHSHHQPTFPLIRFGISAPAVKKRHWKKGEFPATSQPSFPNDTRRKTPLKNLKKKFDKKNDAKAWVNTVTESLSERIHNKHWLQALQVFDMLREQTFYQPKEGTYMKLIVLLGKSGQPHRAHQLFTTMIEEGLEPTPELYTALLAAYCRSNMIDEAFSVLNEMKKLPRCQPDVFTYSTLIKVCVDAFKFDLVELLYEEMAERSIMPNTVTQNIVLGGYGKAGMFDQMEKVLSSMLLSTTCKPDVWTMNTIISVFGNMGQIDMMEKWYEKFRYFGIEPETRTFNILIGAYGKKRMYDKMSSVMEYMRKLQFPWTTSTYNNVIEAFADAGDAKHMECTFDQMRAEGMKADTKTLCCLINGYANAGLFHKVISSVRLAGKLEIPENITFYNAVLSACAKAEDLMEMERVFKRMKDSQCQPDDTTYTIMIEAYRKEGMNDKIYYLEQEKQTMMTDDKKVSQFENEILI

SEQ ID NO: 10297 - protein, 488 aa, Glycine max
MASISLSFCSSIVPSRIPHDKSNKTHSHHNPTFPLIRFGISAPAVKKRHWKKGEFPATSQPSFPNDTRRKTPLKNLKKKFDKKNDAKAWVNTVTESLSERIHNKHWLQALQVFDMLREQTFYQPKEGTCMKLIVLLGKSGQPHRAHQLFTTMIEEGLEPTPELYTALLAAYCRSNMIDEAFSVLNEMKKLPLCQPDVFTYSTLIKVCVDAFKFDLVQLLYEEMAERSITPNTVTQNIVLGGYGKAGMFDQMEKVLSSMLQSTTCKPDVWTMNTIISVFGNMGQIDMTEKWYEKFRYFGIEPETRTFNILIGAYGKKRMYDKMSSVMEYMRKLQFPWTTSTYNNVIEAFADAGDAKHMECTFDQMRAEGMKADTKTLCCLINGYANAGLFHKVISSVRLAGKLEIPENITFYNAVLSACAKAEDLMEMERVFKRMKDSQCQPDDTTYTIMIEAYRKEGMNDKIYYLEQEKQTMMTDDKKASQFENEILI

SEQ ID NO: 10298 - protein, 493 aa, Phaseolus vulgaris
MASLSLSFSSSIVPSRIPHHNSNRTHTQHSTFRVTCFAISSPPSKPVVKKRHWKKGEFPGTSETLLHDSTRRTPIKNIKQKLEKKNSAKAWVNTVTESLSEQIDKKQWLQALQVFDMLREQTFYRPKEGAYMKLIVLLGKSGQPHRAHQLFTTMIEEGLEPTPHLYTALLAAYCRSNLIDEAFSILNEMKKLPLCQPDVFTYSTLIKVCVDAFKFDLVELLYEEMAERSVTPNTVTQNIVLGGYGKAGKFDQMEKVLSSMLESTTCKPDVWTMNTIISVFGNIGQIDMMEKWYEKFRNFGIEPETRTFNILIGAYGKKRMYDKMSSVMEYMRRLQFPWTTSTFNNVIEAFADAGDVRHMECTFDQMRAEGMKADTKTFCCLIKGYANAGLFHKVISSVHLAGKFEIPQNIAFYNAVLSACAKAEDLMEMERVYKRMKDNQCQPDETTYMIMIEAYKKDNMNDKIYYLEQEKQTMITDNKKVSRSEDDIFSSDS

SEQ ID NO: 10299 - protein, 482 aa, Vigna unguiculata
IVPSSIPHHKSTKIHTQDSTFRVTCFAISSPPSKPVVKKRHWKKGEFPGTSETSLDDSTRRSPIKNIKKKLEKKNSAKAWVNTVTEALFEQIDKKQWLQALQVFDMLREQTFYKPKEGAYMKLIVLLGKSGQPHRAHQLFTTMIEEGLEPTPYLYTALLAAYCRSNLIDEAFSVLNEMKRLPLCQPDVFTYSTLIKVCVDAFKFDLVELLYEEMAERAITPNTVTQNIVLGGYGKAGKFDQMEKVLSSMLESITCKPDVWTMNTIISVFGNMGQIDMMEKWYEKFRNFGIEPETRTFNILIGAYGKKKMYDKMSSVMEYMRKLQFPWTTSTYNNVIEAFADAGDVRHMECTFDQMRAEGMKADTKTFCCLINGYANAGYFHKVISSVQLAGKFEIPENIAFYNAVLSACAKADDLMEMERVFKRMKDNQCQPDETTYMIMIEAYRKDGMNDKIYYLEQEKQTMITDNKIVSHYEDGIFSSDS

SEQ ID NO: 10300 - protein, 499 aa, Cicer arietinum
MASLSLTFSSSIAPSPISPHKFNKTRNPKPKVPIFPITRFAISSPPSASASNSSSVVKKKHWKQGEFPGFSETSLPGSTKRSPIKNLKKKLDRKNDAKAWVNTVTEALSECIDKKQWLQALQTFDMLREQSFYQPREGTYMKLIVLLGRSSQPHRARQLFTTMIEEGCDPTPELYTALLAAYCRSNMIDEALSILNEMKNHPLCQPDVFTYSTLIKVCVDAFKFELVELMYEEMAQRSIMPNTVTQNIVLSGYGKAGMFDQMEKVLSSMLQSTSCKPDVWTMNTIISVFGNMGQIDMMEKWYEKFRNFGIEPETRTFNILIGAYGKKRMYDKMSSVMEYMRKLQFPWTTSTYNNVIDAFADAGDAKNMEYTFNQMRSEGMRADTKTFCCLINGFANAGLFHKVISSVHLAAKLETPENTAFYNAVLSACAKAEDLMEMERVFKRMKDNQCQPDNTTYSIMVKAYRKQGMSDKIYYLEQEKQTMITDDKIVNQPEDELFS

SEQ ID NO: 10301 - protein, 497 aa, Lupinus angustifolius
MSSISISFSCSIIPSPIPLHNNNYPFPTTTQAPIFRVTLFAISSPPSKSASSTSQDVKKKHWKRGEFPGTSQTQSTRRTPIKNIKKRLDKKNIAKAWVNTVAEALSERVEKKQWLQALEIFDMLREQSWYQPKEGTYMKLIVLLGKSGQPHRARQLFTTMIEDGLEPTPELYTALLAAYCRSNLIDEAFSILNEMKSHPFCQPDIFTYSTLIKPCVDAFKFDLVELLYVEMAERSITPNTVTQNIVLNGYGKAGKFDEMEKVLSGMLESTTCKPDVWTMNTFISVFGNIGQIDMMEKWYKKFCNFGIEPETRTFNVLISAYVKKRMYHKMSSVMEYMRKLQLPWTTSTYNNMIEAFADVGDAKHMEYTFDQMRTEGMKADTRTFCCLINGYANAGLFHKVISSIRLAAKLEIAENITFYNAVLSACAKADDLMEMERVFNRMKDNQCQPDDTTFSIMIEAYRKEGMNDKIYYLEQEKQTMLTDDKIVSEPEDKIVQS

SEQ ID NO: 10302 - protein, 512 aa, Mimulus guttatus
MQMAFQLSLSSSFLPSPLPTTTTTTTRMTVTQSPRRLIYISSSTNSSSSTTVNSPKKKHWKVGEYPGLTHTSNPKFSTNKKRTPIKNIKKKLDRKINANAWVNTVTEALSDAIDKKQWLRALQVFEMLKVQPFYHPKEGTYMKLLVLLGRSGQPGQASQLFDEMLQTGLEPTPELYTALLAACCRSNLIDKAYEVLEQMKSLPLCQPDVYTYSILIKACADAFRFELVDSLYDEMAERLITPNTVTQNTVLSGYGKAGKYEEMEKILSKMLESTTSEPDVWTMNTIIGLFGNVGQIEMMEKWYEKFRNFGIEPETRTFNILIGAYGKKRMYDKMSSVMEYMRRLSFPWTTSTYNNVIEAFSDAGDAKHMEYTFDQMRAEGIKADTKTLCCLIRGFANAGLFHKVISMVQLAGRLEIPENTSFFNAVIYACSRADDLMEMERVFKRMKDKSCQPDSTTYSVMMDAYRKEGMSDKVYDLEQEMQRMNGGKVSKGYDDVETEANDDVSKEVLVMV

SEQ ID NO: 10303 - protein, 495 aa, Lippia dulcis
MASAFQLSLSSSFLPSPLPTKTTAAPQPLRRLIILAAASSSSSSTLNLPKKKHWKIGEYPGVIETSTPKFSSNSKKRAPIKNIKKKLDKKNNATGWANTVTEALSEAIDRKQWERALQVFEMLKVQPFYQPKEGTYMKLLVLLGRCGQPGQACQLFDEMLEEGLERTPQLFTALLGACCRSNLVDKAFSILEQMKSLPTCQPDVYTYSILIKACADAGRFELIESLYDQMDERLITPNTVTQNIVLSGYGKAGKYEEMEKILSKMLDSTMSPPDVWTMNTIISLFGNEGQIEMMERWYEKFRNFGIEPETRTFNILIGAYGKKRMYDKMSSVMEYMRRLSLPWTTSTYNNVIEAFSYAGDAKHMEYAFDQMRAEGMKADTKTLCCLIRGYANAGLFHKVISMVQLAGRLEIPENTSFFNAVIYACSRAEDLMEMERVFKRMKDKKCKPDTTTYSIMMDAYRKEGMSDKVYDLEQEQQMMTANVSKLCHDAGTGSF

SEQ ID NO: 10304 - protein, 516 aa, Mimulus guttatus
MQMATTAFQLSLSSSFLPSPLPTTTTTTTRMTVTQSPRRLLYISSSSTNSSSSTTVNSPKKKHWKVGEYPGLTHTSNPKFSTNKKRTPIKNIKKKLDRKSNANAWVNTVTEALSDAIDKKQWLRALQVFEMLKVQPFYHPKEGTYMKLLVLLGRSGQPGQASQLFDEMLQTGLEPTPELYTALLAACCRSNLIDKAYEVLEQMKSLPLCQPDVYTYSILIKACADACRFELVDSLYDEMAERLITPNTVTQNTVLSGYGKAGKYEEMEKILSKMLESTTSEPDVWTMNTIIGLFGNAGQIEMMEKWYEKFRNFGIEPETRTFNILIGAYGKKRMYDKMSSVMEYMRRLSFPWTTSTYNNVIEAFSDAGDAKHMEYTFDQMRAEGIKADTKTLCCLIRGFANAGLFHKVIGMVQLAGRLEIPENTSFFNAVIYACSRADDLMEMERVFKRMKDKSCQPDSTTYSVMMDAYRKEGMSDKVYDLEQEMQRMNGGKVSKGYDDVETEANDDVSKEVLVMV

SEQ ID NO: 10305 - protein, 511 aa, Avena sativa
MTATPAVIGLSAGNRLLSTSFGPPNDLLSDKVNSHMACATGDAHGSTSLQFAPHAAPKLTVAAHRLKLSPHGRAQVMRALRQSAPAAALAPPPPPPRSTAMEPAHDEFSLEAIILLQRSMLEKQWQLPFEDDDQAVSSPEEEEEDDGNSRASSVVVVARSGVSARQRRMSGRRRGRSKNGGAAAHLNISPELLQSRNRIYLRGTVSKELLTHKQVVHLSKKIKDGMWLQQQRSKLKEKLGNEPSYKQMAQSLRISTPELRSRMRESFLAREVLTMSNIRLVISIAQKYDKLGVELADLIQGGLIGLLRGIEKFDASRGFKISTYVYWWIRQGVSRALAENSKTFRLPTYLHERLIAIRGAKYTLEDQGISPTAKNIAVSLNISEKKVHNATEAVNKVLSLDQQAFPSLNGLPGDTLHSYIEDQNVANDPWHGFEQWYLKEEVNKLLNSTLTERERDIIRLYHGIGKQCHTWEDISRQFGLSRERVRQVGLIAMQKLKHAARRKKLDALLED

SEQ ID NO: 10306 - protein, 506 aa, Lolium multiflorum
MTATPAVIGLSAGNRLLSTSFGPPSDLLTDKVNSHMACATGDAHGSTSLQFAPPPAPKLTVAAHRLKLSPHGRAQVMRALRQSAPAAVLAPPPRPRSAAMDHPTDELALEAIIQLQRSMLEKQWQLPFEDDDDLAEEDDGGKTMASSVGVVARSGVSARQRRMSGRRRGRSKNGAAAAHLSISPELLQSRNRIYLRGTVSKELLTHKQVVQLSKKIKDGMWLQQQRSKLKEKLGNEPSYQQMAQSLRISTAELRSRMRESFLAREVLTMSNLRLVISIAQKYDKLGVELADLIQGGLIGLLRGIEKFDASRGFKISTYVYWWIRQGVSRALAENSKTFRLPTYLHERLIAIRGAKYALEDQGISPTTENIAVSLNISEKKVHNATEAVNKVLSLDQQAFPSLNGLPGDTLHSYIEDQNVANDPWHGFEEWYLKEEVNKLLDSTLTERERDIIRLYHGIGKQCHTWEDISRQFGLSRERVRQVGLIAMEKLKHTARRKRLDALLQDY

SEQ ID NO: 10307 - protein, 503 aa, Flaveria ramosissima
MMATNAVVGLRAGERLLGSTCYYSEVSEKLSCSSNLGFIFVPTTSSITSKKSPNYSHSLVNKRDTHPTRAVKEHVDTTLDSSSTDQWDDWVQRLDYPNEEVSEHELPVDALLLLHKSLLEKQWTLSTEEITTTEKNSKKVVTGSGISARTRRLNAQNKTPAKNSSVNQDGRNKQLRSIISPELLQNCQKGYLKGIKNEALLTHSEVVALSEKIKIGLQLEEEKSSLRERLGSEPSEKQLADFLKISQVDLQTKQMECALAREKLTLSNIRLVMSVAQKYKHMGADMSDLIQGGLIGLLRGIEKYDSSRGHKISTYVYWWIRQGVTRTFFENSKTLRLPTHLHERLSAIRTAKAKLERKGITPSIDRIAESLRMSRKKVTNATEAVCKVFSLDKEAFPSLNGLPGDTLHSYIADDCPDNNPWHGVDEGALKEEVRNLIKRTLGEREREIIYLYYGLDNEYLTWEDISRRKGLSRERVRQVGLVALEKLKHAAKNTKLAAMLVCD

SEQ ID NO: 10308 - protein, 143 aa, Flaveria ramosissima
MYVVLFLLVNSRDIYDGYKCSCWIKSRRTVIRLTCYYPEVSEKLSCSSNLGGIFVPTTSSITSKKSPNYSHSLVNKRDIHPTRAVKEHVDTALNSSSTDQWDDWVQRLDYLNEEVSEHELPVDALLLLHNLYWKNSGHSQLRR

SEQ ID NO: 10309 - protein, 493 aa, Flaveria ramosissima
MMATNAVVGLRAGERLLGSTCYYSEVSEKLSCSSNLGFIFVPTTSSITSKKSPNYSHSLVNKRDIHPTRAVKEHVDTALNSSSTDQWDDWVQRLDYLNEEVSEHELPVDALLLLHKSLLEKQWTLSTEETTTTEKNSKKVVTGSGISARRRRLNAQNKTPARSCSVNQDGRNKQLRSIISSELLQNCQKGYLKGVKNEALLTHSEVVSLSEKIKIGLQLEEEKSSLRERLGSEPSEKQLADFLKISQVDLQTKQMECALAREKLTLSNIRLVMSVAQKYKHMGADMSDLIQGGLIGLLRGIEKYDSSRGHKISTYVYWWIRQGVTRTFFENSKTLRLPTHLHERLSAIRTAKAKLERKGITPSIDKIAESLHMSRKKVTNATEAVCKVFSLDKEAFPSLNGLPGDTLHSYIADDCPDNNPWHGVDEGALKEEVRNLIKRTLGEREREIIHLYYGLDNEYLTWEDISRRKGLSRERVRQVGLVALEKLKHAAKN

SEQ ID NO: 10310 - protein, 149 aa, Flaveria ramosissima
MMATNAVVGLRAGERLLGSTCYYSEVSEKLSCSSNLGFIIVQLQVQSLLRSTPNYSHSLVNKRDIHPTRAVKEHVDTALNSSSTDQWDDWVQRLDYLNEEVSEHELPVDALLLLHKSLLVKTIGHYQQRDNNYRKEQQKVSHWFRDISS

SEQ ID NO: 10311 - protein, 502 aa, Flaveria ramosissima
MMATNAVVGLRAGERLFGSTCYYSEVCEKLSCSSNFGFIFVPTTSSITSKKSPNYSHSLVNKRDTHPTRAVKEHVDTALDSSSTDQWVDWVQRLDYLNEEVSEHELPVDALLLLHKSLLEKQWTLSTEETTTTEKKSKKVVTGSGISARRRRLNAQNKTPVKSSVNQDGRNKQLRSIISPKLLQNCQKGYLKGVKSEALLTHSEVVSLSEKIKIGLQLEEEKSSLKERLGSEPSEKQLADFLKISQVDLQTKQMECALAREKLTLSNIRLVMSVAQKYKHMGADMSDLIQGGLIGLLRGIEKYDSSRGHKISTYVYWWIRQGVTRTFFENSKTLRLPTHLHERLSAIRTAKAKLERKGITPSIDKIAESLHMSRKKVTNATEAVCKVFSLDKEAFPSLNGLPGDTLHSYIADDCPDNNPWHGVDEGALKEEVRNLIKRTLGEREREIIHLYYGLDNEYLTWEDISRRKGLSRERVRQVGLVALEKLKHAAKNTKLAAMLVND

SEQ ID NO: 10312 - protein, 497 aa, Helianthus annuus
MMATNAVVGLRAGERLLGSSSYYSEVSEKLSCSSNIGFIFVPTTSSIISKKSTNYSHSLVNKRDTHPTRAVKEHVDTALDSSTTDQWVHRFDYLDEEVSEHEFPVDALLLLHKSLLEKQWTLTTEETITTEKKSKKVVTGSGVSARRRRLNAQNKTLAKNCQDGGNKQLRSIISPELLQSYQKAYLKGVKNEALLTHSEVVALSEKIKIGLQLEEEKSSLKERLGTEPSEKQLADFLKISQVDLQTKQMECTLAREKLTLSNIRLVMSVAQKYKHMGADMSDLIQGGLIGLLRGIEKYDSSRGHKISTYVYWWIRQGVTRTFFENSKTLRLPTHLHERLSAIRSAKAKLERKGITPSIDRIAETLNMSRKKVTNATEAVCKVFSLDKEAFPSLNGIPGDTLHSYIADDCPDNNPWHGVDVGALKEEVRNLIKTTLGEREREIIHLYYGLDNEYLTWEDISRRKGLSRERVRQVGLVALEKLKHAARNTNLAAMLVYD

SEQ ID NO: 10313 - protein, 222 aa, Ambrosia trifida
MGADMSDLIQGGLIGLLRGIEKYDSSRGHKISTYVYWWIRQGVTRTFFENSKTLRLPTHLHERLSAIRSAKAKLERKGITPSIDKIAESLHMSRKKVTNATEAVCKVFSLDKEAFPSLNGLPGDTLHSYIADDCPDNDPWHGVDEGALKEEVRNLIKKTLGEREREIIYLYYGLDNEYLTWEDISRRKGLSRERVRQVGLVALEKLKHAARNTNLAAMLVND

SEQ ID NO: 10314 - protein, 497 aa, Helianthus annuus
MMATNAVVGLRAGERLLGSSSYYSEVSEKLSCSSNIGFIFVPTTSSIISKKSTNYSHSLVNKRDTHPTRAVKEHVDTALDSSTSDQWVHRFDYLDEEVSKHEFPVDALLLLHKSLLEKQWTLSTEETITTEKKTKKVVTGSGVSARRRRLNAQNKTLAKNCQDGGNKQLRSIISPELLQSYQKAYLKGVKNEALLTHSEVVALSEKIKIGLQLEEEKSSLKERLGTEPSEKQLADFLKISQVDLQTKQMECTLAREKLTLSNIRLVMSVAQKYKHMGADMSDLIQGGLIGLLRGIEKYDSSRGHKISTYVYWWIRQGVTRTFFENSKTLRLPTHLHERLSAIRSAKAKLERKGITPSIDRIAETLNMSRKKVTNATEAVCKVFSLDKEAFPSLNGIPGDTLHSYIADDCPDNNPWHGVDVGALKEEVRNLIKTTLGEREREIIHLYYGLDNEYLTWEDISRRKGLSRERVRQVGLVALEKLKHAARNTNLAAMLVYD

SEQ ID NO: 10315 - protein, 500 aa, Helianthus annuus
MMATNAVVGLRAGERLLGSSSYYSEVSEKLSCSSNIGFIFVPTTSSIISKKSTNYSHSLVNKRDTHPTRAVKEHVDTALDSSTSDQWAHRFDYLDEEVSEHEFPVDALLLLHKSLLEKQWTLSTEETITTEQKTKKVVTGSGVSARRRRLNAQNKTLAKNCSGNQDGGNKQFKSIISPELLQSYQKAYLKGVKNEALLTHSEVVALSEKIKIGLQLEEEKSSLKERLGTEPSEKQLADFLKISQVDLQTKQMECTLAREKLTLSNIRLVMSVAQKYKHMGADMSDLIQGGLIGLLRGIEKYDSSRGHKISTYVYWWIRQGVTRTFFENSKTLRLPTHLHERLSAIRGAKAKLERKGITPSIDRIAETLNMSRKKVTNATEAVCKVFSLDKEAFPSLNGIPGDTLHSYIADDCPDNNPWHGVDVGALKEEVRNLIKTTLGEREREIIHLYYGLDNEYLTWEDISRRKGLSRERVRQVGLVALEKLKHAARNTNLAAMLVYD

SEQ ID NO: 10316 - protein, 479 aa, Helianthus annuus
MATNAVVGLRAGERLLGSSSYYSEVSEKLSCSSNIGFIFVPTTSSIISKKSTNYSHSLVNKRDTHPTRAVKEHVDTALDSSTSDQWAHRFDYLDEEVSEHEFPVDALLLLHKSLLEKQWTLSTEETITTEKKSKKVVTGSGVSARRRRLNAQNKTLAKNCQDGGNKQLRSIISPELLQSYQKAYLKGVKNEALLTHSEVVALSEKIKIGLQLEEEKSSLKERLGTEPSEKQLADFLKISQVDLQTKQMECTLAREKLTLSNIRLVMSVAQKYKHMGADMSDLIQGGLIGLLRGIEKYDSSRGHKISTYVYWWIRQGVTRTFFENSKTLRLPTHLHERLSAIRGAKAKLERKGITPSIDRIAETLNMSRKKVTNATEAVCKVFSLDKEAFPSLNGIPGDTLHSYIADDCPDNNPWHGVDVGALKEEVRNLIKTTLGEREREIIHLYYGLDNEYLTWEDISRRKGLSRERVRQVGLVALEN

SEQ ID NO: 10317 - protein, 492 aa, Echinacea purpurea
MATNAFAGLRAGERLLGSSSYYSEVSEKLSCSSNLGFISAPTTNSIVSKKSPNHSHGLVNKRVTHPTRAVKEHVVDTALDSSPTDQWFQRFGYLNDDVSELEFPVDALLLLQKSLLEKQWTLSTDETTIVEKSSKKVVTGSGISARRRRLFAQNKTPAKNCSVKQDGGHKQLRSVISPELLLNYQKGYLKGVKTEALLTHSEVVALSEKIKIGLQLEEEKSSLKERLGTEPSEKQLADFLKISRVDLQTKQMECSLAREKLTLSNIRLVMSVAQKYKHMGADMSDLIQGGLIGLLRGIEKYDSSRGHKISTYVYWWIRQGVTRTFFENSKTLRLPTHLHERLSAIRSAKAKLERKGISPSIDRIAETLNMSRKKVTNATEAVCKVFSIDKEAFPSLNGIPGDTLHSYIADDCPDNDPWHVVDEGALKNEVRNLIKMTLGEREREIIHLYYGLDNEYLTWEDISRRKGLSRERVRQVGLVALEKLKRRPEIQI

SEQ ID NO: 10318 - protein, 360 aa, Ambrosia trifida
TGFIFVPTTSSIISKKSRNYSHSLVNKRDTHPTRAVKEHVDTALDSSSTDQWVQRFDYLDEEVADHEIAVDALLLLHKSLLEKQWTLTTEETTTTEKNSKKVVTGSGISARRRRLNAQNKTPVEICSGNQDGGNKKLRSIISPELLQNYQKAYLKGVKNETLLTHSEVVALSEKIKIGLQLEEEKSSLKERLGTDPSEKQLADFLKISQVDLQTKQMECTLAREKLTLSNIRLVMSVAQKYKHMGADMSDLIQGGLIGLLRGIEKYDSSRGHKISTYVYWWIRQGVTRTFFENSKTLRLPTHLHERLSAIRSAKAKLERKGITPSIDKIAESLHMSRKKVTNATEAVCKVFSLDKEASLL

SEQ ID NO: 10319 - protein, 500 aa, Ambrosia trifida
MMATNAVVGLRAGERLLGSSSYYSEVCEKLSCSSNIGFIFVPTTSSIISKKSRNYSHSLVNKRDTHPTRAVKEHVDTALDSSSSDQWVQRFDYLDEEVADHEIAVDALLLLHKSLLEKQWTLSTEETTTTEKNSKKVVTGSGISARRRRLNAQNKTSVQSCSRNQDGGNKKLRSIISPELLQNYQKAYLKGVKNETLLTHSEVVALSEKIKIGLQLEEEKSSLKERLGIDPSEKQLADFLKISQVDLQTKQMECTLAREKLTLSNIRLVMSVAQKYKHMGADMSDLIQGGLIGLLRGIEKYDSSRGHKISTYVYWWIRQGVTRTFFENSKTLRLPTHLHERLSAIRSAKAKLERKGITPSIDKIAESLHMSRKKVTNATEAVCKVFSLDKEAFPSLNGLPGDTLHSYIADDCPDNDPWHGVDEGAPKEEVRNLIKKTLGDGKERSYIFTTAWTMNILLGRISVEGRGCQGNEFRSGLALLHWRTKTCGQNTNLAAMLVND

SEQ ID NO: 10320 - protein, 90 aa, Ambrosia trifida
MECTLAREKLTLSNIRLVMSVAQKYKHMGADMSDLIQGGLIGLLRGIEKYDSSRGHKISTYVYWWIRQGVTRTFFENSKTLDCLLICMKD

SEQ ID NO: 10321 - protein, 131 aa, Ambrosia trifida
MSRKKVTNATEAVCKVFSLDKEAFPSLNGLPGDTLHSYIADDCPDNDPWHGVDEGALKEEVRNLIKKTLGEREREIIYLYYGLDNEYLTWEDISRRKGLSRERVRQVGLVALEKLKHAARNTNLAAMLVND

SEQ ID NO: 10322 - protein, 506 aa, Centaurea maculosa
MMSTTAVTGLRAGKRLLGSSPYYSEVSEKLTCSSNLGFISVPTTNLITSKKSPNFSHGSIYSRDTHSVRALKEHVDTALDVPSTDQWAQRFDHLDEEVSDSEHELSVEAMLLLHKSLLEKQWTLSTERTTTSTPTKRNSRKVHVTGSGVSARRRRIDAQNKAPNSNYSVNQVSGSRQLRSIISPELLQNCQRGYLKGVRNEALLTHSEVVALSEKIKIGLHLEEEKSRLKERLGSEPSEKQLATSLQISQLDLQTKQTECTLAREKLALSNVRLVMSVAQKYKHMGADMSDLIQGGLIGLLRGIEKYDSSRGHKISTYVYWWIRQGVTRTFFENSKTLRLPTHLHERLGAIRNAKSKLERKGITPSIDKIAESLKMSRKKVTNATEAVYKVFSLDKEAFPSLNGLPGDTLHCYIADDSPQNNPWHGVDEEALKDEVRKLIAMTLGEREREIIHLYYGLDNEYLTWEDISRRKGLSRERVRQVGLVALEKLKHAAKNTRLAEMLDYD

SEQ ID NO: 10323 - protein, 506 aa, Cirsium arvense
MMSTTAVTGLRAGKRLLGSSPYYSEVSEKLTCSSNLGFISVPTTNLITSKKSTNFSHGSIYSRDTHSVRALKEHVDTALDVPSTDQWAQRFDHLDEEVSDSEHELSVEAMLLLHKSLLEKQWTLSTERTTTSTPIKRNSRKVHVTGSGVSARRRRIDAQNKAPNSNYSVNQVSGSRQLRSIISPELLQNCQRGYLKGVRNEALLTHSEVVALSEKIKIGLHLEEEKSRLKERLGSEPSEKQLATSLQISQLDLQTKQTECTLAREKLALSNVRLVMSVAQKYKHMGADMSDLIQGGLIGLLRGIEKYDSSRGHKISTYVYWWIRQGVTRTFFENSKTLRLPTHLHERLGAIRNAKSKLERKGITPSIDKIAESLKMSRKKVTNATEAVYKVFSLDKEAFPSLNGLPGDTLHCYIADDSPQNNPWHGVDEEALKDEVRKLIAMTLGEREREIIHLYYGLDNEYLTWEDISRRKGLSRERVRQVGLVALEKLKHAAKNTRLAEMLDYD

SEQ ID NO: 10324 - protein, 506 aa, Centaurea maculosa
MMSTTAVTGLRAGKRLLGSSPYYSDVSEKLTCSSNLVFISVPTTNLITSKKSTNFSHGSIYSRDTHSVRALKEHVDTALDLPSTDQWAQRFDHLDEEVSDSEHELSVEAMLLLHKSLLEKQWTLSTERTTTTTPTKRNNRKVHVTGSGVSARRRRIDAQNKTPSRNYSVNQVSGSRQLRSIISPELLQNCQRGYLKGVRNEALLTHSEVVALSEKIKIGLHLEEEKSRLKERLGCEPSEKQLATSLQISQLDLQTKQTECTLAREKLALSNVRLVMSVAQKYKHMGADMSDLIQGGLIGLLRGIEKYDSSRGHKISTYVYWWIRQGVTRTFFENSKTLRLPTHLHERLGAIRNAKSKLERKGITPSIDKIAESLKMSRKKVTNATEAVYKVFSLDKEAFPSLNGLPGDTLHCYIADDSPQNNPWHGVDEEALKDEVRKLITKTLGEREREIIHLYYGLDNEYLTWEDISRRKGLSRERVRQVGLVALEKLKHAAKNTRLAEMLDYD

SEQ ID NO: 10325 - protein, 197 aa, Ambrosia trifida
MMATNAVVGLRAGERLLGSSSYYSDVCEKLACSSNTGFIFVPTTSSIVSKKSRNYSHSLVNKRDTHPTRAVKEHVDTALDSSSTDQWVQRFDYLDEEVADHEIAVDALLLLHKSLLEKQWTLSTEETTTTEKNGKKVVTGSGISARRRRLNAQNKTPVESCSGNQDGGHKKLRSIISPELLQNYQKAYLKGVKTKRC

SEQ ID NO: 10326 - protein, 494 aa, Tragopogon dubius
MATTAVVGLRTGNRILSSSSYYSDVSEKLSCSSNMWFIYVPTTNLITSKKSPNYSHSYIYSRDIHPVRALKEHVDTTLDPPITDQWIQGFDHLEENEIPVEALLLLQKSLLEKQWTLSTDTDTEKISRKLRVTGSGVSARRRRIDSQNKTPTRTSSVNQVGGNKQLRSIISPELLQNCQKGYLKGAKNEALLTHSEVVALSEKIKIGLHLEEEKLRLKERLGSEPSEKQLAASLKISRVELQAKQIECSLAREKLALSNVGLVMSVALKYKHMGADMSDLIQGGLIGLLRGIEKYDSSRGHKISTYVYWWIRQGVTRTFFENSRTLRLPTHLHERLGAIRNAKAKLERKGITPSIDKIAESLNMSKKKVTNATEAVCKVFSLDKAAFPSLNGLPGETLHSYIADDCPENNPWHGVDEGALKDEVRKLIQSTLGEREREIIHLYYGLDNEYLTWEDISRRKGLSRERVRQVGLVALEKLKHAARNTKLAEMLVNH

SEQ ID NO: 10327 - protein, 499 aa, Gossypium raimondii
MMATAAIIGLTVGKRFLSSSFSYSDIIEKHSYAGDYGGAPHYQTAPTKSLIVAKKSSNCSQSVPSYDRRSRSIKALKEHVDTASLVSTAGPWCQGSDDFEEESYELDYSVEALLLFQKSMLEQQWTLSFERTVFTESPSRKTKKKVPVTCSGVSARQRRFNTRMQPNAKQLRSLISPELLRSRLKGYVRGVVSEELLSHAEVVRLSKKIKAGLSLEDQRLRLKERLGCDPSDEQLATSLKISRAELRSMLIECSLARDKLAMSNVRLVMSIAQRYDNMGAEMPDLIQGGLIGLLRGIEKFDSSKGYKISTYVYWWIRQGVSRALVDNSRTLRLPTHMHERLGLIRNAKYRLEEKGITPTIDRIAESLNMSQKKVRNATKADSKVFSLDRVAFPSLNGLPGETHHSYIADNHEENNPWHGVDEGALKDEVNRLIGITLGEREREIIKLYHGLGKESLTWEDISKRIGLSRERVRQIGLVALEKLKNAARKNGMEAMLLKQ

SEQ ID NO: 10328 - protein, 499 aa, Gossypium raimondii
MMATAAIIGLTVGKRLLSSSFSYSDIIEKHSYAGDYGGAPHYQTAPTKSLIVAKKSSNCSQSVPSYDRRSRSIKALKEHVDTASLVSTAGPWCRGSDDFEEESYELDYSVEALLLFQKSMLEQQWTLSFERTVFTESPSRKTKKKVPVTCSGVSARQRRFNTRMQPNAKQLRSLISPELLRSRLKGYVRGVVSEELLSHAEVVRLSKKIKAGLSLEDQRLRLKERLGCDPSDEQLATSLKISRAELRSMLIECSLARDKLAMSNVRLVMSIAQRYDNMGAEMPDLIQGGLIGLLRGIEKFDSSKGYKISTYVYWWIRQGVSRALVDNSRTLRLPTHMHERLGLIRNAKYRLEEKGITPTIDRIAESLNMSQKKVRNATKADSKVFSLDRVAFPSLNGLPGETHHSYIADNHEENNPWHGVDEGALKDEVNRLIGITLGEREREIIKLYHGLGKESLTWEDISKRIGLSRERVRQIGLVALEKLKNAARKNGMEAMLLKQ

SEQ ID NO: 10329 - protein, 499 aa, Gossypium hirsutum
MMATAAIIGFTVGKRLLSSSFSYSDIIEKHSYAGDYGGAPHYQTAPTKSLIVAKKSSNCSQSVPSYDRRSRSIKALKEHVDTASLVSTAGPWCRGSDDFEEESYELDYSVEALLLFQKSMLEQQWTLSFERTVFTESPSRKTKKKVPVTCSGVSARQRRFNTRMQPNAKQLRSLISPELLRSRLKGYVRGVVSEELLSHAEVVQLSKKIKTGLSLEDQRLRLKERLGCDPSDEQLATSLKISRAELRSMLIECSLARDKLAMSNVRLVMSIAQRYDNMGAEMPDLIQGGLIGLLRGIEKFDSSKGYKISTYVYWWIRQGVSRALVDNSRTLRLPTHMHERLGLIRNAKYRLKEKGITPTIDRIAESLNMSQKKVRNATEADSKVFSLDRVAFPSLNGLPGETHHSYIADHHEENNPWHGVDEGALKDEVNRLIGITLGEREREIIKLYHGLGKESLTWEDISKRIGLSRERVRQIGLVALEKLKNAARKNGMEAMLLKQ

SEQ ID NO: 10330 - protein, 508 aa, Theobroma cacao
MMATAAVIGLTTGKRLLSSSFSYSDIIEKLSYANDYGSSHHQTSSTKSLIVAKKSSNCSQSLPSSNRRAQSIKALKEHVDSASIVSTAEPLFQGSNDLEVESYDLDYSVEALLLLQKSMLEKQWTLSFERTVFTESPSRKIHKKIPVTCSGVSARQRRFNTKRKILIQNKSIIQPNAKQLRSLISPELLQSRLKGYVKGVVSDELLSHAEVVRLSKKIKAGLSLEEHRLRLKERLGCEPSDEQLATSLKISRAELRSKLIECSLAREKLAMSNVRLVMSIAQRYDNMGAEMSDLIQGGLIGLLRGIEKFDSSKGYKISTYVYWWIRQGVSRALVENSRTLRLPTHLHERLGLIRNAKIRLEEKGITPTIDRIAESLNMSQKKVRNATEAVSKVFSLDRDAFPSLNGLPGETHHSYIADNHVENIPWHGVDEWALKDEVNRLITITLGEREREIIRLYYGLDKESLTWEDISKRIGLSRERVRQVGLVALEKLKHAARKKKMEAMLVKH

SEQ ID NO: 10331 - protein, 508 aa, Gossypium raimondii
MMATAAVIGLSTGKRLLSSSFSYSETVDKLSYAGDYGSSYYQTPSTKTLMVAKRSSNCSQNLPSSNRHTQSIKAFKEHVDTASSISTVEPWIHGTNDLEQESYDLDYSVEALLLLQKSMLEKQWTLSFERTMFTESPSRKTHNKVPVTCSGVSARQRRFNTKRKILSQNKSMIQPNAKQLRSLIGPELLQNRLKGYVKGVVSEDLLSHAEVVRLSKKIKAGLSLEEHRLRLKERLGCEPSDEQLATSLKVSRAELRSRSIECSLAREKLAMSNVRLVMSIAQRYDNMGAEMSDLIQGGLIGLLRGIEKFDSSKGYKISTYVYWWIRQGVSRALVENSRTLRLPTYLHERLGLIRNAKYRLEEKGITPTIDRIAESLNMSQKKVRNATEAVSKVFSLDRDAFPSLNGLPGETHHSYIADNHVENNPWHGVDEWALKDEVNRLINITLGEREREIIRLYHGLDKESLTWEDISKRIGLSRERVRQVGLVALEKLKHAARKKKMEAMLVKH

SEQ ID NO: 10332 - protein, 508 aa, Gossypium raimondii
MMATAAVIGLSTGKRLLSSSFSYSETVDKLSYAGDYGSSYYQTPSTKTLMVAKRSSNCSQNLPSSNRHTQSIKAFKEHVDTASSISTVEPWIHGTNDLEQESYDLDYSVEALLLLQKSMLEKQWTLSFERTMFTESPSRKTHNKVPVTCSGVSARQRRFNTKRKILSQNKSMIQPNAKQLRSLIGPELLQNRLKGYVKGVVSEDLLSHAEVVRLSKKIKAGLSLEEHILRLKERLGCEPSDEQLATSLKVSRAELRSRSIECSLAREKLAMSNVRLVMSIAQRYDNMGAEMSDLIQGGLIGLLRGIEKFDSSKGYKISTYVYWWIRQGVSRALVENSRTLRLPTYLHERLGLIRNAKYRLEEKGITPTIDRIAESLNMSQKKVRNATEAVSKVFSLDRDAFPSLNGLPGETHHSYIADNHVENNPWHGVDEWALKDEVNRLINITLGEREREIIRLYHGLDKESLTWEDISKRIGLSRERVRQVGLVALEKLKHAARKKKMEAMLVKH

SEQ ID NO: 10333 - protein, 479 aa, Brassica juncea
KFGGSSVATAGRMREVADLVLTFPEESPVIVLSAMGKTTNNLLLAGEKAVSCGVSNASEIEELSIIKELHLRTVKELEIDPSVVSSFLEELEQLLKGIAMMKELTLRTRDYLVSFGECLSTRIFAAYLNKIGVKARQYDAFEIGFITTDDFTNGDILEATYPAVAKRLYDDWMHDPAVPVVTGFLGKGWKTCAVTTLGRGGSDLTATTIGKALGLQEIQVWKDVDGVLTCDPTIYKRATPVPYLTFDEAAELAYFGAQVLHPQSMRPAREGGIPVRVKNSYNPKAPGTIITKTRDMTKTVLTSIVLKRNVTMLDIASTRMLGQVGFLAKVFSIFEDLEISVDVVATSEVSISLTLDPSKLWSRELIQQELDHVVEELEKIAVVNLAKGRAIISLIGNVQHSSLILERAFHVLWTKGINVQMISQGASKVNISLIVNDAEAEGCVEALHKSFFESGDLSELLIQPRLGNGSPVRTMQVEN

SEQ ID NO: 10334 - protein, 554 aa, Setaria italica
MATSVRSAAAPRRLAPSAPPASAGHVRGLARFGNRTGPLGARGLSMVVADSTRRRAKFGSGDSVLGAPVLGGPGAELGDQLSVVMKFGGSSVSSAARMEEVADLILAFPEERPVVVLSAMGKTTNLLLLAGEKAVGCGVIHVSEIEEWNTIKDLHIKTVDELGLPRSEIHDMLDELEQLLKGIAMMKELTLRTRDYLVSFGECMSTRIFAAYLNKIGVKARQYDAFDIGFITTDDFGNADVLEATYPAVAKRLHGDWIRDPAIPVVTGFLGKGWKSGAVTTLGRGGSDLTATTIGKALGLREIQVWKDVDGVLTCDPNIYPHAKTVPYLTFEEATELAYFGAQVLHPQSMRPAREGDIPVRVKNSYNPKAPGTLITKQREMDKVVLTSIVLKSNVTMLDIVSTRMLGQFGFLARVFSIFEDLGISVDCVATSEVSISVSLDPSKIWSRELIQQELDNVVEELEKIAIVHLLQQRAIISLIGNVKRSSLILEKTFQVLRKCGVNIQMISQGASKVNMSLIVHDSEAKACIKALHQAFFEDEDVLTQVETENLLVG

SEQ ID NO: 10335 - protein, 555 aa, Panicum virgatum
MATSVRSAAAPRRLVPAIPPASAGHVRGQASFGTRTWSDGARGLSMVVAGSTRRRAREGGDGDGVHVAPVVGGPGAELGDQLSVVMKFGGSSVSSAARMKEVAGLILAFPEERPVVVLSAMGKTTNLLLLAGEKAVGCGVIHVSDIEEWNTIKDLHIKTVDELGLQRSVVHDMLDELEQLLKGIAMMKELTLRTRDYLVSFGECMSTRIFAAYLNKIGVKARQYDAFDIGFITTDDFGNADILEATYPAVAKRLHGDWIRDPAIPVVTGFLGKGWKSGAVTTLGRGGSDLTATTIGKALGLREIQVWKDVDGVLTCDPNIYPNAKTVPYLTFEEATELAYFGAQVLHPQSMRPAREGDIPVRVKNSYNPKAPGTLITKQREMDKVVLTSIVLKSNVTMLDIVSTRMLGQFGFLARVFAIFEDLGISVDCVATSEVSISVSLDPSKIWSRELIQQELDNVVEELEKIAIVHLLQQRAIISLIGNVRRSSLILEKAFHVLRKSGVNVQMISQGASKVNMSLIVHDSEAKACVKALHQAFFEDDDVLTQVEAENLLVS

SEQ ID NO: 10336 - protein, 567 aa, Brachypodium distachyon
MAIALRFAATPRRLAASIPESYPGHGVGGVARAGALWGTRRGWRLAMVVVPDSTRCRAKRGGDGDGVLGVAADGGDAAVGGGDQLSVVMKFGGSSMSSAARMEEVAGLITAFPEERPVVVLSAMGKTTNLLLLAGEKAVGCGVIYVSEIEEWNMIKDLHIKTVDELGLPRSVIHSMLDELEQLLKGIAMMKELTLRTTDYLVSFGECMSTRIFAAYLNKIGIKARQCDAFDIGFITTDDFGNAEILEATYPAVAKRLHGDWVRDPAIPIVTGFLGKGWKSGAVTTLGRGGSDLTATTIGKALGLREIQVWKDVDGVLTCDPNIYPNAKTVPYLTFEEASELAYFGAQVLHPQSMRPAREGDIPVRVKNSYNPKAPGTLITKRREMDKVVLTSLVLKSNVTMLDIVSTRMLGQFGFLAKVFSIFEDLGISVDCVATSEVSISVSLDPSKIWSRELIQQELDHVVEELEKIAVVHLLQQRAIISLIGNVRRSSLILEKAFHVLRKSGVNVQMISQGASKVNMSLIVHDSEAKQCMKALHQAFFEGDHPLVVEIEEEDVEILQLRADHPV

SEQ ID NO: 10337 - protein, 564 aa, Hordeum vulgare
MAIALRFAATPPRLAAPIPPTGAPRAHGGAARVGALVGTRRGRILAMAAADSARCRAKIGGDGDGVLAGVAVHGGTGEEGEDQLSVVMKFGGSSVSSAARMKEVAGLIQAFPEERPVVVLSAMGKTTNLLLLAGEKAVGCGVTNVSQIEEWNMLRDLHIRTVDELGLPRSVIHTKLDELEQLLKGVAMMKELTLRSTDYLVSFGECMSTRVFAAYLNKIGVKARQCDAFDIGFITTDDFGNAEILEATYPAVAKRLHGDWIRDPAIPIVTGFLGKGWKSGAVTTLGRGGSDLTATTIGKALGLREIQVWKDVDGVLTCDPNIYPNAKTVPYLTFDEAAELAYFGAQVLHPQSMRPAREGDIPVRVKNSYNPKAPGTLIAKGRDMDKVVLTSIVLKSNVTMLDIVSTRMLGQFGFLAKVFSIFEDLGISVDCVATSEVSISVSLDPSKIWSRELIQQELDHVVEELEKIAFVHLLQQRAIVSLIGNVRKSSLILEKAFHVLRRIGVNVQMISQGASKVNMSLIVHDSEAKLCVEALHQAFFEGDGDGDDRLTAEFDEEENLRLEL

SEQ ID NO: 10338 - protein, 284 aa, Secale cereale
MAIALRFAATTPRLAAPIPPTSAPRAHGGVARVGALGGTRRGRRLAMAAADSARCRAKREGDGDGVLAGVAVHGGTGAEGEDQLSVVMKFGGSSVSSAARMKEVAGLIQAFPEERPVVVLSAMGKTTNLLLLAGEKAVGCGVTRVSEIEEWNMIRDLHIMTVDELGLPRSVIHAKLDELEQLLKGVAMMKELTLRSTDYLVSFGECMSTRVFAAYLNQIGVKARQCDAFDIGFITTDDFGNAEILEATYPAVAKRLHGDWIRDPAIPVVTGSLGRAGNQVPLLL

SEQ ID NO: 10339 - protein, 555 aa, Sorghum bicolor
MATPVRSAAAPRRLVPSIPPASSGHVQQLACFGTRTEPCGARGLSMVVADSTRRRAKLGDGGDGVLGASVLGGLGMAGLGDQLSVVMKFGGSSVASAARMAEVAGLILTFPEERPVVVLSAMGKTTNNLLLAGEKAVGCGVIHVSEIEEWNMIKDLHIKTVDELGLPRSVIQDMLDELEQLLKGIAMMKELTPRTSDYLVSFGECMSTRIFAAYLNKIGVKARQYDAFDIGFMTTDEFGNADILEATYPAVAKRLHGDWILDPAIPVVTGFLGKGWKSGAVTTLGRGGSDLTATTIGKALGLREIQVWKDVDGVLTCDPNIYPHAKTVPYLTFEEATELAYFGAQVLHPQSMRPAREGDIPVRVKNSYNPKAPGTLITKQRDMDKVVLTSIVLKSNVTMLDIVSTRMLGQYGFLARVFAIFEDLGISVDCVATSEVSVSVSLDPSKIWSRELIQQELDNVVEELEKIAIVHLLQQRAIISLIGNVRQMSLILEKTGHVLRKSGVNVQMISQGASKVNMSLIVHDSEAKALVEALHQAFFQDDVLAQVEVENLLVG

SEQ ID NO: 10340 - protein, 322 aa, Secale cereale
MLRYWKQLILLLQRDYMGTGFGIQQYLLLLGSVGKGWKSGAVTTLGRGGSDLTATTIGKALGLREIQVWKDVDGVLTCDPNIYPNARTVPYLTFDEAAELAYFGAQVLHPQSMRPAREGDIPVRVKNSYNPKAPGTLIAKGRDMDKVVLTSIVLKSNVTMLDIVSTRMLGQFGFLAKVFSIFEDLGISVDCVATSEVSISVSLDPSKIWSRELIQQELDHVVEELEKIAFVHLLQQRAIVSLIGNVRKSSLILEKAFHVLRKIGVNVQMISQGASKVNMSLIVHDSEAKLCVEALHQAFFEGDGDDRLTAEFDEEENLRLEL

SEQ ID NO: 10341 - protein, 499 aa, Brassica rapa
MKQEQLCLLVAKVSSTQELWSLLVSQSFDGIYTTTCSRRVASVSVVPTTCSTKSPKERKDKKSSGLISTKHQVDPKRELSRILRTDAAVKSIERKANSEKYNTLWPKAVLEALDDAVKENRWQSALKIFSLLRKQHWYEPRCKTYTKLFKLLGNCKQPEQASLLFELMLSEGLKPTIDVYTSLISVYGKCSLLEKAFATLEYMKSVSDCTPDVFTFTVLISCCCKLARFDLVNRVLLEMSYLGVRCSTVTYNTILDGYGKAGMFEEMENVLADMIEDGDSLPDVYTFNSIIGSYGNGGNIRKMESWYNRFQLMGVEPDITTFNVLILSFGKAGMYKKMSSVMDYMEKRFFSPTVVTYNIVIETFGKAGRIEKMEEVFRKMKYRGVKPNSITYCSLVDAYSKAGLVGKIDSVLRQVVNSDVVLDTVFFNCIINAYGEAGDLATMKELYIQMEERKCKPDKITFATMVKTYAAHGIFDAVRELEKQMISTCESSGKKRLMG

SEQ ID NO: 10342 - protein, 449 aa, Arabidopsis thaliana
MCSTKVPNERTEKMNSGLISTRHQVDPKKELSRILRTDAAVKGIERKANSEKYLTLWPKAVLEALDEAIKENRWQSALKIFNLLRKQHWYEPRCKTYTKLFKVLGNCKQPDQASLLFEVMLSEGLKPTIDVYTSLISVYGKSELLDKAFSTLEYMKSVSDCKPDVFTFTVLISCCCKLGRFDLVKSIVLEMSYLGVGCSTVTYNTIIDGYGKAGMFEEMESVLADMIEDGDSLPDVCTLNSIIGSYGNGRNMRKMESWYSRFQLMGVQPDITTFNILILSFGKAGMYKKMCSVMDFMEKRFFSLTTVTYNIVIETFGKAGRIEKMDDVFRKMKYQGVKPNSITYCSLVNAYSKAGLVVKIDSVLRQIVNSDVVLDTPFFNCIINAYGQAGDLATMKELYIQMEERKCKPDKITFATMIKTYTAHGIFDAVQELEKQMISSDIGKKRLTE

SEQ ID NO: 10343 - protein, 806 aa, Vigna unguiculata
MAHHPLTHSHSFRERVDETLSGNRNEILALLSRLEAKGKGILQHHQVIAEFEEIPEENRKKLQDGAFGEVLRSTQEAIVLPPFVALAVRPRPGVWEYLRVNLHMLVVDELSPAEYLRFKEELVEGSANGNFVLELDFEPFNASFPRPTLNKSIGNGVEFLNRHLSAKLFHDKESMQPLLEFLRLHSYKGTTMMLNDKVQNLNSLQHVLRKAEEYLTSVAPATPYSEFESRFREIGLERGWGDTAERVLEMIQLLLDLLEAPDPCTLETFLGRVPMVFNVVILSPHGYFAQDNVLGYPDTGGQVVYILDQVRALENEMLNRIKKQGLDITPRILIITRLLPDAVGTTCGQRLERVYDTEYCDILRVPFRTEEGIVRKWISRFEVWPYLETYAEDVAVELAKELQAKPDLIVGNYSDGNIVASLLAHKLGVTQCTIAHALEKTKYPESDIYWKKFEEKYHFSCQFTADLFAMNHTDFIITSTFQEIAGSKDTVGQYESHTAFTLPGLYRVVHGIDVFDPKFNIVSPGADMGIYFPYTETERRLTNFHPEIEELLYSSVENEEHICVLKDRNKPIIFTMARLDRVKNITGLVEWYGKNARLRELVNLVVVAGDRRKESKDLEEKAEMKKMYGLIETYKLNGQFRWISSQMNRVRNGELYRVICDTKGAFVQPAVYEAFGLTVVEAMTCGLPTFATFNGGPAEIIVHGKSGYHIDPYHGDQAAELLVDFFEKSKADPSHWDTISQGGLKRIQEKYTWQIYSERLLTLTGVYGFWKHVTNLERRESKRYLEMFYALKYRKLAESVPLAIEE

SEQ ID NO: 10344 - protein, 806 aa, Glycine max
MANHPLTHSHSFRERFDETLTGHRNEILALLSRLEAKGKGILQHHQVVAEFEEIPEESRKKLQDGVFGEVLRSTQEAIVLPPFVALAVRPRPGVWEYLRVNVHMLVVDELRPAEYLRFKEELVEGSSNGNFVLELDFEPFNASFPRPTLNKSIGNGVEFLNRHLSAKLFHDKESMQPLLEFLRLHSYKGKTMMLNDKVQSLDSLQHVLRKAEEYLISVAPETPYSEFENRFREIGLERGWGDTAERVLEMIQLLLDLLEAPDPCTLETFLGRVPMVFNVVILSPHGYFAQDNVLGYPDTGGQVVYILDQVRALENEMLNRIKKQGLDITPRILIITRLLPDAVGTTCGQRLERVYDTEYCDILRVPFRTEKGIVRKWISRFEVWPYLETYTEDVALELAKELQAKPDLIVGNYSDGNIVASLLAHKLGVTQCTIAHALEKTKYPESDIYWKKFEEKYHFSCQFTADLFAMNHTDFIITSTFQEIAGSKDTVGQYESHTAFTLPGLYRVVHGIDPFDPKFNIVSPGADMGIYFPYTETERRLTEFHSDIEELLYSSVENEEHICVLKDRNKPIIFTMARLDRVKNITGLVEWYGKNARLRELVNLVVVAGDRRKESKDLEEKAEMKKMYGLIETYKLNGQFRWISSQMNRVRNGELYRVICDTRGAFVQPAVYEAFGLTVVEAMTCGLPTFATCNGGPAEIIVHGKSGYHIDPYHGDHAAEILVEFFEKSKADPSHWDKISQGGLKRIHEKYTWQIYSDRLLTLTGVYGFWKHVTNLERRESKRYLEMFYALKYRKLAESVPLAIEE

SEQ ID NO: 10345 - protein, 806 aa, Glycine max
MANHPLTHSHSFRERFDETLTGHRNEILALLSRLEAKGKGILQHHQVVAEFEEIPEESRKKLQGGVFGEVLRSTQEAIVLPPFVALAVRPRPGVWEYLRVNVHMLVVDELLPAEYLRFKEELVEGSSNGNFVLELDFEPFNASFPRPTLNKSIGNGVEFLNRHLSAKLFHDKESMQPLLEFLRLHSYKGKTMMLNDKVQSLDSLQHVLRKAEEYLTSVAPETPYSEFENKFREIGLERGWGDIAERVLEMIQLLLDLLEAPDPCTLETFLGRVPMVFNVVILSPHGYFAQDNVLGYPDTGGQVVYILDQVRALENEMLNRIKKQGLDITPRILIITRLLPDAVGTTCGQRLERVYDTEYCDILRVPFRTEKGIVRKWISRFEVWPYLETYTEDVALELAKELQAKPDLIVGNYSDGNIVASLLAHKLGVTQCTIAHALEKTKYPESDIYWKKFEEKYHFSCQFTADLFAMNHTDFIITSTFQEIAGSKDTVGQYESHTAFTLPGLYRVVHGIDPFDPKFNIVSPGADMSIYFPYTETERRLTEFHPDIEELLYSSVENEEHICVLKDRNKPIIFTMARLDRVKNITGLVEWYGKNARLRELVNLVVVAGDRRKESKDLEEKAEMKKMYGLIETYKLNGQFRWISSQMNRVRNGELYRVICDTRGAFVQPAVYEAFGLTVVEAMTCGLPTFATCNGGPAEIIVHGKSGYHIDPYHGDRAAEILVEFFEKSKADPSHWDKISQGGLKRIHEKYTWQIYSDRLLTLTGVYGFWKHVTNLERRESKRYLEMFYALKYRKLAESVPLAIEE

SEQ ID NO: 10346 - protein, 806 aa, Cajanus cajan
MANHPLTHSRSFRERLDETLAGHRNEIIALLSRLEAKGKGILQHHQVIAEFEEIPEENRKKLLDGTFGEVLRSTQEAIVLPPFVALAVRPRPGVWEYLRVNVHMLVVDELRPAEYLRFKEELVEGSSNGNFVLELDFEPFNASFPRPTLNKSIGNGVEFLNRHLSAKLFHDKESMQPLLEFLRLHSYKGKTMMLNDKVQNLNALQHVLRKAEEYLTTVAPTTPSSEFENKFRDIGLERGWGDNAERVLEMIQLLLDLLEAPDPCTLETFLGRIPMVFNVVILSPHGYFAQDNVLGYPDTGGQVVYILDQVRALENEMLDRIKKQGLDITPRTLIITRLLPDAVGTTCGQRLERVYGTEHCDILRIPFRTEKGIVRKWISRFEVWPYLETYTEDVALELAKELQAKPDLIVGNYSDGNIVASLLAHKLGVTQCTIAHALEKTKYPESDIYWKKFEEKYHFSCQFTADLFAMNHTDFIITSTFQEIAGSKDSVGQYESHTAFTLPGLYRVVHGIDVFDPKFNIVSPGADMSIYFPYTETERRLTNFHPEIEELLYSSVENEEHICVLKDRNKPIIFTMARLDRVKNITGLVEWYGKNARLRELVNLVVVAGDRRKESKDLEEKAEMKKMYGLIETYKLNGQFRWISSQMNRVRNGELYRVICDTKGAFVQPAIYEAFGLTVVESMTCGLPTFATCNGGPAEIIVHGKSGYHIDPHHGDRAAELLVEFFEKSKADPSHWDKISQGGLKRIHEKYTWQIYSDRLLTLTGVYGFWKHVTNLERRESKRYLEMFYALKYRKLAESVPLAIEE

SEQ ID NO: 10347 - protein, 802 aa, Arachis hypogaea
MALTRSHSLKERLDETLAGQRNEILALLARIEAKGKGILQHHQVIAEFEEIPEEKRQKLYDGAFGEVLRSTQEAIVLPPFVALAVRPRPGVWEYLRVNVHALVVDELRPAEYLKFKEELVDGSSNGNFVLELDFEPFNASFPRPTLNKSIGNGVEFLNRHLSAKLFHGKESMQPLLEFLRLHSYNGKTMMLNDRIQNLNSLQHVLRKAEDYLVTLAPETPYSVFEHKFQEIGLERGWGDTAERVLEMIQLLLDLLEAPDPCTLETFLGRIPMVFNVVILSPHGYFAQDNVLGYPDTGGQVVYILDQVRALENEMLNRIKKQGLDITPRILILTRLLPDAVGTTCGQRLEKVFGTEHCHILRVPFRTEKGIVRKWISRFEVWPYLETYTEDAAHELAKELKGKPDLIVGNYSDGNIVASLLAHKLGVTQCTIAHALEKTKYPESDIYWKKFDDKYHFSCQFTADLFAMNHTDFIITSTFQEIAGSKDTVGQYESHTHFTLPGLYRVVHGIDVFDPKFNIVSPGADMSIYFPYTETERRLTSFHPEIEELLYSNVENEEHICVLKDRTKPIIFTMARLDRVKNITGLVEWYGKNARLRELVNLVVVAGDRRKESKDLEEKAEMKKMYGLIETYKLNGQFRWISSQMNRVRNGELYRVICDTKGAFVQPAIYEAFGLTVVEAMTCGLPTFATCNGGPAEIIVNGKSGYHIDPYHGDRAAEILVDFFEKSKADPSHWDKISQGGLKRIHEKYTWQIYSDRLLTLTGVYGFWKHVTNLDRRESKRYLEMFYALKYRMLAESVPLAVE

SEQ ID NO: 10348 - protein, 806 aa, Cicer arietinum
MGSDRLTRSHSIRQRFDEILTGHRNEILALLSRIEAKGKGILQHHQVIAEFEEIPEENRQKLVNGAFGEVLRSTQEAIVLPPFVALAVRPRPGVWEYLRVDVHGLVVDELSAAEYLKFKEELVEGSSNGNFVLELDFEPFNASFPRPTLNKSIGNGVEFLNRHLSAKLFHGKESLQPLLEFLRLHNYNGKTMMVNDRIQNLNSLQHVLIKAEEYLSTIAPETSYSEFEHKFQEIGLERGWGDTAERVLEMIQLLLDLLEAPDPCTLETFLGRIPMVFNVVILSPHGYFAQDNVLGYPDTGGQVVYILDQVRALENEMLKRIKQQGLDITPRILIITRLLPDAVGTTCGQRLEKVYDTEHCHILRVPFRTEKGIVRKWISRFEVWPYLETFTEDVANELAKELQGKPDLIVGNYSDGNIVASLLAHKLGVTQCTIAHALEKTKYPESDIYWKKFDDKYHFSCQFTADLFAMNHTDFIITSTFQEIAGSKDTVGQYESHTAFTLPGLYRVVHGIDVFDPKFNIVSPGADMSIYFPYTETERRLTSFHPEIEELLYSSVENEEHICVLKDRSKPIIFTMARLDRVKNITGLVEWYGKNARLRELVNLVVVAGDRRKESKDLEEKAEMKKMYGLIETYKLNGQFRWISSQMNRIRNGELYRVICDTKGAFVQPAIYEAFGLTVVEAMTCGLPTFATCNGGPAEIIVHGKSGYHIDPYHGDLAAETLVEFFEKSKADPSYWDKISHGGLKRIHEKYTWQIYSDRLLTLTGVYGFWKHVTNLDRRESKRYLEMFYALKYNKLAEAVPLAVEE

SEQ ID NO: 10349 - protein, 806 aa, Lotus japonicus
MANDYLTRSHSFRERLDETLAGQKNEILTLLSRIVAKGKGILQQNQIIAEFEEIPEESRQKLFNGAFGEILRSTQEAIVLPPFVALAVRPRPGVWEYLRVDVYSIVVDELRPAEYLKFKEELVDGSSNGNFVLELDFEPFNASFPRPTLNKSIGNGVEFLNRHLSAKLFHGKESLQPLLEFLRLHSYNGQTMMLNDRVQNLNSLQHVLRKAEEYLISVAPETPYSEFEHKFQEIGLERGWGDTAERVLEMIQLLLDLFEAPDPFTLEKFLGRIPMVFNVVILSPHGYFAQDNVLGYPDTGGQVVYILDQVRALENEMLSRIKKQGLDITPRILILTRLLPDAVGTTCGQRLEKVYNTEHCHILRVPFRTEKGIVRKWISRFEVWPYLERYTEDVATELSKELQGKPDLIVGNYSDGNIVASLLAHKLGVTQCTIAHALEKTKYPESDIYWKKFEEKYHFSAQFTADLFAMNHTDFIITSTFQEIAGSKDKVGQYESHTAFTLPGLYRVVHGIDVFDPKFNIVSPGADMDIYFPYTETERRLTHFHPDIEELLFSSVENEEHICVLKDRNKPIIFTMARLDRVKNITGLVEWYGKNARLRELVNLVVVAGDRRKESKDLEEIAEMKKMYGLIETYKLNGQFRWISSQMDRIRNGELYRVICDTKGAFVQPAIYEAFGLTVVEAMTCGLPTFATCNGGPAEIIVHGKSGYHIDPYHGDRAAETLVEFFEKSKADPSYWDKISQGGLQRIHEKYTWKIYSDRLLTLTGVYGFWKHVTNLDRRENKRYLEMFYALKYSKLAESVPLAVEE

SEQ ID NO: 10350 - protein, 804 aa, Medicago truncatula
MASLTRSTSLRERFDESLTAHRIEILALLSRIEAKGKGILQHHQVIAEFEEIPEEKRQKLVNGAFGEVLRSTQEAVVLPPFVALAVRPRPGVWEYLRVDVHSLVVDELRAAEYLKFKEELVEGSSNGNFVLELDFEPFNASFPRPTLNKSIGNGVEFLNRHLSAKLFHGKESLKPLLEFLRLHNYNGKTMMVNDRIQNLDSLQHVLRTAEDYLRIIAPETPYSEFEHKFQDSGLERGWGDTAERVLEMIQLLLDLLEAPDPFTLEKFLGRIPMVFNVVILSPHGYFAQDNVLGYPDTGGQVVYILDQVRALENEMLRRIKQQGLDIKPRILIITRLLPDAVGTTCGERLEKVYDTEHCHILRVPFRTEKGIVRKWISRFEVWPYLETFSEDVANELAKELEGKPDLIVGNYSDGNIVASLLAHKLGVTQCTIAHALEKTKYPESELYWKKFEDKYHFSCQFTADLFAMNHTDFIITSTFQEIAGSKDTVGQYESHTAFTLPGLYRVVHGIDVFDPKFNIVSPGADMSIYFPYTETERRLTSFHPEIEELLYSSVENEEHICVLKDRSKPIIFTMARLDRVKNITGLVEWYGKNARLRELVNLVVVAGDRRKESKDLEEKAEMKKMYGLIETYKLNGQFRWISSQMNRIRNGELYRVICDTKGAFVQPAIYEAFGLTVVEAMTCGLPTFATCNGGPAEIIVHGKSGYHIDPYHGDQAAETLVEFFEKSKADPSYWDKISHGGLKRIHEKYTWQIYSDRLLTLTGVYGFWKHVTNLDRRESKRYLEMFYALKYSKLAESVPLAVEE

SEQ ID NO: 10351 - protein, 806 aa, Cicer arietinum
MATDRLTRVHSLRERIDETLTANRNEILALLSRIEAKGKGILQHHQIIAEFEEIPEEPRQKLTDGAFGEVLRSTQEAIVLPPWVALAVRPRPGVWEYLRVNVHALVVEELQPAEFLKFKEELVDGSANGNFVLELDFEPFTASFPRPTLNKSIGNGVQFLNRHLSAKLFHDKESLHPLLEFLRLHSYKGKTLMLNDRIQNPDSLQHVLRKAEEYLATLAPETPYSEFEHRFQEIGLERGWGDTAERVLESIQLLLDLLEAPDPCTLETFLDRIPMVFNVVILSPHGYFAQDNVLGYPDTGGQVVYILDQVRALENEMLHRIKQQGLDIVPRILIITRLLPDAVGTTCGQRLEKVFGTEHCHILRVPFRNEKGIVRKWISRFEVWPYLETYTEDVAHELAKELQGKPDLIVGNYSDGNIVASLLAHKLGVTQCTIAHALEKTKYPESDIYWKKFEEKYHFSCQFTADLFAMNHTDFIITSTFQEIAGSKDTVGQYESHTAFTLPGLYRVVHGIDVFDPKFNIVSPGADETIYFPYTETSRRLTSFHPEIEELLYSTVENEEHICVLKDRNKPIIFTMARLDRVKNISGLVEWYGKNAKLRELVNLVVVAGDRRKESKDLEEKAEMKKMYALIDTYKLNGQFRWISSQMNRVRNGELYRVICDTKGAFVQPAVYEAFGLTVVEAMGCGLPTFATLNGGPAEIIVHGKSGFHIDPYHGERAADLLVEFFEKCKVDPSHWDKISQGGLKRIEEKYTWQIYSQRLLTLTGVYGFWKHVSNLDRLESRRYLEMFYALKYRKLAESVPLAVEE

SEQ ID NO: 10352 - protein, 805 aa, Cajanus cajan
MATDRLTRVHSLRERLDETLTANRNEILALLSRLEAKGKGILQHHQVIAEFEEIPEENRQKLTDGAFGEVLRSTQEAIVLPPWVALAVRPRPGVWEYLRVNVHALVVEELQPAEFLRFKEELVDGSSNGNFVLELDFEPFTASFPRPTLNKSIGNGVQFLNRHLSAKLFHDKESLHPLLEFLRLHSVKGKTLMLNDRIQNPDSLQHVLRKAEEYLGTIPPETPYSAFEHKFQEIGLERGWGDTAERVLESIQLLLDLLEAPDPCTLETFLGRIPMVFNVVILSPHGYFAQDNVLGYPDTGGQVVYILDQVRALENEMLHRIKQQGLDIVPRILIITRLLPDAVGTTCGQRLEKVFGTEHSHILRVPFRNEKGIVRKWISRFEVWPYLETYTEDVAHELAKELQGKPDLIVGNYSDGNIVASLLAHKLGVTQCTIAHALEKTKYPESDIYWKKLEERYHFSCQFTADLFAMNHTDFIITSTFQEIAGSKDTVGQYESHTAFTLPGLYRVVHGIDVFDPKFNIVSPGADQTIYFPYTETNRRLTSFHPEIEELLYSSVENEEHICVLKDRSKPIIFTMARLDRVKNITGLVEWYGKNAKLRELVNLVVVAGDRRKESKDLEEKAEMKKMYGLIETYKLNGQFRWISSQMNRVRNGELYRVICDTKGAFVQPAVYEAFGLTVVEAMTCGLPTFATCNGGPAEIIVHGKSGFHIDPYHGDRAAELLVEFFEKCKVDPSHWDKISLGGLQRIEEKYTWQIYSQRLLTLTGVYGFWKHVSNLDRRESRRYLEMFYALKYRKLAESVPLAVE

SEQ ID NO: 10353 - protein, 806 aa, Trigonella foenum-graecum
MATERLTHVHSLRERLDETLTANRNEILALLSRLEAKGKGILQHHQVIAEFEEIPEESRKKLTDGAFGEVLRSTQEAIVLPPWVALAVRPRPGVWEYLRVNVHALVVENLQPAEFLKFKEELVDGSANGNFVLELDFEPFTASFPRPTLNKSIGNGVQFLNRHLSAKLFHDKESLHPLLEFLRLHSYKGKTLMLNDRIQNPNSLQHVLRKAEEYLSTIAPDTPYSEFEHRFQEIGLERGWGDTAERVLESIQLLLDLLEAPDPCTLESFLDRIPMVFNVVILSPHGYFAQDDVLGYPDTGGQVVYILDQVRALESEMLNRIKKQGLDIVPRILIITRLLPDAVGTTCGQRLEKVYGTEHCHILRVPFRDQKGIVRKWISRFEVWPYLETYTEDVAHELAKELQGKPDLIVGNYSDGNIVASLLAHKLGVTQCTIAHALEKTKYPESDIYWKKFEEKYHFSCQFTADLFAMNHTDFIITSTFQEIAGSKDKVGQYESHTAFTLPGLYRVVHGIDVFDPKFNIVSPGADQTIYFPYTETSRRLTSFYPEIEELLYSSVENEEHICVLKDRNKPIIFTMARLDRVKNITGLVEWYGKNAKLRELVNLVVVAGDRRKESKDLEEIAEMKKMYGLIETYKLNGQFRWISSQMNRVRNGELYRVICDTKGAFVQPAVYEAFGLTVVEAMATGLPTFATLNGGPAEIIVHGKSGFHIDPYHGDRAADLLVEFFEKVKVDPSHWDKISQGGLQRIEEKYTWTIYSQRLLTLTGVYGFWKHVSNLDRLESRRYLEMFYALKYRKLAESVPLAVEE

SEQ ID NO: 10354 - protein, 806 aa, Arachis hypogaea
MASDRLTRVHSLRERLDETLTANRNEILALLSRIEAKGKGILQHHQVIAEFEEIPEENRQKLTDGAFGEVLRSTQEAIVLPPWVALAVRPRPGVWEYLRVNVHALVVEELQAAEYLRFKEELVDGSSNANFVLELDFEPFTASFPRPTLNKSIGNGVQFLNRHLSAKLFHDKESLHPLLEFLRLHSYKGKTLMLNDRIHNPDSLQHVLRKAEEYLGTLPAETPYSEFEHKFQEIGLERGWGDTAERVLESIQLLLDLLEAPDPCTLETFLDRIPMVFNVVILSPHGYFAQDNVLGYPDTGGQVVYILDQVRALENEMLHRIKQQGLDIVPRILIITRLLPDAVGTTCGQRLEKVFGTEHSHILRVPFRTEKGIVRKWISRFEVWPYLETYTEDVAHELAKELQGKPDLIVGNYSDGNIVASLLAHKLGVTQCTIAHALEKTKYPESDIYWKKFEEKYHFSCQFTADLFAMNHTDFIITSTFQEIAGSKDTVGQYESHTAFTLPGLYRVVHGIDVFDPKFNIVSPGADQTIYFPYTDGSRRLTAFHPEIEELLYSSVENEEHICVLKDRSKPIIFTMARLDRVKNITGLVEWYGKNARLRELVNLVVVAGDRRKESKDLEEKAEMKKMYGLIETYKLNGQFRWISSQMNRVRNGELYRVICDTKGAFVQPAVYEAFGLTVVEAMTCGLPTFATCNGGPAEIIVHGKSGFHIDPYHGDRAADLLVDFFDKCKVDPTHWDKISQGGLQRIEEKYTWQIYSQRLLTLTGVYGFWKHVSNLDRRESRRYLEMFYALKYRKLAESVPLAVEE

SEQ ID NO: 10355 - protein, 806 aa, Arachis hypogaea
MASDRLTRVHSLRERLDETLTANRNEILALLSRIEAKGKGILQHHQVIAEFEEIPEENRQKLTDGAFGEVLRSTQEAIVLPPWVALAVRPRPGVWEYLRVNVHALVVEELQAAEYLRFKEELVDGSSNANFVLELDFEPFTASFPRPTLNKSIGNGVQFLNRHLSAKLFHDKESLHPLLEFLRLHSYKGKTLMLNDRIHNPDSLQHVLRKAEEYLGTLPSETPYSEFEHKFQEIGLERGWGDTAERVLESIQLLLDLLEAPDPCTLETFLDRIPMVFNVVILSPHGYFAQDNVLGYPDTGGQVVYILDQVRALENEMLHRIKQQGLDIVPRILIITRLLPDAVGTTCGQRLEKVFGTEHSHILRVPFRTEKGIVRKWISRFEVWPYLETYTEDVAHELAKELQGKPDLIVGNYSDGNIVASLLAHKLGVTQCTIAHALEKTKYPESDIYWKKFEEKYHFSCQFTADLFAMNHTDFIITSTFQEIAGSKDTVGQYESHTAFTLPGLYRVVHGIDVFDPKFNIVSPGADQTIYFPYTDGSRRLTAFHPEIEELLYSSVENEEHICVLKDRSKPIIFTMARLDRVKNITGLVEWYGKNARLRELVNLVVVAGDRRKESKDLEEKAEMKKMYGLIETYKLNGQFRWISSQMNRVRNGELYRVICDTKGAFVQPAVYEAFGLTVVEAMTCGLPTFATCNGGPAEIIVHGKSGFHIDPYHGDRAADLLVDFFDKCKVDPTHWDNISQGGLQRIEEKYTWQIYSQRLLTLTGVYGFWKHVSNLDRRESRRYLEMFYALKYRKLAESVPLAVEE

SEQ ID NO: 10356 - protein, 805 aa, Vigna unguiculata
MATDRLTRVHSLRERLDETLSANRNEILALLSRIEGKGKGILQHHQVIAEFEEIPEESRQKLTDGAFGEVLRSTQEAIVLPPWVALAVRPRPGVWEYLRVNVHALVVEVLQPAEYLRFKEELVDGSSNGNFVLELDFEPFTASFPRPTLNKSIGNGVQFLNRHLSAKLFHDKESLHPLLEFLRLHSVKGKTLMLNDRIQNPDALQHVLRKAEEYLGTVPPETPYSAFEHKFQEIGLERGWGDNAERVLESIQLLLDLLEAPDPCTLETFLGRIPMVFNVVILSPHGYFAQDNVLGYPDTGGQVVYILDQVRALENEMLHRIKQQGLDIVPRILIITRLLPDAVGTTCGQRLEKVFGTEHSHILRVPFRTENGIVRKWISRFEVWPYLETYTEDVAHELAKELQGKPDLIVGNYSDGNIVASLLAHKLGVTQCTIAHALEKTKYPESDIYWKKLEERYHFSCQFTADLFAMNHTDFIITSTFQEIAGSKDTVGQYESHTAFTLPGLYRVVHGIDVFDPKFNIVSPGADQTIYFPHTETSRRLTSFHTEIEELLYSSVENEEHICVLKDRTKPIIFTMARLDRVKNITGLVEWYGKNAKLRELVNLVVVAGDRRKESKDLEEKAEMKKMYSLIETYKLNGQFRWISSQMNRVRNGELYRVIADTKGAFVQPAVYEAFGLTVVEAMTCGLPTFATCNGGPAEIIVHGKSGFHIDPYHGDRAADLLVEFFEKVKVDPSHWDKISQAGLQRIEEKYTWQIYSQRLLTLTGVYGFWKHVSNLDRRESRRYLEMFYALKYRKLAESVPLAVE

SEQ ID NO: 10357 - protein, 805 aa, Lotus japonicus
MANGLTRVHSLRERLDETLATNRNEILTLLSRIEAKGKGILQHHQIIAEFEEIPEENRQKLTDGAFGEVLRSTQEAIVLPPWVALAVRPRPGVWEYLRVNVHALVVEELQPAEFLHFKEELVDGSSNGNFVLELDFEPFNASFPRPTLNKSIGNGVEFLNRHLSAKLFHDKESLHPLLEFLRLHNYNGKTLMLNDRIQTPNALQHVLRKAEEYLGTLPLETPYSEFEHKFQEIGLERGWGDTAERVLESIQLLLDLLEAPDPCTLETFLGRIPMVFNVVILSPHGYFAQDNVLGYPDTGGQVVYILDQVRALESEMLQRIKQQGLDIVPRILIITRLLPDAVGTTCGQRLEKVYNTEHCHILRVPFRNEKGIVRKWISRFEVWPYLETYTEDVAHELAKELQGKPDLIVGNYSDGNIVASLLAHKLGVTQCTIAHALEKTKYPESDIYWKKFEEKYHFSCQFTADLFAMNHTDFIITSTFQEIAGSKDTVGQYESHTAFTLPGLYRVVHGIDVFDPKFNIVSPGADQTIYFPYTETSRRLTSFHPEIEELLYSSVENEEHICVLKDRSKPIIFTMARLDRVKNITGLVEWYGKNAKLRELVNLVVVAGDRRKESKDLEEKAEMKKMYSLIETYKLNGQFRWISSQMNRVRNGELYRVICDTKGAFVQPAVYEAFGLTVVEAMTCGLPTFATCNGGPAEIIVHGKSGFHIDPYHGDRAADLLVEFFEKVKVDPTHWDNISHGGLQRIEEKYTWQIYSQRLLTLTGVYGFWKHVSNLDRLESRRYLEMFYALKYRKLAESVPLAVEE

SEQ ID NO: 10358 - protein, 806 aa, Pisum sativum
MATDRLTRVHSLRERLDETLTANRNEILALLSRIEAKGKGILQHHQVIAEFEEIPEENRQKLTDGAFGEVLRSTQEAIVLPPWVALAVRPRPGVWEYLRVNVHALVVENLQPAEFLKFKEELVDGSANGNFVLELDFEPFTASFPRPTLNKSIGNGVQFLNRHLSAKLFHDKESLHPLLEFLRLHSYKGKTLMLNDRIQNPDSLQHVLRKAEEYLGTVAPDTPYSEFEHRFQEIGLERGWGDTAERVLESIQLLLDLLEAPDPCTLETFLDRIPMVFNVVILSPHGYFAQDDVLGYPDTGGQVVYILDQVRALESEMLNRIKKQGLDIVPRILIITRLLPDAVGTTCGQRLEKVYGTEHCHILRVPFRDQKGIVRKWISRFEVWPYLETYTEDVAHELAKELQGKPDLIVGNYSDGNIVASLLAHKLGVTQCTIAHALEKTKYPESDIYWKKFEEKYHFSCQFTADLFAMNHTDFIITSTFQEIAGSKDTVGQYESHTAFTLPGLYRVVHGIDVFDPKFNIVSPGADQTIYFPYTETSRRLTSFYPEIEELLYSTGENEEHICVLKDRNKPIIFTMARLDRVKNITGLVEWYGKNAKLRELVNLVVVAGDRRKESKDLEEKAEMKKMYEHIETYKLNGQFRWISSQMNRVRNGELYRVICDTKGAFVQPAVYEAFGLTVVEAMATGLPTFATLNGGPAEIIVHGKSGFHIDPYHGDRAADLLVEFFEKVKTDPSHWDKISQGGLQRIEEKYTWQIYSQRLLTLTGVYGFWKHVSNLDRLESRRYLEMFYALKYRKLAESVPLAVEE

SEQ ID NO: 10359 - protein, 805 aa, Glycine max
MATDRLTRVHSLRERLDETLTANRNEILALLSRIEAKGKGILQHHQVIAEFEEIPEENRQKLTDGAFGEVLRSTQEAIVLPPWVALAVRPRPGVWEYLRVNVHALVVEELQPAEYLHFKEELVDGSSNGNFVLELDFEPFNAAFPRPTLNKSIGNGVQFLNRHLSAKLFHDKESLHPLLEFLRLHSVKGKTLMLNDRIQNPDALQHVLRKAEEYLGTVPPETPYSEFEHKFQEIGLERGWGDNAERVLESIQLLLDLLEAPDPCTLETFLGRIPMVFNVVILSPHGYFAQDNVLGYPDTGGQVVYILDQVRALENEMLHRIKQQGLDIVPRILIITRLLPDAVGTTCGQRLEKVFGTEHSHILRVPFRTEKGIVRKWISRFEVWPYLETYTEDVAHELAKELQGKPDLIVGNYSDGNIVASLLAHKLGVTQCTIAHALEKTKYPESDIYWKKLEERYHFSCQFTADLFAMNHTDFIITSTFQEIAGSKDTVGQYESHTAFTLPGLYRVVHGIDVFDPKFNIVSPGADQTIYFPHTETSRRLTSFHPEIEELLYSSVENEEHICVLKDRSKPIIFTMARLDRVKNITGLVEWYGKNAKLRELVNLVVVAGDRRKESKDLEEKAEMKKMYGLIETYKLNGQFRWISSQMNRVRNGELYRVICDTRGAFVQPAVYEAFGLTVVEAMTCGLPTFATCNGGPAEIIVHGKSGFHIDPYHGDRAADLLVDFFEKCKLDPTHWDKISKAGLQRIEEKYTWQIYSQRLLTLTGVYGFWKHVSNLDRRESRRYLEMFYALKYRKLAESVPLAAE

SEQ ID NO: 10360 - protein, 183 aa, Cicer arietinum
MKKMYALIDTYKLNGQFRWISSQMNRVRNGELYRVICDTKGAFVQPAVYEAFGLTVVEAMGCGLPTFATLNGGPAEIIVHGNTGFHIDPYHGERAADLLVEFFEKCKVDPSHWDKISQGGLKRIEEKYTWQIYSQRLLTLTGVYGFWKHVSNLDRLESRRYLEMFYALKYRKLAESVPLAVEE

SEQ ID NO: 10361 - protein, 806 aa, Lupinus angustifolius
MATDRLTRVHSLRERIDETLSINRNEILSLLARVEGKGKGLLQHHQIIAEFEEIPKENRQKLSDGPFGEVLRSTQEAIVLSPWVALAVRPRPGVWEYLKVNVHALVVEELQAAEYLKFKEEIVDGSSNGNFVLELDFEPFNASFPRPTLNKSIGNGVQFLNRHLSAKLFHDKESLHPLLEFLRSHSYNGKTLMLNDRIQTPDSLQHVLREAEEYLGTLAPETPYSEFEYKFQEIGLERGWGDTAERVLEMIQLLLDLLESPDPCTLESFLGRIPMVFNVVILSPHGYFAQDNVLGYPDTGGQVVYILDQVRALENEMLKRIKQQGLDIVPRILIITRLLPEAVGTTCGQRLEKVYDTEHCHILRVPFRTEKGIVRKWISRFEVWPYLETFTEDVAHELAKELKGKPDLIVGNYSDGNIVASLLAHKLGVTQCTIAHALEKTKYPESDLYWKKFDEKYHFSSQFTADLFAMNHTDFIITSTFQEIAGNKDTVGQYESHTAFTLPGLYRVVHGINVFDPKFNIVSPGADQTIYFPYTETSRRLTSFHPEIEELLYSTVENEEHICVLKDRNKPIIFTMARLDRVKNITGLVEWYGKNARLRELVNLVVVAGDRRKESKDLEEKAEMKKMYGLIETYKLNGQFRWISSQMNRIRNGELYRVICDTKGAFVQPAVYEAFGLTVVEAMTCGLPTFATSNGGPAEIIVHGKSGYHIDPYHGDRAADLLVEFFEKSKADPSLWDKISQGGLQRIEEKYTWQIYSERLLTLTGVYGFWKHVSNLDRRESRRYLEMFYALKYRKLAESVPLAVEE

SEQ ID NO: 10362 - protein, 805 aa, Medicago truncatula
MATERLTRVHSLKERLDETLTANRNEILALLSRLEAKGKGILQHHQVIAEFEEIPEDSRQKLTDGAFGEVLRSTQEAIVLPPWVALAVRPRPGIWEYLRVNVHALVVENLQPAEFLKFKEELVDGSANGNFVLELDFEPFTASFPRPTLNKSIGNGVQFLNRHLSAKLFHDKESLHPLLEFLRLHSYKGKTLMLNDRIQNPDSLQHVLRKAEEYLSTIDPETPYSEFEHRFQEIGLERGWGDTAERVLESIQLLLDLLEAPDPCTLETFLDRIPMVFNVVILSPHGYFAQDDVLGYPDTGGQVVYILDQVRALESEMLSRIKKQGLDIIPRILIITRLLPDAVGTTCGQRLEKVYGTEHCHILRVPFRDTKGIVRKWISRFEVWPYLETYTEDVAHELAKELQGKPDLIVGNYSDGNIVASLLAHKLGVTQCTIAHALEKTKYPESDIYWKKFEEKYHFSCQFTADLFAMNHTDFIITSTFQEIAGSKDKVGQYESHTAFTLPGLYRVVHGIDVFDPKFNIVSPGADQTIYFPYTETSRRLTSFYPEIEELLYSSVENEEHICVLKDRNKPIIFTMARLDRVKNITGLVEWYGKNAKLRELVNLVVVAGDRRKESKDLEEIAEMKKMYGLIETYKLNGQFRWISSQMNRVRNGELYRVICDTKGAFVQPAVYEAFGLTVVEAMATGLPTFATLNGGPAEIIVHGKSGFHIDPYHGDRAADLLVEFFEKVKVDPSHWDKISQGGLQRIEEKYTWTIYSQRLLTLTGVYGFWKHVSNLDRLESRRYLEMFYALKYRKLAESVPLAVE

SEQ ID NO: 10363 - protein, 805 aa, Glycine max
MATDRLTRVHSLRERLDETLTANRNEILALLSRIEAKGKGILQHHQVIAEFEEIPEENRQKLTDGAFGEVLRSTQEAIVLPPWVALAVRPRPGVWEYLKVNVHALVVEELQPAEYLHFKEELVDGSSNGNFVLELDFEPFNAAFPRPTLNKSIGNGVQFLNRHLSAKLFHDKESLHPLLEFLRLHSVKGKTLMLNDRIQNPDALQHVLRKAEEYLGTVPPETPYSEFEHKFQEIGLERGWGDNAERVLESIQLLLDLLEAPDPCTLETFLGRIPMVFNVVILSPHGYFAQDNVLGYPDTGGQVVYILDQVRALENEMLHRIKQQGLDIVPRILIITRLLPDAIGTTCGQRLEKVFGTEHSHILRVPFRTEKGIVRQWISRFEVWPYLETYTEDVAHELAKELQGKPDLIVGNYSDGNIVASLLAHKLGVTQCTIAHALEKTKYPESDIYWKKLEERYHFSCQFTADLFAMNHTDFIITSTFQEIAGSKDTVGQYESHTAFTLPGLYRVVHGIDVFDPKFNIVSPGADQTIYFPPTETSRRLTSFHPEIEELLYSSVENEEHICVLKDRSKPIIFTMARLDRVKNITGLVEWYGKNAKLRELVNLVVVAGDRRKESKDLEEKAEMKKMYGLIETYKLNGQFRWISSQMNRVRNGELYRVICDTKGAFVQPAIYEAFGLTVVEAMTCGLPTFATCNGGPAEIIVHGKSGFHIDPYHGDRAADLLVDFFEKCKLDPTHWETISKAGLQRIEEKYTWQIYSQRLLTLTGVYGFWKHVSNLDRRESRRYLEMFYALKYRKLAESVPLAVE

SEQ ID NO: 10364 - protein, 804 aa, Pisum sativum
MASLTHSTSLRQRFDETLTAHRNEILSLLSRIEAKGKGILQHHQIIAEFEEIPEENRQKLVNGVFGEVLRSTQEAIVLVPFVALAVRPRPGVWEYLRVDVHGLVVDELSAAEYLKFKEELVEGSSNENFVLELDFEPFNASIPKPTQNKSIGNGVEFLNRHLSAKLFHGKESLQPLLEFLRLHNHNGKTIMVNDRIQNLNSLQHVLRKAEDYLIKIAPETPYSEFEHKFQEIGLERGWGDTAERVVETIQLLLDLLDAPDPGTLETFLGRIPMVFNVVILSPHGYFAQDNVLGYPDTGGQIVYILDQVRALEEEMLKRIKQQGLDITPRILIITRLLPDAVGTTCGQRLEKVYNTEHCHILRVPFRTEKGIVRKWISRFEVWPYLETFSEDVANELAKELQGKPDLIVGNYSDGNIVASLLAHKLGVTQCTIAHALEKTKYPESDIYWKKFDDKYHFSSQFTADLFAMNHTDFIITSTFQEIAGSKDTVGQYESHTAFTLPGLYRVVHGIDVFDPKFNIVSPGADLSIYFPYTETERRLTSFHPDIEELLYSTVENEEHICVLKDRSKPIIFTMARLDRVKNITGLVECYGKNARLRELVNLVVVAGDRRKESKDLEEIAEMKKMYGLIETYKLNGQFRWISAQMDRIRNGELYRVICDTKGAFVQPAIYEAFGLTVIEAMSCGLPTFATCNGGPAEIIVHGKSGYHIDPYHGDRAAETLVEFFEKSKADPTYWDKISHGGLKRIHEKYTWQIYSDRLLTLTGVYGFWKHVTNLERRESKRYLEMFYALKYSKLAESVPLAVEE

SEQ ID NO: 10365 - protein, 805 aa, Phaseolus vulgaris
MAADRLTRVHSLRERLDETLSANRNEILALLSRIEAKGTGILQHHQVIAEFEEIPEESRQKLIDGAFGEVLRSTQEAIVLPPWVALAVRPRPGVWEYLRVNVHALVVEVLQPAEYLRFKEELVDGSSNGNFVLELDFEPFTASFPRPTLNKSIGNGVQFLNRHLSAKLFHDKESLHPLLEFLRLHSVNGKTLMLNDRIQNPDALQHVLRKAEEYLGTVPPETPYSEFEHKFQEIGLERGWGANAELVLESIQLLLDLLEAPDPCTLETFLGRIPMVFNVVILSPHGYFAQDNVLGYPDTGGQVVYILDQVRALENEMLHRIKQQGLDIVPRILIITRLLPDAVGTTCGQRLEKVFGTEHSHILRVPFRTENGIVRKWISRFEVWPYLETYTEDVAHELAKELQGKPDLIVGNYSDGNIVASLLAHKLGVTQCTIAHALEKTKYPESDIYWKKLEERYHFSCQFTADLFAMNHTDFIITSTFQEIAGSKDTVGQYESHTAFTLPGLYRVVHGIDVFDPKFNIVSPGADQTIYFSHKETSRRLTSFHPEIEELLYSSVENEEHICVLKDRTKPIIFTMARLDRVKNITGLVEWYGKNEKLRELVNLVVVAGDRRKESKDLEEKAEMKKMYSLIETYKLNGQFRWISSQMNRVRNGELYRVISDTRGAFVQPAVYEAFGLTVVEAMTCGLPTFATCNGGPAEIIVHGKSGFHIDPYHGDRAADLLVEFFEKCKVEPSHWDTISQAGLQRIEEKYTWQIYSQRLLTLTGVYGFWKHVSNLDRLESRRYLEMFYALKYRKLAESVPLAVE

SEQ ID NO: 10366 - protein, 806 aa, Cannabis sativa
MPERALTRVHSLRERLDETLSAHRNEIVALLSRIEAKGKGFLQPHQIIAEFEAIPEVNRKKLLDGAFGEVLRATQEAICLPPWVALAVRPRPGVWEYIRVNVHALVIEELQVSEYLHFKEELVDGSANGNFVLELDFEPFNASFPRPTLSKSIGNGVEFLNRHLSAKLFHDKESMHPLLEFLRVHCYKGKNMMLNDRIHNLNGLQHVLRKAEEYLTSLAPETPYAEFEHKFQEIGLERGWGDTAERVLEMIQLLLDLLEAPDPCTLEKFLGRIPMVFNVVILSPHGYFAQDNVLGYPDTGGQVVYILDQVRALENEMLLRIKQQGLDIKPRILIITRLLPDAVGTTCGQRLEKVYDTEHTHILRVPFRDEKGMVRKWISRFEVWPYLETYTEDVAHELAKELQGKPDLIIGNYSDGNIVASLLAHKLGVTQCTIAHALEKTKYPDSDIYWKKLEEKYHFSCQFTADLIAMNHTDFIITSTFQEIAGSKDTVGQYESHTAFTLPGLYRVVHGIDVFDPKFNIVSPGADMSIYFPYTETEKRLTYFHPEIEELLYSDVENEEHICVLKDRNKPIIFTMARLDRVKNITGLVEWYGKNKKLRELVNLVVVAGDRRKESKDIEEKAEMAKMYGLIETYKLNGQFRWISSQMNRVRNGELYRYICDTKGAFVQPAVYEAFGLTVVEAMTCGLPTFATCKGGPAEIIVHGKSGYHIDPYHGDRAAETLVEFFEKCKVDPSHWDKISEGGLQRIYEKYTWKIYSERLLTLTGVYGFWKHVSNLDHQESRRYLEMFYALKYRKLAESVPLAVDE

SEQ ID NO: 10367 - protein, 632 aa, Momordica charantia
MQPLLDFLRVHCYKGKTMMLNDRIQTLNAFQHVLRKAEEYLVTLAPETPYSEFAHKFQETGLERGWGDTAERVLEMIQLLLDLLEAPDPCTLEKFLGRIPMVFNVVILSPHGYFAQDNVLGYPDTGGQVVYILDQVRALEHEMLQRIKHQGLDITPRILIISRLLPDAVGTTCTQRLEKVFGTEHAHILRVPFRNEKGIIRKWISRFEVWPYLETYTEDVAQELTKELQGKPDLIIGNYSDGNIVASLLAHKLGVTQCTIAHALEKTKYPDSDIYWKRFEDKYHFSCQFTADLIAMNHTDFIITSTFQEIAGSKDTVGQYESHTAFTLPGLYRVVHGIDVFDPKFNIVSPGADMSIYFPYTETEKRLTSFHPEIEELLYSQVENKEHLCVLKDRSKPIIFTMARLDRVKNITGLVEWYGKNKRLRELVNLVVVAGDRRKESKDNEEKAEMEKMYALIETYNLNGQFRWISSQMNRVRNGELYRCIADTKGAFVQPAVYEAFGLTVVEAMTCGLPTFATCNGGPAEIIVDGKSGYHIDPYHGDRAAEILVEFFEKSKKDPAHWDKISKGGLQRIYEKYTWQIYSERLLTLTGVYGFWKHVSNLDRLESRRYLEMFYALKYRKLAESVPLAVDE

SEQ ID NO: 10368 - protein, 806 aa, Citrus clementina
MAERALTRVHSLRERLDETLSAHRNEILALLSRIEGKGKGILQNHQLIAEFESISEENRKHLTEGAFGEVLRATQEAIVLPPWVALAVRPRPGVWEYIRVNVHALVVEELLVAEYLHFKEELVDGGSNGNFVLELDFEPFNASFPRPTLSKSIGNGVEFLNRHLSAKLFHDKESMHPLLEFLRVHCHKGKNMMLNDRIQNLNSLQHVLRKAEEYLTTVAPETPFSELALRFQEIGLERGWGDTAERALEMIQLLLDLLEAPDPCTLETFLGRIPMVFNVVILTPHGYFAQDDVLGYPDTGGQVVYILDQVRALEDEMLLRIKQQGLDITPQILIITRLLPDAVGTTCGQRLEKVYGTKYSDILRVPFRTEKGVVRKWISRFEVWPYLETYTEDVAVEIAKELQGKPDLIIGNYSDGNIVASLLAHKLGVTQCTIAHALEKTKYPDSDIYWKNLDDKYHFSCQFTADLIAMNHTDFIITSTFQEIAGSKDTVGQYESHTAFTLPGLYRVVHGIDVFDPKFNIVSPGADMSIYFPYTEEKRRLKSFHPEIEELLYSDVENKEHLCVLKDRNKPILFTMARLDRVKNLTGLVEWYGKNAKLRELVNLVVVGGDRRKESKDLEEQAEMKKMYSLIDQYKLNGQFRWISSQMNRVRNGELYRYICDTKGAFVQPALYEAFGLTVVEAMTCGLPTFATCKGGPAEIIVNGKSGYHIDPYHGEQAAEILVDFFEKCKADPSYWDKISLGGLKRIEEKYTWKIYSQRLLTLTGVYGFWKHVSNLDRLESRRYLEMFYALKYRKLAESVPLAVEE

SEQ ID NO: 10369 - protein, 806 aa, Theobroma cacao
MAERVITRVHSLRERLDETLTAHRNEILALLARIEGKGKGILQHHQIILEFEAIPEENRKKLADGAFFEILRASQEAIVFPPWVALAVRPRPGVWEYIRVNVHALVVEELTVAEYLHFKEELVDGSSNGNFVLELDFEPFNASFPRPTLSKSIGNGVEFLNRHLSAKLFHDKESMHPLLEFLRVHCHKGKNMMLNDRIQNLNSLQHVLRKAEEYLSTLPAGTPYAEFEHKFQEIGLERGWGDTAERVLEMIQLLLDLLEAPDPCTLEKFLGRIPMVFNVVILTPHGYFAQDNVLGYPDTGGQVVYILDQVRALENEMLHRIKQQGLNITPRILIITRLLPDAVGTTCGQRLEKVYGTEYSDILRIPFRTEQGIVRRWISRFEVWPYLETYTEDVAHEISKELQGKPDLIIGNYSDGNIVASLLAHKLGVTQCTIAHALEKTKYPDSDIYWKKLEDKYHFSCQFTADLFAMNHTDFIITSTFQEIAGSKDTVGQYESHTAFTLPGLYRVVHGIDVFDPKFNIVSPGADMSIYFSYTEEKRRLKHFKPEIEDLLYSKVENEEHLCVLNDRTKPILFTMARLDRVKNLTGLVEWYGKNAKLRELVNLVVVGGDRRKESKDLEEKAEMKKMFEMIEKYKLNGQFRWISSQMNRVRNGELYRYICDTKGAFVQPALYEAFGLTVVEAMTCGLPTFATCNGGPAEIIVHGKSGFNIDPYHGDQAAEILVDFFEKCKADPSYWNKISEGGLKRIQEKYTWQIYSERLLTLTGVYGFWKHVSNLDRRESRRYLEMFYALKYRKLAESVPLAVEE

SEQ ID NO: 10370 - protein, 805 aa, Gossypium raimondii
MADRVITRVHSLRERLDETLLAHRNEILALLSRIEGKGKGILQHHQIILEFEAIPEENRKKLANGAFFEVLKASQEAIVLPPWVALAVRPRPGVWEYIRVNVHALVVEELTVAEYLHFKEELVDGSSNGNFVLELDFEPFNSSFPRPTLSKSIGNGVEFLNRHLSAKLFHDKESMHPLLEFLRVHCHKGKNMMLNDRIQNLNALQHVLRKAEEYLGTLPPETPCAEFEHRFQEIGLERGWGDTAERVLEMIQLLLDLLEAPDPCTLEKFLGRIPMVFNVVILTPHGYFAQDNVLGYPDTGGQVVYILDQVRALENEMLLRIKQQGLNITPRILIITRLLPDAVGTTCGQRLEKVYGTEHSDILRVPFRTEKGIVRKWISRFEVWPYLETYTEDVAHEISKELQGKPDLIIGNYSDGNIVASLLAHKLGVTQCTIAHALEKTKYPDSDIYWKKLEDKYHFSCQFTADLFAMNHTDFIITSTFQEIAGSKDTVGQYESHTAFTLPGLYRVVHGIDVFDPKFNIVSPGADMEIYFPYTEEKRRLKHFHTEIEDLLYSKVENEEHLCVLNDRNKPILFTMARLDRVKNLTGLVEWYGKNAKLRELANLVVVGGDRRKESKDLEEKAEMKKMFELIEKYNLNGQFRWISSQMNRIRNGELYRYICDTKGAFVQPALYEAFGLTVVEAMTCGLPTFATCNGGPAEIIVHGKSGFNIDPYHGDQAADILVDFFEKCKKDPSHWDKISQGGLKRIEEKYTWKIYSERLLTLTGVYGFWKHVSNLERRESRRYLEMFYALKYRKLAESVPLAEE

SEQ ID NO: 10371 - protein, 805 aa, Gossypium hirsutum
MANPVITRVHSLRERLDETLLAHRNEILALLSRIEGKGKGILQHHQIILEFEAIPEENRKKLADGAFFEVLKASQEAIVLPPWVALAVRPRPGVWEYIRVNVHALVVEELTVAEYLHFKEELVDGSSNGNFVLELDFEPFNSSFPRPTLSKSIGNGVEFLNRHLSAKLFHDKESMHPLLEFLRVHCHKGKNMMLNDRIQNLNALQHVLRKAEEYLGTLPPETPCAEFEHRFQEIGLERGWGDTAQRVLEMIQLLLDLLEAPDPCTLEKFLGRIPMVFNVVILTPHGYFAQDNVLGYPDTGGQVVYILDQVRALENEMLLRIKQQGLNITPRILIITRLLPDAVGTTCGQRLEKVYGTEHSDILRVPFRTEKGIVRKWISRFEVWPYLETYTEDVAHEISKELQGKPDLIIGNYSDGNIVASLLAHKLGVTQCTIAHALEKTKYPDSDIYWKKLEDKYHFSCQFTADLFAMNHTDFIITSTFQEIAGSKDTVGQYESHTAFTLPGLYRVVHGIDVFDPKFNIVSPGADMEIYFPYTEEKRRLKHFHTEIEDLLYSKVENEEHLCVLNDRNKPILFTMARLDRVKNLTGLVEWYGKNAKLRELANLVVVGGDRRKESKDLEEKAEMKKMFELIDKYNLNGQFRWISSQMNRIRNGELYRYICDTKGAFVQPALYEAFGLTVVEAMTCGLPTFATCNGGPAEIIVHGKSGFNIDPYHGDQAADILVDFFEKCKKDPSHWDKISQGGLKRIEEKYTWKIYSERLLTLTGVYGFWKHVSNLERRESRRYLEMFYALKYRKLAESVPLAEE

SEQ ID NO: 10372 - protein, 805 aa, Gossypium raimondii
MADRVITRVHSLRERLDETLLAHRNEILALLSRIEGKGKGILQHHQIILEFEAIPEENRKKLANGAFFEVLKASQEAIVLPPWVALAVRPRPGVWEYIRVNVHALVVEELTVAEYLHFKEELVDGSSNGNFVLELDFEPFNSSFPRPTLSKSIGNGVEFLNRHLSAKLFHDKESMHPLLEFLRVHCHKGKNMMLNDRIQNLNALQHVLRKAEEYLGTLPPETPCAGFEHRFQEIGLERGWGDTAQRVLEMIQLLLDLLEAPDPCTLEKFLGRIPMVFNVVILTPHGYFAQDNVLGYPDTGGQVVYILDQVRALENEMLLRIKQQGLNITPRILIITRLLPDAVGTTCGQRLEKVYGTEYSDILRVPFRTEKGIVRKWISRFEVWPYLETYTEDVAHEISKELQGKPDLIIGNYSDGNIVASLLAHKLGVTQCTIAHALEKTKYPDSDIYWKKLEDKYHFSCQFTADLFAMNHTDFIITSTFQEIAGSKDTVGQYESHTAFTLPGLYRVVHGIDVFDPKFNIVSPGADMEIYFPYTEEKRRLKHFHTEIEDLLYSKVENEEHLCVLNDRNKPILFTMARLDRVKNLTGLVEWYGKNAKLRELANLVVVGGDRRKESKDLEEKAEMKKMFELIEKYNLNGQFRWISSQMNRIRNGELYRYICDTKGAFVQPALYEAFGLTVVEAMTCGLPTFATCNGGPAEIIVHGKSGFNIDPYHGDQAADILVDFFEKCKKDPSHWDKISQGGLKRIEEKYTWKIYSERLLTLTGVYGFWKHVSNLERRESRRYLEMFYALKYRKLAESVPLAEE

SEQ ID NO: 10373 - protein, 806 aa, Cucumis melo
MAERVLNRVHSLRERLDETLIAQRNEILGLLSKIEAKGKGILQHHELIAEFETIPEENRKKLADGAFGEVLRSTQESIVLPPWVALAVRPRPGVWEYIKVNVHALVVEELQVSEYLRFKEELVDGSSNGNFVLELDFEPFNASFPRPTLSKSIGNGVEFLNRHLSAKLFHGKESMQPLLDFLRVHCYKGKTMMLNDRIQTLNAFQHVLRKAEEYLVTLAPDTPYSDFANKFQEIGLERGWGDTAERVLEMIQLLLDLLEAPDPCTFEKFLGRIPMVFNVVILSPHGYFAQDNVLGYPDTGGQVVYILDQVRALEHEMLQRIKQQGLDITPRILIITRLLPDAVGTTCTQRLEKVFGTEHSHILRVPFRNEKGIVRKWISRFEVWPYLETYTEDVAQELTKELQGKPDLIIGNYSDGNIVASLLAHKLGVTQCTIAHALEKTKYPDSDIYWKRFDEKYHFSSQFTADLIAMNHTDFIITSTFQEIAGSKDTVGQYESHTAFTLPGLYRVVHGIDVFDPKFNIVSPGADMSIYFPYTETEKRLTSFHPEIEELLYSEVENEEHLCVLKDRSKPIIFTMARLDRVKNITGLVEWYGKNNRLRELVNLVVVAGDRRKESKDNEEKAEMEKMYNLIKTYNLNGQFRWISAQMNRVRNGELYRCIADTKGAFVQPAVYEAFGLTVVEAMTCGLPTFATCNGGPAEIIVDGKSGFHIDPYRGDRAAEILVDFFEKSKEDPTHWDKISQAGLKRIYEKYTWQIYSERLLTLTGVYGFWKHVSNLDRLESRRYLEMFYALKYRKLADSVPPAVDE

SEQ ID NO: 10374 - protein, 805 aa, Citrus sinensis
MAERALTRVHSLRERLDETLSAHRNEILALLSRIEGKGKGILQNHQLIAEFESISEENRKHLTEGAFGEVLRATQEAIVLPPWVALAVRPRPGVWEYIRVNVHALVVEELLVAEYLHFKEELVDGGSNGNFVLELDFEPFNASFPRPTLSKSIGNGVEFLNRHLSAKLFHDKESMHPLLEFLRVHCHKGKNMMLNDRIQNLNSLQHVLRKAEEYLTTVVPETPFSELALRFQEIGLERGWGDTAERALEMIQLLLDLLEAPDPCTLETFLGRIPMVFNVVILTPHGYFAQDDVLGYPDTGGQVVYILDQVRALEDEMLLRIKQQGLDITPQILIITRLLPDAVGTTCGQRLEKVYGTKYSDILRVPFRTEKGVVRKWISRFEVWPYLETYTEDVAVEIAKELQGKPDLIIGNYSDGNIVASLLAHKLGVTQCTIAHALEKTKYPDSDIYWKNLDDKYHFSCQFTADLIAMNHTDFIITSTFQEIAGSKDTVGQYESHTAFTLPGLYRVVHGIDVFDPKFNIVSPGADMSIYFPYTEEKRRLKSFHPEIEELLYSDVENKEHLCVLKDRNKPILFTMARLDRVKNLTGLVEWYGKNAKLRELVNLVVVGGDRRKESKDLEEQAEMKKMYSLIDQYKLNGQFRWISSQMNRVRNGELYRYICDTKGAFVQPALYEAFGLTVVEAMTCGLPTFATCKGGPAEIIVNGKSGYHIDPYHGEQAAEILVDFFEKCKADPSYWDKISLGGLKRIEEKYTWKIYSQRLLTLTGVYGFWKHVSNLDRLESRRYLEMFYALKYRKLAESVPLAVE

SEQ ID NO: 10375 - protein, 806 aa, Castanea mollissima
MAGSALTRVHSLRERLDETLSANRNEIVALLSRIEGKGKGILQHHQLIAEVEAIPEANRKTLLDGPFGEVLRAAQEAIVLPPWVALAVRPRPGVWEYIRVNVHALVVEELRVPEYLHFKEELVDGSVNGNFVLELDFEPFTASFPHPTLSKSIGNGVEFLNRHLSAKLFHDKESMHPLLEFLRVHCYKGKTMMLNDRIHNVDSLQYVLRKAEEYLTTLAPETPYSTFEHKFQEIGLERGWGDTAERVLEMIQLLLDLLEAPDPCTLETFLGKIPMVFNVVIMSPHGYFAQDNVLGYPDTGGQVVYILDQVRALESEMLKRIKHQGLDITPRILIVTRLLPDAAGTTCGQRLEKVFGCEHAHILRVPFRDEKGMVRKWISRFEVWPYLENYTEDVAQELNKELQGKPDLIIGNYSDGNIVASLLAHKFGVTQCTIAHALEKTKYPESDIYWKKFEEKYHFSCQFTADLIAMNHTDFIITSTFQEIAGSKDTVGQYESHTSFTLPGLYRVVHGINVFDPKFNIVSPGADMDIYFPYTEEKKRLTAFHPEIEELLYSSVENEEHLCVLKDKNKPIIFTMARLDRVKNITGLVEWYGKNKRLRELVNLVVVAGDRRKESKDLEEQAEMKKMHTLIETYKLNGQFRWISSQMNRVRNGELYRVIADTKGAFVQPAVYEAFGLTVVEAMTCGLPTFATCNGGPAEIIVHGKSGFHIDPYHGEQAAELLVGFFEKCTKDPSHWDQISQGGLKRIYEKYTWQIYSERLLTLTGVYGFWKHVSNLDRRESRRYLEMFYALKYRKLAESVPLAVEK

SEQ ID NO: 10376 - protein, 806 aa, Gossypium raimondii
MAERALTRVHSLRERLDSTLTAHRNEILALLSRIEGKGKGILLHHQIILEFEAIPEENRKKLADGAFFEILKASQEAIVLPPWVALAVRPRPGVWEYIRVNVHALVVEELTVAEYLRFKEELVDGSSNANFVLELDFEPFNASFPRPTLSKSIGNGVEFLNRHLSAKLFHDKESMHPLLEFLKVHCHKGKNMMLNDRIQNLNSLQHVLRKAEEYLVALPAETSYADFEHKFQEIGLERGWGDTAERVLEMIQLLLDLLEAPDPCTLEKFLGRIPMVFNVVILTPHGYFAQDNVLGYPDTGGQVVYILDQVRALENEMLNRIKQQGLNITPRILIITRLLPDAVGTTCGQRLEKVYGTEYSDILRIPFRTEKGIVRRWISRFEVWPYLETYTEDVAHEISKELQGKPDLIIGNYSDGNIVASLLAHKLGVTQCTIAHALEKTKYPDSDIYWKKLEDKYHFSCQFTADLFAMNHTDFIITSTFQEIAGSKDTVGQYESHTAFTLPGLYRVVHGIDVFDPKFNIVSPGADMSIYYPYTEEKKRLKHFHSEIEELLYSKVENEEHWCVLNDRNKPILFTMARLDRVKNLTGLVEWYGKNAKLRELVNLVVVGGDRRKESKDLEEKAEMKKMFELIEKYKLNGQFRWISSQMNRVRNGELYRYICDTKGAFVQPALYEAFGLTVVEAMTCGLPTFATCNGGPAEIIVHGKSGFNIDPYHGDQAAEILVDFFEKCKTDPSYWTKISEGGLKRIEEKYTWKIYSERLLTLTGVYGFWKHVSNLDRLESRRYLEMFYALKYRKLAESVPLAVEE

SEQ ID NO: 10377 - protein, 806 aa, Gossypium raimondii
MAERALTRVHSLRERLDSTLTAHRNEILALLSRIEGKGKGILLHHQIILEFEAIPEENRKKLADGAFFEILKASQEAIVLPPWVALAVRPRPGVWEYIRVNVHALVVEELTVAEYLRFKEELVDGSSNANFVLELDFEPFNASFPRPTLSKSIGNGVEFLNRHLSAKLFHDKESMHPLLEFLKVHCHKGKNMMLNDRIQNLNSLQHVLRKAEEYLVALPAETPYAEFEHKFQEIGLERGWGDTAERVLEMIQLLLDLLEAPDPCTLEKFLGRIPMVFNVVILTPHGYFAQDNVLGYPDTGGQVVYILDQVRALENEMLNRIKQQGLNITPRILIITRLLPDAVGTTCGQRLEKVYGTEYSDILRIPFRTEKGIVRRWISRFEVWPYLETYTEDVAHEISKELQGKPDLIIGNYSDGNIVASLLAHKLGVTQCTIAHALEKTKYPDSDIYWKKLEDKYHFSCQFTADLFAMNHTDFIITSTFQEIAGSKDTVGQYESHTAFTLPGLYRVVHGIDVFDPKFNIVSPGADMSIYYPYTEEKKRLKHFHSEIEQLLYSKVENEEHWCVLNDRNKPILFTMARLDRVKNLSGLVEWYGKNAKLRELVNLVVVGGDRRKESKDLEEKAEMKKMFELIEKYKLNGQFRWISSQMNRVRNGELYRYICDTKGAFVQPALYEAFGLTVVEAMTCGLPTFATCNGGPAEIIVHGKSGFNIDPYHGDQAAEILVDFFEKCKTDPSYWTKISEGGLKRIEEKYTWKIYSERLLTLTGVYGFWKHVSNLDRLESRRYLEMFYALKYRKLAESVPLAVEE

SEQ ID NO: 10378 - protein, 806 aa, Manihot esculenta
MAERVITRVHSIRERLDETLSAHRNEIVALLSRIEGKGKGILQHHQIIAEFEAIPEENRKKLLDGAFGEVLRSAQEAIVLPPWVALAVRPRPGVWEYIRVNVHALVVEELRVAEYLHFKEELVDGSVNGNFVLELDFEPFNASFPRPTLSKYIGNGVEFLNRHLSAKLFHDKESLHPLLEFLKVHCHKGKNMMLNDRIHNLNSLQYVLRKAEEYLTALSPDTPYSQFEHRFQEIGLERGWGDTAERVLEMIRLLLDLLEAPDPCTLETFLGRIPMVFNVVIMSPHGYFAQDNVLGYPDTGGQVVYILDQVRALETEMLQRIKQQGLDITPRILIITRLLPDAVGTTCGQRLEKVFGTEHSDILRVPFRNEKGIVRKWISRFEVWPYLETYTEDVATEIGKELQGKPDLIIGNYSDGNIVASLLAHKLGVTECTIAHALEKTKYPDSDIYWKKFDEKYHFSCQFTADLIAMNHTDFIITSTFQEIAGSKDTVGQYESHTAFTLPGLYRVVHGIDVFDPKFNIVSPGADESIYFAYTEEKRRLTSFHPEIEELLYSPVENEEHLCVLKDRNKPIIFTMARLDRVKNLSGLVEWYGKNAKLRELANLVVVGGDRRKESKDLEEQAEMKKMHSLIEKYNLNGQFRWISSQMNRVRNGELYRCICDTKGVFVQPALYEAFGLTVVEAMTCGLPTFATCNGGPAEIIVHGKSGFNIDPYHGDQAAELLVEFFEKCKADPPHWDKISQGAMQRIQEKYTWQIYSQRLLTLTGVYGFWKHVSKLDRRESRRYLEMFYALKYRKLAESVPLTVED

SEQ ID NO: 10379 - protein, 771 aa, Vigna unguiculata
EGKGKGILQHHQVIAEFEEIPEESRQKLTDGAFGEVLRSTQEAIVLPPWVALAVRPRPGVWEYLRVNVHALVVEVLQPAEYLRFKEELVDGSSNGNFVLELDFEPFTASFPRPTLNKSIGNGVQFLNRHLSAKLFHDKESLHPLLEFLRLHSVKGKTLMLNDRIQNPDALQHVLRKAEEYLGTVPPETPYSAFEHKFQEIGLERGWGDNAERVLESIQLLLDLLEAPDPCTLETFLGRIPMVFNVVILSPHGYFAQDNVLGYPDTGGQVVYILDQVRALENEMLHRIKQQGLDIVPRILIITRLLPDAVGTTCGQRLEKVFGTEHSHILRVPFRTEKGIVRQWISRFEVWPYLETYTEDVAHELAKELQGKPDLIVGNYSDGNIVASLLAHKLGVTQCTIAHALEKTKYPESDIYWKKLEERYHFSCQFTADLFAMNHTDFIITSTFQEIAGSKDTVGQYESHTAFTLPGLYRVVHGIDVFDPKFNIVSPGADQTIYFPPTETSRRLTSFHPEIEELLYSSVENEEHICVLKDRTKPIIFTMARLDRVKNITGLVEWYGKNAKLRELVNLVVVAGDRRKESKDLEEKAEMKKMYGLIETYKLNGQFRWISSQMNRVRNGELYRVICDTRGAFVQPAVYEAFGLTVVEAMTCGLPTFATCNGGPAEIIVHGKSGFHIDPYHGDRAADLLVDFFEKCKVDPSHWDKISQAGLQRIEEKYTWQIYSQRLLTLTGVYGFWKHVSNLDRRESRRYLEMFYALKYRKLAESVPLAVE

SEQ ID NO: 10380 - protein, 806 aa, Citrullus lanatus
MAERVLNRVHSLRERLDETLIAQRNEILGLLSKIEAKGKGILQHHQLIAEFEAIPEENRKKLADGAFGEVLRATQESIVLPPWVALAVRPRPGVWEYIKVNVHALVVEELQVAEYLHLKEELVDGSSNGNFVLELDFEPFNASFPRPTLSKSIGNGVEFLNRHLSAKLFHGKESMQPLLDFLRVHCYKGKTMMLNDRIQTLNAFQHVLRKAEEYLATLAPETPYSEFANKFQEIGLERGWGNTAERVLEMIQLLLDLLEAPDPCTFEKFLGRIPMVFNVVILSPHGYFAQDNVLGYPDTGGQVVYILDQVRALEHEMLQRIKQQGLDITPRILIITRLLPDAVGTTCTQRLEKVFGTEHSHILRVPFRNEKGIVRKWISRFEVWPYLETYTEDVAQELTKELQGKPDLIIGNYSDGNIVASLLAHKLGVTQCTIAHALEKTKYPDSDIYWKRFDDKYHFSSQFTADLIAMNHTDFIITSTFQEIAGSKDTVGQYESHTAFTLPGLYRVVHGIDVFDPKFNIVSPGADMSIYFPYTETEKRLTSFHPEIEELLYSEVENEEHLCVLKDRSKPIIFTMARLDRVKNITGLVEWYGKNKRLRELVNLVVVAGDRRKESKDNEEKAEMEKMYSLIKTYNLNGQFRWISAQMNRVRNGELYRCIADTKGAFVQPAVYEAFGLTVVEAMTCGLPTFATCNGGPAEIIIDGKSGFHIDPYRGDRAAEILVDFFEKSKEDPSHWDKISQAGLQRIYEKYTWQIYSERLLTLTGVYGFWKHVSNLDRLESRRYLEMFYALKYRKLADSVPQAVDE

SEQ ID NO: 10381 - protein, 806 aa, Cucumis sativus
MAERVLNRIHSLRERLDETLIAQRNEILGLLSKIEAKGKGILQHHELIAEFETIPEENRRKLADGAFGEVLRSTQESIVLPPWVALAVRPRPGVWEYIKVNVHALVVEELQASEYLRFKEELVDGSSNGNFVLELDFEPFNASFPRPTLSKSIGNGVEFLNRHLSAKLFHGKESMQPLLDFLRVHCYKGKTMMLNDRIQTLDAFQHVLRKAEEYLVTLAPETPYSEFANKFQEIGLERGWGDTAERVLEMIQLLLDLLEAPDPCTFEKFLGRIPMVFNVVILSPHGYFAQDNVLGYPDTGGQVVYILDQVRALEHEMLQRIKQQGLDITPRILIITRLLPDAVGTTCTQRLEKVFGTEHSHILRVPFRNEKGIVRKWISRFEVWPYLETYTEDVAQELTKELQGKPDLIIGNYSDGNIVASLLAHKLGVTQCTIAHALEKTKYPDSDIYWKTFDDKYHFSSQFTADLIAMNHTDFIITSTFQEIAGSKDTVGQYESHTAFTLPGLYRVVHGINVFDPKFNIVSPGADMSIYFPYTETEKRLTAFHPEIEELLYSEVENEEHLCVLKDRSKPIIFTMARLDRVKNITGLVEWYGKNDRLRELVNLVVVAGDRRKESKDNEEKAEMEKMYNLIKTYNLNGQFRWISAQMNRVRNGELYRYIADTKGAFVQPAVYEAFGLTVVEAMTCGLPTFATCNGGPAEIIVDGKSGFHIDPYRGDRAAEILVDFFEKSKEDPTHWDEISQAGLKRIYEKYTWQIYSERLLTLTGVYGFWKHVSNLDRLESRRYLEMFYALKYRKLADSVPPAVDE

SEQ ID NO: 10382 - protein, 806 aa, Quercus alba
MAGSALTRVHSLRERLDETLSANRNEIVALLSRIEGKGKGILQHHQLIAEVEAIPEANRKTLLDGPFGEVLRAAQEAIVLPPWVAMAVRPRPGVWEYIRVNVHALVVEELRVPEYLHFKEELVDGSTNGNFVLELDFEPFTASFPHPTLSKSIGNGVEFLNRHLSAKLFHDKESMHPLLEFLRVHCYKGKTMMLNDRIHNVDSLQYVLRKAEEYLTTLAPETPYSTFEHKFQEIGLERGWGDTAERVLEMIQLLLDLLEAPDPCTLETFLGKIPMVFNVVIMSPHGYFAQDNVLGYPDTGGQVVYILDQVRALESEMLKRIKHQGLDITPRILIVTRLLPDAVGTTCGQRLEKVFGCEHANILRVPFRDEKGMVRKWISRFEVWPYLENYTEDVAQELNKELQGKPDLIIGNYSDGNIVASLLAHKFGVTQCTIAHALEKTKYPESDIYWKKFEEKYHFSCQFTADLIAMNHTDFIITSTFQEIAGSKDTVGQYESHTSFTLPGLYRVVHGINVFDPKFNIVSPGADMDIYFPYTEEKKRLTAFHPEIEELLYSSVENEEHLCVLKDKNKPIIFTMARLDRVKNITGLVEWYGKNKRLRELVNLVVVAGDRRKESKDLEEQAEMKKMHALIETYKLNGQFRWISSQMNRVRNGELYRYIADTKGAFVQPAVYEAFGLTVVEAMTCGLPTFATCNGGPAEIIVHGKSGFHIDPYHGEQAAELLVGFFEKCQKDPSHWDQISQGGLKRIYEKYTWQIYSERLLTLTGVYGFWKHVSNLDRRESRRYLEMFYALKYRKLAESVPPAVDN

SEQ ID NO: 10383 - protein, 806 aa, Gossypium raimondii
MAERVITRVHSLRERLDDTLIAHRNEVLALLTRIEGKGKGILQHHQIILEFEAIPEETRKKLADGAFSEILRASQEAIVLPPWVALAVRPRPGVWEYIKVNVHALVVEELTVAEYLHFKEELVDGSANGNFVLELDFEPFNASFPRSTLSKSIGNGVEFLNRHLSAKLFHDKESMHPLLEFLKVHCHKGKNMMLNDRIQNLNSLQHVLRKAEEYLGTLPAETPYAELEHKFQEIGLERGWGDTAGRVLEMIQLLLDLLEAPDPCTLEKFLGRVPMVFNVVILTPHGYFAQDNVLGYPDTGGQVVYILDQVRALENEMLLRIKQQGLNITPRILIITRLLPDAVGTTCGQRVEKVYGTEYSDILRVPFRTEKGIVRRWISRFEVWPYLETYTEDVAHEISKELQGKPDLIIGNYSDGNIVASLLAHKLGVTQCTIAHALEKTKYPDSDIYWKKLEDKYHFSCQFTADLIAMNHTDFIITSTFQEIAGSKDTVGQYESHTAFTLPGLYRVVHGIDVFDPKFNIVSPGADMSIYFPYTEEKRRLKHFHPEIEDLLYSKVENEEHLCVLNDRNKPILFTMARLDRVKNLTGLVEWYGKNAKLRELVNLVVVGGDRRKESKDLEEKAEMKKMFELIETYKLNGQFRWISSQMNRVRNGELYRYICDTKGAFVQPALYEAFGLTVVEAMTCGLPTFATCNGGPAEIIVHGKSGFNIDPYHGDQAAEILVDFFDKCKKDPSHWNDISEGGLKRIQEKYTWQIYSERLLTLTGVYGFWKHVSNLDRRESRRYLEMFYALKYRKLAESVPLAEEE

SEQ ID NO: 10384 - protein, 806 aa, Gossypium hirsutum
MAERALTRVHSLRERLDSTLTAHRNEILALLSRIEGKGKGILLHHQIILEFEAIPEENRKKLADGAFFEILKASQEAIVLPPWVALAVRPRPGVWEYIRVNVHALVVEELTVAEYLRFKEELVDGSSNANFVLELDFEPFNASFPRPTLSKSIGNGVEFLNRHLSAKLFHDKESMHPLLEFLKVHCHKGKNMMLNDRIQNLNSLQHVLRKAEEYLVALPAETSYADFEHKFQEIGLERGWGDTAERVLEMIQLLLDLLEAPDPCTLEKFLGRIPMVFNVVILTPHGYFAQDNVLGYPDTGGQVVYILDQVRALENEMLNRIKQQGLNITPRILIITRLLPDAVGTTCGQRLEKVYGTEYSDILRIPFRTEKGIVRRWISRFEVWPYLETYTEDVAHEISKELQGKPDLIIGNYSDGNIVASLLAHKLGVTQCTIAHALEKTKYPDSDIYWKKLEDKYHFSCQFTADLFAMNHTDFIITSTFQEIAGSKDTVGQYESHTAFTLPGLYRVVHGIDVFDPKFNIVSPGADMSIYYPYTEEKKRLKHFHSEIEQLLYSKVENEEHWCVLNDRNKPILFTMARLDRVKNLSGLVEWYGKNAKLRELVNLVVVGGDRRKESKDLEEKAEMKKMFELIEKYKLNGQFRWISSQMNRVRNGELYRYICDTKGAFVQPALYEAFGLTVVEAMTCGLPTFATCNGGPAEIIVHGKSGFNIDPYHGDQAAEILVDFFEKCKTDSSYWTKISEGGLKRIEEKYTWKIYSERLLTLTGVYGFWKHVSNLDRLESRRYLEMFYALKYRKLAESVPLAVEE

SEQ ID NO: 10385 - protein, 806 aa, Manihot esculenta
MAERVITRVQSIRERLDETLSAHRNEIVALLSRIEGKGKGILQHHQIIAEFEEIPEENRKKLLESVFGEVLRSAQEAIVLPPWVALAVRPRPGVWEYIRVNVHALVVEELRVAEYLHFKEELVDGSVNGNFVLELDFEPFNASFPRPTLSKYIGNGVEFLNRHLSAKLFHDKESLHPLLEFLKVHCHKGKNMMLNDRIHNLDSLQYVLRKAEEYLTALAPETPYSQFEHKFQEIGLERGWGDTAERVLEMIRLLLDLLEAPDPCTLETFLGRIPMVFNVVIMSPHGYFAQDNVLGYPDTGGQVVYILDQVRALETEMLHRIKQQGLDITPRILIITRLLPDAVGTTCGQRLEKVFGTEHSDILRIPFRTEKGIVRKWISRFEVWPYLETYTEDVATEIGKEFQGKPDLIIGNYSDGNIVASLLAHKLGVTECTIAHALEKTKYPESDIYWKKFDEKYHFSCQFTADLIAMNHTDFIITSTFQEIAGSKDTVGQYESHTAFTLPGLYRVVHGIDVFDPKFNIVSPGADETIYFSYTEEKRRLTSFHPEIEELLYSPVENEEHLCVLKDRSKPIIFTMARLDRVKNLTGLVEWYGKNAKLRELANLVVVGGDRRKESKDLEEQAEMKKMHSLIEKYNLNGHFRWISSQMNRVRNGELYRYICDTKGVFVQPAIYEAFGLTVVEAMTCGLPTFATCNGGPAEIIVHGKSGFNIDPYHGDQAAELLVQFFEKCKADPSHWIKISEGAMQRIQEKYTWQIYSQRLLTLTGVYGFWKHVSKLDRRESRRYLEMFYALKYRKLAESVPLTVED

SEQ ID NO: 10386 - protein, 805 aa, Gossypium hirsutum
MAERVITRVHSLRERLDDTLIAHRNEVLALLTRIEGKGKGILQHHQIILEFEAIPEETRKKLADGAFSEILRSSQEAIVLPPWVALAVRPRPGVWEYIKVNVHALVVEELTVAEYLHFKEELVDGSANGNFVLELDFEPFNASFPRSTLSKSIGNGVEFLNRHLSAKLFHDKESMHPLLEFLKVHCHKGKNMMLNDRIQNLNSLQHVLRKAEEYLGTLPAETPYAELEHKFQEIGLERGWGDTAGRVLEMIQLLLDLLEAPDPCTLEKFLGRVPMVFNVVILTPHGYFAQDNVLGYPDTGGQVVYILDQVRALENEMLLRIKQQGLNITPRILIITRLLPDAVGTTCGQRVEKVYGTEYSDILRVPFRTEKGIVRRWISRFEVWPYLETYTEDVAHEISKELQGKPDLIIGNYSDGNIVASLLAHKLGVTQCTIAHALEKTKYPDSDIYWKKLEDKYHFSCQFTADLIAMNHTDFIITSTFQEIAGSKDTVGQYESHTAFTLPGLYRVVHGIDVFDPKFNIVSPGADMSIYFPYTEEKRRLKHFHPEIEDLLYSKVENEEHLCVLNDRNKPILFTMARLDRVKNLTGLVEWYGKNAKLRELVNLVVVGGDRRKESEDLEEKAEMKKMFELIETYKLNGQFRWISSQMNRVRNGELYRYICDTRGAFVQPALYEAFGLTVVEAMTCGLPTFATCNGGPAEIIVHGKSGFNIDPYHGDQAAEILADFFDKCKKDPSHWNDISEGGLKRIQEKYTWQIYSERLLTLTGVYGFWKHVSNLDRRESRRYLEMFYALKYRKLAESVPLAEE

SEQ ID NO: 10387 - protein, 806 aa, Gossypium hirsutum
MAERVITRVHSLRERLDDTLIAHRNEVLALLTRIEGKGKGILQHHQIILEFEAIPEETRKKLADGAFSEILRSSQEAIVLPPWVALAVRPRPGVWEYIKVNVHALVVEELTVAEYLHFKEELVDGSANGNFVLELDFEPFNASFPRSTLSKSIGNGVEFLNRHLSAKLFHDKESMHPLLEFLKVHCHKGKNMMLNDRIQNLNSLQHVLRKAEEYLGTLPAETPYAELEHKFQEIGLERGWGDTAGRVLEMIQLLLDLLEAPDPCTLEKFLGRVPMVFNVVILTPHGYFAQDNVLGYPDTGGQVVYILDQVRALENEMLLRIKQQGLNITPRILIITRLLPDAVGTTCGQRVEKVYGTEYSDILRVPFRTEKGIVRRWISRFVVWPYLETYTEDVAHEISKELQGKPDLIIGNYSDGNIVASLLAHKLGVTQCTIAHALEKTKYPDSDIYWKKLEDKYHFSCQFTADLIAMNHTDFIITSTFQEIAGSKDTVGQYESHTAFTLPGLYRVVHGIDVFDPKFNIVSPGADMSIYFPYTEKKRRLKHFHPEIEDLLYSKVENEEHLCVLNDRNKPILFTMARLDRVKNLTGLVEWYGKNAKLRELVNLVVVGGDRRKESKDLEEKAEMKKMFELIKTYKLNGQFRWISSQMNRVRNGELYRYICDTKGAFVQPALYEAFGLTVVEAMTCGLPTFATCKGGPAEIIVHGKSGFNIDPYHGDQAAEILVDFFDKCKKEPSHWNDISEGGLKRIQEKYTWQIYSERLLTLTGVYGFWKHVSNLDRRESRRYLEMFYALKYRKLAESVPLAEEE

SEQ ID NO: 10388 - protein, 806 aa, Gossypium raimondii
MAERVITRVHSLRERLDDTLIAHRNEVLALLTRIEGKGKGILQHHQIILEFEAIPEETRKKLADGAFSEILRASQEAIVLPPWVALAVRPRPGVWEYIKVNVHALVVEELTVAEYLHFKEELVDGSANGNFVLELDFEPFNASFPRSTLSKSIGNGVEFLNRHLSAKLFHDKESMHPLLEFLKVHCHKGKNMMLNDRIQNLNSLQHVLRKAEEYLGTLPAETPYAELEHKFQEIGLERGWGDTAGRVLEMIQLLLDLLEAPDPCTLEKFLGRVPMVFNVVILTPHGYFAQDNVLGYPDTGGQVVYILDQVRALENEMLLRIKQQGLNITPRILIITRLLPDAVGTTCGQRVEKVYGTEYSDILRVPFRTEKGIVRRWISRFEVWPYLETYTEDVAHEISKELQGKPDLIIGNYSDGNIVASLLAHKLGVTQCTIAHALEKTKYPDSDIYWKKLEDKYHFSCQFTADLIAMNHTDFIITSTFQEIAGSKDTVGQYESHTAFTLPGLYRVVHGIDVFDPKFNIVSPGADMSIYFPYTEEKRRLKHFHPEIEDLLYSKVENEEHLCVLNDRNKPILFTMARLDRVKNLTGLVEWYGKNAKLRELVNLVVVGGDRRKESEDLEEKAEMKKMFELIETYKLNGQFRWISSQMNRVRNGELYRYICDTRGAFVQPALYEAFGLTVVEAMTCGLPTFATCKGGPAEIIVHGKSGFNIDPYHGDQAAEILVDFFDKCKKEPSHWNDISEGGLKRIQEKYTWQIYSERLLTLTGVYGFWKHVSNLDRRESRRYLEMFYALKYRKLAESVPLAEEE

SEQ ID NO: 10389 - protein, 805 aa, Gossypium hirsutum
MAERVITRVHSLRERLDDTLIAHRNEVLALLTRIEGKGKGILQHHQIILEFEAIPEETRKKLADGAFSEILRASQEAIVLPPWVALAVRPRPGVWEYIKVNVHALVVEELTVAEYLHFKEELVDGSANGNFVLELDFEPFNASFPRSTLSKSIGNGVEFLNRHLSAKLFHDKESMHPLLEFLKVHCHKGKNMMLNDRIQNLNSLQYVLRKAEEYLGTLPAETPYTELEHKFQEIGLERGWGDTAGRVLEMIQLLLDLLEAPDPCTLEKFLGRVPMVFNVVILTPHGYFAQDNVLGYPDTGGQVVYILDQVRALENEMLLRIKQQGLNITPRILIITRLLPDAVGTTCGQRVEKVYGTEYSDILRVPFRTEKGIVRRWISRFVVWPYLETYTEDVAHEISKELQGKPDLIIGNYSDGNIVASLLAHKLGVTQCTIAHALEKTKYPDSDIYWKKLEDKYHFSCQFTADLIAMNHTDFIITSTFQEIAGSKDTVGQYESHTAFTLPGLYRVVHGIDVFDPKFNIVSPGADMSIYFPYTEEKRRLKHFHPEIEDLLYSKVENEEHLCVLNDRNKPILFTMARLDRVKNLTGLVEWYGKNAKLRELVNLVVVGGDRRKESEDLEEKAEMKKMFELIETYKLNGQFRWISSQMNRVRNGELYRYICDTRGAFVQPALYEAFGLTVVEAMTCGLPTFATCNGGPAEIIVHGKSGFNIDPYHGDQAAEILADFFDKCKKDPSHWNDISEGGLKRIQEKYTWQIYSERLLTLTGVYGFWKHVSNLDRRESRRYLEMFYALKYRKLAESVPLAEE

SEQ ID NO: 10390 - protein, 751 aa, Trigonella foenum-graecum
EEKRQKLVNGAFGEVLRSTQEAVVLPPFVALAVRPRPGVWEYLRVDVHGLVVDELRAAEYLKFKEELVEGSSNGNFVLELDFEPFNASFPRPTLNKSIGNGVEFLNRHLSAKLFHGKESLQPLLEFLRLHNYNGKTMMVNDRIQNLNALQNVLRTAEDYLRTIAPETPYSEFEHKFQNIGLERGWGDTAERVLEMIQLLLDLLEAPDPFTLEKFLGKIPMVFNVVILSPHGYFAQDNVLGYPDTGGQVVYILDQVRALENEMLKRIKQQGLDIKPRILIITRLLPDAVGTTCGDRLEKVYDTEYCHILRVPFRTEKGIVRKWISRFEVWPYLETFSEDVANELAKELQGKPDLIVGNYSDGNIVASLLAHKLGVTQCTIAHALEKTKYPESELYWKKFEDKYHFSCQFTADLFAMNHTDFIITSTFQEIAGSKDTVGQYESHTAFTLPGLYRVVHGIDVFDPKFNIVSPGADMSIYFPYTEAERRLTSFHPEIEELLYSSVENEEHICVLKDRSKPIIFTMARLDRVKNITGLVEWYGKNARLRELVNLVVVAGDRRKESKDLEEKAEMKKMYGLIETYKLNGQFRWISSQMNRIRNGELYRVICDTKGAFVQPAIYEAFGLTVVEAMTCGLPTFATCNGGPAEIIVHGKSGYHIDPYHGDQAAETLVEFFEKSKADPSYWDKISHGGLKRIHEKYTWQIYSDRLLTLTGVYGFWKHVTNLERRESKRYLEMFYALKYSKLAESVPLAVEE

SEQ ID NO: 10391 - protein, 805 aa, Ricinus communis
MAERVITRVHSIRERLDETLAANRNEIVALLTRIEGKGKGILQHHQIIAEFEAIPEDIRKNLLDSVFGEVLRSTQEAIVLPPWVALAVRPRPGVWEYIRVNVHALVVEELRVAEYLHFKEELVDGSQNGNFVLELDFEPFNASFPRPTLSKYIGNGVEFLNRHLSAKLFHDKESLHPLLEFLKVHCHKGKNMMLNDRIQNLNSLQYVLRKAEEYLVTLPAKTPYSEFEHKFQEIGLERGWGDTAERVLEMIRLLLDLLEAPDPCTLETFLGRIPMVFNVVIMSPHGYFAQDNVLGYPDTGGQVVYILDQVRALETEMLQRIKQQGLDITPRILIITRLLPDAVGTTCGQRLEKVFGTEHSDILRIPFRTEKGIVRKWISRFEVWPYLETYTEDVATEIGKEFQGKPDLIIGNYSDGNIVASLLAHKLGVTECTIAHALEKTKYPESDIYWKKLDDKYHFSCQFTADLIAMNHTDFIITSTFQEIAGSKDTVGQYESHTAFTLPGLYRVVHGIDVFDPKFNIVSPGADESIYYPYTDTKRRLTSFHPEIEELLYSPVENEEHLCVLKDRSKPIIFTMARMDRVKNLTGLVEWYGKNAKLRELANLVVVGGDRRKESKDLEEQAEMKKMHGLIEKYNLNGQFRWISSQMNRVRNGELYRCICDTKGVFVQPALYEAFGLTVVESMSCGLPTFATCNGGPAEIIVHGKSGFNIDPYHGDQAAELLVEFFEKCKADPCVWDEISKGGLQRIQEKYTWQIYSQRLLTLTGVYGFWKHVSKLDRRESRRYLEMFYALKYKKLADSVPLTVE

SEQ ID NO: 10392 - protein, 799 aa, Lupinus angustifolius
MATSFKERVDETLQGHKDEILALLLRIEAKGKGIFQHNQVIAELEEIPKENKQNLVDGAIGEVLRSIQEAIVLPPFIALAVRPRPGVWKYARVNAHELVVDELSAAEYLKFKEEVVDGSSDGKFVLELDFEPFNASFPKPALNKSIGNGVEFLNRHLSAKLFHDRESLNLLLEFLKLHSYNGQSLLLNDKIQNVDALQQVLRKTEEYLVTLAPETPYSKFEKKFQEIGLERGWGDTAERVLELIRNLLDLLEAPEPRTLETFLGSIPLVFNVVILSPHGYFAQDNVLGYPDTGGQIVYILDQVRALENEILNRIKKQGLDITPRILIITRLLPDAVGTTCGERLEKVYHTEHCYILRVPFRTEKGIVRKWISRFEVWPYLETFAEDVALELAKELQGKPDLIVGNYSDGNIVASLLAHKFDVTQCTIAHALEKTKYPESDIYWKKLDDKYHFSSQFTADLFAMNHTDFIITSTFQEIAGSKDTVGQYESHTAFTLPGLYRVVHGIDSFDPKFNIVSPGADLSIYFPYTETERRLTKFHLDIEELLYSSVENEEHIGVLKDHNKPIIFTMARLDRVKNITGLVEWYGKNERLRELVNLVVVAGDRRKESEDLEEKAEMKKMYGLIETYKLNGQFRWISSQMDRVRNGELYRVICDTKGAFVQPAIYEAFGLTVVEAMTCGLPTFATSNGGPAEIIVHGKSGYHIDPYQGDQAAKLLVDFFEKSKNDPSHWDKISHGGLKRIHEKYTWQIYSEKLLTLTNVYGFWKHVTNLDRREHKRYLELFYALGFSKLAKSVPLAVEE

SEQ ID NO: 10393 - protein, 803 aa, Populus trichocarpa
MSVLTRVQSIRERLDETLKTHRNEIVALLTRIEGKGKGILQHHQIIAEFEAIPEEIRKILAGGAFSEVLRSTQEAIVLPPWVALAVRPRPGVWEYVRVNVQALVVEELRVAEYLHFKEELVDGGSNGNFVLELDFEPFSASFPRPTLSKYIGNGVEFLNRHLSAKLFHDKESLHPLLAFLKVHCHKGKNMMLNDRIHNLDSLQYVLRKAEEYLSSLKPETPYSQFEHKFQEIGLERGWGNTAERVLQMIQLLLDLLEAPDPCTLETFLGRIPMVFNVVIMSPHGYFAQDNVLGYPDTGGQVVYILDQVRALENEMLLRIKQQGLDIIPRILIITRLLPDAVGTTCGQRLEKVYGSEHCDILRVPFRDEKGMVRKWISRFEVWPYLETYTEDVAAEIAKELQGKPDLIIGNYSDGNVVASLLAHKLGVTECTIAHALEKTKYPDSDIYWKKFDEKYHFSCQFTADLFAMNHTDFIITSTFQEIAGSKDTVGQYESHTAFTLPGLYRVVHGIDVFDPKFNIVSPGADESIYFPYTEKKLRLTSFHEEIEELLYSSVENDEHLCVLKDRNKPILFTMARLDRVKNLTGLVEWYGKNTKLRELANLVVVGGDRRKESKDIEEQAEMKKMYSHIEKYKLNGQFRWISSQMNRVRNGELYRYICDTKGAFVQPALYEAFGLTVVEAMTCGLPTFATCNGGPAEIIVHGKSGFHIDPYHGVQAAELLVDFFEKCKADPTYWDKISQGGLQRIQEKYTWKIYSQRLLTLTGVYGFWKHVSNLDHRESRRYLEMFYALKYRKLADSVPLTIE

SEQ ID NO: 10394 - protein, 806 aa, Prunus persica
MAERALTRVQSLRERLDVTLSAHRNEIVALLSRIVNKGKGFMQPHELVAEFEAIPESNRQKLLDGAFGEVLTHTQEVIVLPPWVALAVRPRPGVWEYIRVNVDALVVEELQVPEYLHFKEELVDGSANGNFVLELDFEPFNASFPRPTLSKSIGNGVEFLNRHLSAKLFHDKESMHPLLEFLRVHCYKGKNMMLNDRIHNVNELQHVLRKAEDYLSTIAPETPYKQFEDKLQKLGLERGWGDTAERVLEMIQLLLDLLEAPDPCTLEKFLGQIPMVFNVVILSPHGYFAQDNVLGYPDTGGQVVYILDQVRALETEMLKRIKQQGLDITPRIIILTRLLPDAVGTTCGERLEKVYNTEYSHILRVPFRTEKGIVRRWISRFEVWPYLETYAEDAIQELSKELHGKPDLIIGNYSDGNIVASLMAHKLGVTQCTIAHALEKTKYPDSDLYWKKLDDKYHFSSQFTADLIAMNHTDFIITSTFQEIAGSKDTVGQYESHTAFTLPGLYRVVHGIDVFDPKFNIVSPGADMSIYFPYSEKEKRLTSFHPEIEELLYSQVENKEHLCVLKDRNKPIIFTMARLDRVKNITGLVEWYGKNAKLRELVNLVVVAGDRRKESKDNEEKAEMKKMYELIDTYNLNGQFRWISSQMNRVRNGELYRVIADTKGAFVQPAVYEAFGLTVVEAMTCGLPTFATCKGGPAEIIVHGKSGYHIDPYHGDQAADILVDFFEKSRADPSHWDKISQGGLQRIYEKYTWQIYSERLLTLTGVYGFWKHVSNLDRLESRRYLEMFYALKYRKLAESVPRAEEE

SEQ ID NO: 10395 - protein, 806 aa, Prunus mume
MAERALTRVQSLRERLDVTLSAHRNEIVALLSRIVNKGKGFMQPHELVAEFEAIPESNRQKLLDGAFGEVLTHTQEVIVLPPWVALAVRPRPGVWEYIRVNVDALVVEELQVPEYLHFKEELVDGSANGNFVLELDFEPFNASFPRPTLSKSIGNGVEFLNRHLSAKLFHDKESMHPLLEFLRVHCYKGKNMMLNDRIHNVNELQHVLRKAEDYLSTIAPETPYKQFEDKLQKLGLERGWGDTAERVLEMIQLLLDLLEAPDPCTLEKFLGQIPMVFNVVILSPHGYFAQDNVLGYPDTGGQVVYILDQVRALETEMLKRIKQQGLDITPRIIILTRLLPDAVGTTCGDRLEKVYNTEYSHILRVPFRTEKGIVRRWISRFEVWPYLETYAEDAIQELSKELHGKPDLIIGNYSDGNIVASLMAHKLGVTQCTIAHALEKTKYPDSDLYWKKLDDKYHFSSQFTADLIAMNHTDFIITSTFQEIAGSKDTVGQYESHTAFTLPGLYRVVHGIDVFDPKFNIVSPGADMSIYFPYSEKEKRLTSFHPEIEELIYSQVENKEHLCVLKDRNKPIIFTMARLDRVKNITGLVEWYGKNAKLRELVNLVVVAGDRRKESKDNEEKAEMKKMYELIDTYKLNGQFRWISSQMNRVRNGELYRVIADSKGAFVQPAVYEAFGLTVVEAMTCGLPTFATCKGGPAEIIVHGKSGYHIDPYHGDQAADILVDFFEKSRADPSHWDKISQGGLQRIYEKYTWQIYSERLLTLTGVYGFWKHVSNLDRLESRRYLEMFYALKYRKLAESVPRAEEE

SEQ ID NO: 10396 - protein, 341 aa, Lupinus angustifolius
MATDRLTRVHSLRERIDETLTTSRNEILALLSRIEGKGKGLLQHHEIIAEFEEIPEENRQKLSDGPFGEVLRSTQEAIVLSPWVAFAVRPRPGVWEYLKVNVHALVVEELQAAEYLKFKEELVEGSSNGNFVLELDFEPFNASFPRPTLNKSIGNGVQFLNRHLSAKLFHDKESLHPLLEFLRSHSYNGKTLMLNDRIQTPDSLQNVLRKAEEYLGTLAPETPYSEFEFKFQEIGLERGWGDTVERVLEMIQLLLDLLEAPDPCTLETFLGRIPMVFNVVILSPHGYFAQDNVLGYPDTGGQVVYILDQVRALENEMLKRIKQQGLDIVPRILIVSPCVVL

SEQ ID NO: 10397 - protein, 805 aa, Populus trichocarpa
MAERALTRVHSIRERVDETLKAHRNEIVALLTRIESKGKGILQHHQIVAEFEAIPEDTRKTLAGGAFAEVLRSTQEAIVVPPWIALALRPRPGVWEYIRLNVQALVVEELRVAEYLHFKEELVDGGCNGNFVLELDFEPFNASFPRPTLSKYIGNGVEFLNRHLSAKLFHDKESLHPLLAFLKVHCHKGKNMMLNDRIRNLDSLQYVLRKAEEFLSTLKPDTPYSQFEHKFQEIGLERGWGDTAERVLEMIRLLLDLLEAPDPCTLETFLGRIPMVFNVVIMSPHGYFAQDNVLGYPDTGGQVVYILDQVRALENEMLQRIKKQGLDITPRILIITRLLPDAVGTTCGQRLEKVYGSEHCDILRVPFRDGKGMVRKWISRFEVWPYLETFTEDVAAEIAKELQGKPDLIIGNYSDGNIVASLLAHKLGVTECTIAHALEKTKYPDSDIYWKKFDEKYHFSCQFTADLFAMNHTDFIITSTFQEIAGSKDTVGQYESHTAFTLPGLYRVVHGIDVFDPKFNIVSPGADESIYFPYTDEKRRLTSFHPEIDELLYSPVENEEHLCVLKDRNKPILFTMARLDRVKNLSGLVEWYGKNTKLRELVNLVVVGGDRRKESKDLEEQAEMKKMYSHIEKYNLNGQFRWISSQMNRVRNGELYRYICDTKGAFVQPALYEAFGLTVVEAMTCGLPTFATCNGGPAEIIVNGKSGFHIDPYHGEQAAELLVDFFEKCKVDPAHWDKISHGGLQRIQEKYTWQIYSQRLLTLTGVYGFWKHVSNLDRLESRRYMEMFYALKYRKLAESVPLTKE

SEQ ID NO: 10398 - protein, 807 aa, Malus domestica
MAERVLTRVQSLRERLDETLSAHRNEILALLSRIESKGKGFLQPHQLLAEFEEIPEANRQKLLDGAFGEVLKNTQEVIVLPPWVALAVRPRPGVWEYIRVNVHALVVEELRVAEYLQFKEELVDGSANGNFVLELDFEPFNASFPRPTLSKSIGNGVEFLNRHLSAKLFHDKESLHPLLKFLRVHCYEGRNLMLNNKIKDVNELQHVLRKAEDFLSAIAPETPYKDFEPKLQAIGLERGWGDTAGRVLEMIELLLDLLEAPDPCTLEKFLDQIPMVFNVVILSPHGYFAQDNVLGYPDTGGQVVYILDQVRALEAEMLKRVKQQGLDIIPRIIILTRLLPDAVGTTCGDRLEKVYGTEHSDILRVPFRDEKGAIVRRWISRFEVWPYLETYAEDAIKELSKEMHGKPDLIIGNYSDGNIVASLMALKLGVTQCTIAHALEKSKYPDSDLYWKKLDDSYHFSCQFTADLIAMNHTDFIITSTYQEIAGSKETVGQYESHTAFTLPGLYRVVHGIDVFDPKFNIVSPGADMSVYFPYSEKEKRLTNFHPEIEELLYSQVENKEHLCVLKDRNKPIIFTMARLDRVKNITGLVEWYGKNAKLRELVNLVVVAGDRRKESKDNEEKAEMKKMYELIDTYKLNGQFRWISSQMNRVRNGELYRYICDTKGAFVQPAVYEAFGLTVVEAMTCGLPTFATCKGGPAEIIVHGKSGYHIDPYHGDQAAEILVDFFEKSKADPSHWDKISQGGLQRIYEKYTWQIYSQRLLTLTGVYGFWKHVSNLDRLESRRYLEMFYALKYSKLAASVPLAVEE

SEQ ID NO: 10399 - protein, 805 aa, Eucalyptus grandis
MAERLLTRVHSLRERLDETLLAHRNDILAFLTRIEAKGKGILQHHQLIAEFEAISEEHRKKLSEGAFGEILRSSQEAIVLPPWIALAVRPRPGVWEYIRVNIHALVVEELQVTEFLHFKEELVNGNLNGNFVLELDFEPFTAQFPRPTLSKSIGNGVEFLNRHLSAKLFHDKESLHPLLEFLQVHCYKGKNMMVNTRIQNVFSLQHVLRKAEEYLSALKPETPYSQFEHKFQEIGLERGWGDTAERVLEMIRLLLDLLEAPDPCTLENFLGRIPMVFNVVIMSPHGYFAQDDVLGYPDTGGQVVYILDQVRALESEMLHRIKQQGLDITPRILIVTRLLPDAVGTTCNQRLEKVFGTEYSHILRVPFRTEKGMVRKWISRFEVWPYLETYTEDVANEIAGELQGKPDLIIGNYSDGNIVASLLAHKLGVTQCTIAHALEKTKYPESDIYWKKFEEKYHFSCQFTADLIAMNHTDFIITSTFQEIAGSKDTVGQYESHTAFTLPGLYRVVHGIDVFDPKFNIVSPGADMSIYFSYTEEKLRLKSFHAEIEELLFSDVENKEHLCVLKDRNKPILFTMARLDRVKNLTGLVEWYGKNTRLRELVNLVVVGGDRRKESKDLEEQAEMKKMYGLIETYNLNGQFRWISSQMNRVRNGELYRYICDMRGAFVQPALYEAFGLTVVEAMTCGLPTFATCKGGPAEIIVHGKSGFHIDPYHGDQAAETLANFFEKCKVDPSHWDKISQGAMQRIKEKYTWQIYSERLLNLTAVYGFWKHVSNLDRLESRRYLEMFYALKYRKLAESVPLAVE

SEQ ID NO: 10400 - protein, 805 aa, Euphorbia peplus
MAERVITRVHSIRERLDETLAANRNEIVALLTRIEGKGKGILQHHHIIAEFEAIPEDNRKKLQEGVFGEVLRAAQEAIVLPPWVALAVRPSPGVWEYVRINSHALVVEELRVAEYLQFKEELVDGSQNGNFVLELDFEPFNASFPRPTLSKYIGNGVEFLNRHLSAKLFHDKESLHPLLEFLKVHCHKGKNMMLNDRIQNLNSLQYVLRKAEEYLVALPATTPYSQFEHKFQEIGLERGWGDTAERVLEMIRLLLDLLEAPDPCTLETFLGRIPMVFNVVIMSPHGYFAQDNVLGYPDTGGQVVYILDQVRALETEMLQRIKQQGLDITPRILIITRLLPDAAGTTCGQRLEKVYGSEYSDILRIPFRTEKGIVRKWISRFEVWPYLETYTEDVATEIGKEFQGKPDLIIGNYSDGNIVASLLAHKLGVTECTIAHALEKTKYPESDIYWKKFDDKYHFSCQFTADLFAMNHTDFIITSTFQEIAGSKDTVGQYESHTAFTLPGLYRVVHGIDVFDPKFNIVSPGADMSIYFAYTEKERRLTAFHKEIEDLLYSSVENEEHLCVLKDRTKPIIFTMARLDRVKNLSGLVEWYGKNEKLREMANLVVVGGDRRKQSQDIEEQSEMKKMHAHIEKYNLNGQFRWISSQMNRVRNGELYRYICDSKGVFVQPALYEAFGLTVVEAMTCGLPTFATCNGGPAEIIVHGKSGFHIDPYHGDQAADLLVAFFERCKKEPSHWDEISKGAMQRIEEKYTWQIYSQRLLTLTGVYGFWKHVSKLDRRESRRYLEMFYALKYRKLADSVPLTVE

SEQ ID NO: 10401 - protein, 806 aa, Tropaeolum majus
MAERVITRVHSQRERLDETLSSHRNEVLALLSRIESNGKGILQHHQLIAEFEGLPEENRKKLADGALFEILTSSQEAIVSPPWVALAVRPRPGVWEYIRVNVHALIVEELTVAEYLHFKEELVDGSVNGNFVLELDFEPFNASFPRPTLSKSIGNGVEFLNRHLSAKLFHDKESMHPLLQFLKVHCHKGKNMMVNDRIGNLNSLQHVLRKAEEYLLTLTPDTAYTEFELKFQQIGLERGWGDTAERVLYMIQLLLDLLEAPDPCTLETFLGRIPMVFNVVILSPHGYFAQDNVLGYPDTGGQIVYILDQVRALETEMLLRIKQQGLNITPRILIITRLLPDAVGTTCGQRLEKVYGTEYSDILRVPFTTENGIVRKWISRFQVWPYLETFTEDVAGEISKELQGKPDLIIGNYSDGNIVASLLAHKLGVTQCTIAHALEKTKYPDSDIYWKTLDDKYHFSCQFTADLIAMNHTDFIITSTFQEIAGSKDTVGQYESHTAFTLPGLYRVVHGIDVFDPKFNIVSPGADKNIYFPYTKVEKRLTSLHPEIEDLLYSAVENEEHLCVIKDRNKPIIFTMARLDRVKNLSGLVEWFGKNARLRELVNLVVVGGDRRKESQDSEEKAELKKMFEHIETYKLNGEFRWISSQMDRVRNGELYRYICDTRGAFVQPALYEAFGLTVVEAMTCGLPTFATCKGGPAEIIVNGKSGFHIDPYHGEQAAQILVDFFEKCKEDPSYWDEISRGGLKRIEEKYTWQIYSQRLLTLTGVYGFWKHVSNLDRRESRRYLEMFYALKYRKLAESVPLTIDE

SEQ ID NO: 10402 - protein, 806 aa, Fragaria vesca
MADSRALNRAHSLRERLDDTLSAHRNEILAFLSRIEAKGKGFLQPHQLIDEFEAIPEASRKNLLESEFGEVLKNTQEAIVLPPWVALAVRPRPGVWEYIRVNVHSLVAEELLVPEYLHFKEELVDGSLNGNFVLELDFEPFNATFPKPTLSKSIGNGVEFLNRHLSAKLFHDKESMHPLLEFLRVHCYKGKNMMLNGKIQNVNALQHNLRKAEEYLSKLAPETPYKTFEIKLQDLGLERGWGDNAERVLEMIQLLLELLEAPDPCNLEKFLGRIPMVFNVVIMSPHGYFAQDNVLGYPDTGGQVVYILDQVRALENEMLKRIKEQGLDIIPRILIVTRLLPDAVGTTCGQRLEKVYNTKHSDILRVPFRTEKGIVRKWISRFEVWPYLETYTEDVATELAKEFQGKPDLIIGNYSDGNIVASLLAHKLSVTQCTIAHALEKTKYPDSDLYWKKLDDKYHFSCQFTADLIAMNHTDFIITSTFQEIAGSKDTVGQYESHTAFTMPGLYRVVHGIDVFDPKFNIVSPGADMDIYFPYSEKEKRLTHFHPEIEELIYSQEENKEHLCVLKDRNKPIIFTMARLDRVKNITGLVEWYGKNKKLRELVNLVVVAGDRRKESQDNEEKAELKKMYELIDTYKLNGQFRWISSQMNRVRNGELYRVICDTKGAFVQPAVYEAFGLTVVEAMTCGLPTFATCKGGPAEIIVHGKSGYHIDPYHGEQAAEILVDFFEKCKKDPSHWDKISQGGLKRIEEKYTWQIYSERLLTLTGVYGFWKHVSNLDRLESRRYIEMFYALKYKKLADSVPLAEE

SEQ ID NO: 10403 - protein, 807 aa, Euonymus alatus
MVTEHALTRTHSIRERLDDTLAAHRNEVIALLARIEAKGKGILQGHQIIAELEAIPEENRKKLLEGAFAEVLKAAQEAIVATPWIALALRSRPGVWEYVRVNVHALVIEDLRVSEYLHFKEELVNGTANGNFVLELDFEPFNASFPRSTLSKSIGNGVEFLNRHLSAKLFHGKESMQPLLDFLRVHCYKGKTMMLNDRIQNLNTLQHVLRKAEEYLHTVAPETLYYEFEHKFQDIGLERGWGDTAEHVQEMIQLLLDLLEAPDPCTLENFLGRIPMVFNVVILSPHGYFAQDNVLGYPDTGGQVVYILDQVRALEEEMLLRIKKQGLDIKPRILIITRLLPDAVGTTCGQRLERVYNTEHSDILRVPFRTEKGIVRKWISRFEVWPYLETFTEDVATEIGKELQGKPDLIIGNYSDGNIVASLLAHKLGVTQCTIAHALEKTKYPESDIYWEKLDEKYHFSCQFTADLIAMNHTDFIITSTYQEIAGSKDTVGQYESHTAFTLPGLYRVVHGIDVFDPKFNIVSPGADMGIYFPYTEEKRRLKHFHDDIEELLFSPVENEEHLCVLKDRNKPILFTMARLDKVKNLSGLVEWYAKNPRLRELVNLVVVGGDRRKESKDIEEQSEMKIMHNLIETYNLNGQFRWISSQMDRVRNGELYRYIADTKGAFVQPALYEAFGLTVVEAMTCGLPTFATLHGGPAEIIVHGKSGFHIDPYHGEQAAHTLVDFFEKSKVDPTYWDKISLGGLQRIQEKYTWKIYSQRLLTLTGVYGFWKHVSHLDRLESRRYLEMFYALKYRKLAQSVPLAVEE

SEQ ID NO: 10404 - protein, 808 aa, Arabidopsis thaliana
MENAERVITRVHSQRERLDATLVAQKNEVFALLSRVEAKGKGILQHHQIIAEFEAMPLETQKKLQGGAFFEILRSAQEAIVLPPFVALAVRPRPGVWEYVRVNLHDLVVEELQASEYLQFKEELVDGIKNGNFTLELDFEPFNAAFPRPTLNKYIGDGVEFLNRHLSAKLFHDKESLHPLLKFLRLHSHEGKTLMLNNRIQNLNTLQHNLRKAEEYLMELKPETLYSEFEHKFQEIGLERGWGDTAERVLNMIRLLLDLLEAPDPCTLENFLGRIPMVFNVVILSPHGYFAQDNVLGYPDTGGQVVYILDQVRALETEMLQRIKQQGLNITPRILIITRLLPDAAGTTCGQRLEKVYGSQYCDILRVPFRTEKGIVRKWISRFEVWPYLETFTEDVAAEISKELQGKPDLIIGNYSDGNLVASLLAHKLGVTQCTIAHALEKTKYPDSDIYWKKLDEKYHFSCQFTADLIAMNHTDFIITSTFQEIAGSKDTVGQYESHRSFTLPGLYRVVHGIDVFDPKFNIVSPGADMSIYFAYTEEKRRLTAFHLEIEELLYSDVENEEHLCVLKDKKKPIIFTMARLDRVKNLSGLVEWYGKNTRLRELVNLVVVGGDRRKESQDNEEKAEMKKMYELIEEYKLNGQFRWISSQMNRVRNGELYRYICDTKGAFVQPALYEAFGLTVVEAMTCGLPTFATCNGGPAEIIVHGKSGFHIDPYHGDKAAESLADFFTKCKHDPSHWDQISLGGLERIQEKYTWQIYSQRLLTLTGVYGFWKHVSNLDRLESRRYLEMFYALKYRPLAQAVPLAHEE

SEQ ID NO: 10405 - protein, 808 aa, Arabidopsis thaliana
MANAERVITRVHSQRERLDATLVAQKNEVFALLSRVEAKGKGILQHHQIIAEFEAMPLETQKKLKGGAFFEFLRSAQEAIVLPPFVALAVRPRPGVWEYVRVNLHDLVVEELQASEYLQFKEELVDGIKNGNFTLELDFEPFNAAFPRPTLNKYIGDGVEFLNRHLSAKLFHDKESLHPLLKFLRLHSHEGKTLMLNNRIQNLNTLQHNLRKAEEYLMELKPETLYSEFEHKFQEIGLERGWGDTAERVLNMIRLLLDLLEAPDPCTLENFLGRIPMVFNVVILSPHGYFAQDNVLGYPDTGGQVVYILDQVRALETEMLQRIKQQGLNITPRILIITRLLPDAAGTTCGQRLEKVYGSQYCDILRVPFRTEKGIVRKWISRFEVWPYLETFTEDVAAEISKELQGKPDLIIGNYSDGNLVASLLAHKLGVTQCTIAHALEKTKYPDSDIYWKKLDEKYHFSCQFTADLIAMNHTDFIITSTFQEIAGSKDTVGQYESHRSFTLPGLYRVVHGIDVFDPKFNIVSPGADMSIYFAYTEEKRRLTAFHLEIEELLYSDVENEEHLCVLKDKKKPIIFTMARLDRVKNLSGLVEWYGKNTRLRELVNLVVVGGDRRKESQDNEEKAEMKKMYELIEEYKLNGQFRWISSQMNRVRNGELYRYICDTKGAFVQPALYEAFGLTVVEAMTCGLPTFATCNGGPAEIIVHGKSGFHIDPYHGDKAAESLADFFTKCKHDPSHWDQISLGGLERIQEKYTWQIYSQRLLTLTGVYGFWKHVSNLDRLESRRYLEMFYALKYRPLAQAVPLAHEE

SEQ ID NO: 10406 - protein, 807 aa, Euonymus alatus
MATERALTRSHSIRERLDETLVAHRNEIVALLARIEAKGKGILQRHQIIAEFEAIPEDNRKKLAEGAFAEVLTAAQEAIVVTPWIALALRSRPGVWEHIRVNVHALVVEELRVAEYLHFKEELVNGTANGNFVLELDFEPFNASVPRSTLSKSIGNGVEFLNRHLSAQLFHGKESMQPLLDFLRVHCHKGKTMMLNDRIQNLKTLQHVLRKAEEYLQTVAPKTPYSVFEHKFQDIGLERGWGDTAEHVFEMIQLLLDLLEAPDPCTLEKFLGRIPMVFNVVILSPHGYFAQDNVLGYPDTGGQVVYILDQVRALEEEMLHRIQQQGLDIKPRILIITRLLPDAVGTTCGQRLERVYHTEHCDILRVPFRTEKGIVRQWISRFEVWPYLETFTEDVASEIGKELQGKPDLIIGNYSDGNIVASLLAHKLGVTECTIAHALEKTKYPESDIYWKKLDEKYHFACQFTADLIAMNHTDFIITSTYQEIAGSKDTVGQYESHNAFTLPGLYRVVHGIDVFDPKFNIVSPGADMSIYFSYTEEKRRLKHFHPDIEELLFSSVENEEHLCVLKDRNKPILFTMARLDKVKNLTGLVEWYAKNPRLRELVNLVVVGGDRRKQSKDIEEQSEMKKMYSLIENYNLNGQFRWISSQMDRVRNGELYRCIADTKGAFVQPALYEAFGLTVVEAMTCGLPTVATLHGGPAEIIVHGKSGFHIDPYHGEQAAETLVDFFEKSKVDPTYWDKISLGGLQRIQEKYTWQIYSQRLLTLTGVYGFWKHVSHLDRLESRRYLEMFYALKYRKLAESVPLAVEE

SEQ ID NO: 10407 - protein, 807 aa, Euonymus alatus
MVTEHALTRTHSIRERLDDTLAAHRNEVIALLARIEAKGKGILQGHQIIAELEAIPEENRKKLLEGAFAEVLKAAQEAIVATPWIALALRSRPGVWEYVRVNVHALVIEDLRVSEYLHFKEELVNGTANGNFVLELDFEPFNASFPRSTLSKSIGNGVEFLNRHLSAKLFHGKESMQPLLDFLRVHCYKGKTMMLNDRIQNLNSLQHVLRKAEEYLHTVAPETLYSVFEHKFQDIGLERGWGDTAEHVHEMIQLLLDLLEAPDPCTLENFLGRIPMVFNVVILSPHGYFAQDNVLGYPDTGGQVVYILDQVRALEEEMLLRIKKQGLDIKPRILIITRLLPDAVGTTCGQRLERVYNTEHSDILRVPFRTEKGIVRKWISRFEVWPYLETFTEDVATEIGKELQGKPDLIIGNYSDGNIVASLLAHKLGVTQCTIAHALEKTKYPESDIYWEKLDEKYHFSCQFTADLIAMNHTDFIITSTYQEIAGSKDTVGQYESHTAFTLPGLYRVVHGIDVFDPKFNIVSPGADMGIYFPYTEEKRRLKHFNDDIEELLFSPVENEEHLCVLKDRNKPILFTMARLDKVKNLSGLVEWYAKNPRLRELVNLVVVGGDRRKESKDIEEQSEMKIMHNLIETYNLNGQFRWISSQMDRVRNGELYRYIADTRGAFVQPALYEAFGLTVVEAMTCGLPTFATLHGGPAEIIVHGKSGFHIDPYHGEQAAHTLVDFFEKSKVDPTYWDKISLGGLQRIQEKYTWKIYSQRLLTLTGVYGFWKHVSHLDRLESRRYLEMFYALKYRKLAQSVPLAVEE

SEQ ID NO: 10408 - protein, 805 aa, Eucalyptus grandis
MADRMLTRSHSLRERLDETLSAHRNDIVAFLSRVEAKGKGILQRHQIFAEFEAISEESRAKLLDGAFGEVLKSTQEAIVSPPWVALAVRPRPGVWEHIRVNVHALVLEQLEVAEYLHFKEELADGSLNGNFVLELDFEPFTASFPRPTLSKSIGNGVEFLNRHLSAKLFHDKESLHPLLEFLQVHCYKGKNMMVNARIQNVFSLQHVLRKAEEYLITLKPETPYSQFEHKFQEIGLERGWGDTAERVLEMIQLLLDLLEAPDPCTLEKFLDRVPMVFNVVIMSPHGYFAQDDVLGYPDTGGQVVYILDQVRALEEEMLHRIKQQGLDITPRILIITRLLPDAVGTTCGQRLEKVFGTEYSHILRVPFRNEKGVVRKWISRFEVWPYLERYTEDVASELAGELQGKPDLIIGNYSDGNIVASLLAHKLGVTQCTIAHALEKTKYPESDIYWKKFEEKYHFSCQFTADLIAMNHTDFIITSTFQEIAGSKDTVGQYESHMNFTLPGLYRVVHGIDVFDPKFNIVSPGADMSIYFAYTEQERRLKSFHPEIEELLFSDVENKEHLCVLKDKKKPIIFTMARLDRVKNLTGLVEWYGKNSKLRELANLVVVGGDRRKDSKDLEEQSEMKKMYDLIEKYKLNGQFRWISSQMNRVRNGELYRYICDTKGVFVQPAIYEAFGLTVVEAMTCGLPTFATCNGGPAEIIVHGKSGYHIDPYHGDQAAELLVDFFNKCKIDQSHWDEISKGAMQRIEEKYTWKIYSERLLNLTAVYGFWKHVTNLDRRESRRYLEMFYALKYRPLAQSVPPAVE

SEQ ID NO: 10409 - protein, 808 aa, Arabidopsis lyrata
MANAERMITRVHSQRERLNETLVSERNEVLALLSRVEAKGKGILQQNQIIAEFEALPEETQKKLEGGPFFDLLKSTQEAIVLPPWVALAVRPRPGVWEYIRVNLHALVVDELQPAEFLHFKEELVDGVKNGDFTLELDFEPFNASFPRPTLNKYIGNGVEFLNRHLSAKLFHDKESLLPLLKFLRRHSHQGKNLMLSEKIQNLNTLQHTLRKAEEYLAELKPETPYEEFEAKFEEIGLERGWGDNAERVLDMIRLLLDLLEAPDPCTLETFLGRVPMVFNVVILSPHGYFAQDNVLGYPDTGGQVVYILDQVRALETEMLQRIKQQGLDIKPRILILTRLLPDAVGTTCGERLERVYDSEYCDILRVPFRTEKGIVRKWISRFEVWPYLETYTEDAAVELSKELNGKPDLIIGNYSDGNLVASLLAHKLGVTQCTIAHALEKTKYPDSDIYWKKLDEKYHFSCQFTADIFAMNHTDFIITSTFQEIAGSKDTVGQYESHTAFTLPGLYRVVHGIDVFDPKFNIVSPGADMSIYFPYTEEKRRLTKFHSEIEELLYSDVENEEHLCVLKDKKKPILFTMARLDRVKNLSGLVEWYGKNTRLRELANLVVVGGDRRKESKDNEEKAEMKKMYDLIEEYKLNGQFRWISSQMNRVRNGELYRYICDTKGAFVQPALYEAFGLTVVEAMTCGLPTFATCKGGPAEIIVHGKSGFHIDPYHGDQAANTLADFFTKCKEDPSHWDEISKGGLQRIEEKYTWQIYSQRLLTLTGVYGFWKHVSNLDHLEARRYLEMFYALKYRPLAQAVPLAQDD

SEQ ID NO: 10410 - protein, 807 aa, Euonymus alatus
MVTEHALTRTHSIRERLDDTLAAHRNEVIALLARIEAKGTGILQGHQIIAELEAIPEENRKKLLEGAFAEVLKAAQEAIVATPWIALALRSRPGVWEYVRVNVHALVIEDLRVSEYLHFKEELVNGTANGNFVLELDFEPFNASFPRSTLSKSIGNGVEFLNRHLSAKLFHGKESMQPLLDFLRVHCYKGKTMMLNDRIQNLNTLQHVLRKAEEYLHTVAPETLYYEFEHKFQDIGLERGWGDTAEHVQEMIQLLLDLLEAPDPCTLENFLGRIPMVFNVVILSPHGYFAQDNVLGYPDTGGQVVYILDQVRALEEEMLLRIKKQGLDIKPRILIITRLLPDAVGTTCGQRLERVYNTEHSDILRVPFRTEKGIVRKWISRFEVWPYLETFTEDVATEIGKELQGKPDLIIGNYSDGNIVASLLAHKLGVTQCTIAHALEKTKYPESDIYWEKLDEKYHFSCQFTADLIAMNHTDFIITSTYQEIAGSKDTVGQYESHTAFTLPGLYRVVHGIDVFDPKFNIVSPGADMGIYFPYTEEKRRLKHFHDDIEELLFSPVENEEHLCVLKDSNKPILFTMARLDKVKNLSGLVEWYAKNPRLRELVNLVVVGGDRRKESKDIEEQSEMKIMHNLIETYNLNGQFRWISSQMDRVRNGELYRYIADTKGAFVQPALYEAFGLTVVEAMTCGLPTFATLHGGPAEIIVHGKSGFHIDPYHGEQAAHTIVDFFEKSKVDPTYWDKISLGGLQRIQEKYTWKIYSQRLLTLTGVYGFWKHVSHLDRLESRRYLEMFYALKYRKLAQSVPLAIEE

SEQ ID NO: 10411 - protein, 806 aa, Eutrema parvulum
MVNGAITRVHSQRERLNETLVDQRNEVLALLSRVEAKGKGILQQNQIIAEFEALPEETQKKIEGGAFFDLLKTTQEAIVLPPWVALAVRPRPGVWEYLRVNLHALVVEELQPAEFLHFKEELVDGVKNGNFTLELDFEPFNASVPRPTLPKYIGDGVEFLNRHLSAKLFHDKESLLPLLKFLRLHSHGGKTLMLNEKIQNLNTLQHILRKAEEYLAELKPETPYEDFEAKFEEIGLERGWGNNAERVLDMIRLLLDLLEAPDPCTLENFLGRIPMVFNVVILSPHGYFAQDNVLGYPDTGGQVVYILDQVRALETEMLQRIKQQGLNITPRILILTRLLPDAVGTTCGERLERVDGSEYCDILRVPFRTEKGIVRKWISRFEVWPYLETYTEDAAVELAKELKGKPDLIIGNYSDGNLVASLLAHKLGVTQCTIAHALEKTKYPDSDIYWKKLDDKYHFSCQFTADLFAMNHTDFIITSTLQEIAGSKDTVGQYESHTAFTLPGLYRVVHGIDVFDPKFNIVSPGADMSIYFPYTEEKRRLTKFHPEIEELLYSDVENEEHLCVLKDKKKPILFTMARLDRVKNLSGLVEWYGKNTRLRELVNLVVVGGDRRKESKDNEEKAEMKKMYDLIEEYKLNGQFRWISSQMNRVRNGELYRYICDSKGAFVQPALYEAFGLTVVEAMTCGLPTFATCKGGPAEIIVHGKSGFHIDPYHGDQAAETLADFFTKCKEDPSHWDQISKGGLQRIEEKYTWQIYSQRLLTLTGVYGFWKHVSNLDRLESRRYLEMFYALKYRPLAQAVPLAEEE

SEQ ID NO: 10412 - protein, 807 aa, Malus domestica
MAERVLTRVQSLRERLDETLSTQRNDFLALLSRIESKGKGFLQPHQLLAEFEAIPENNRQKLLDGAFGEVLKHTQEAIVLPPWVALAVRPRPGVWEYIRVNVHALALEELCVAEYLQFKEELVDGSSNGNFVLELDFQPFNASFPRPTLSKSIGNGVEFLNRHLSAKLFHDKESLHPLLEFLRVHCYEGRNMMLNNRIKNVNELQRVLRKAEDFLSSIVPRTPYKEFEPKLQAIGLERGWGDTAERVLEMIQLLLDLLEAPNPFTLEKFLGQIPMVFNVVILSPHGYFAQDHVLGFPDTGGQVVYILDQVRALESEMLKRIKQQGLDITPRIIILTRLLPDAVGTTCGDRLEKVYGCEHSDILRVPFRDKKGAIVRRWISRFEVWPYLETYAGDAITELSKEMQGKPDLIIGNYSDGNIVASLMAHILGVTQCTIAHALEKSKYPDSDLYWKKLDENYHFSCQFTADLIAMNHTDFIITSTFQEIAGSKDTVGQYESHTAFTLPGLYRVVHGIDVFDPKFNIVSPGADMNVYFPFSEKEKRLTHFHPEIEELLYGQVENIEHLCVLKDRNKPIIFTMARLDRVKNITGLVEWYGKNAKLRELVNLVVVAGDRRNESKDNEEKAELKKMYELIDTYKLNGQLRWISSQMNRVRNGELYRYICDTRGAFVQPAVYEAFGLTVIEAMTCGLPTFATCKGGPAEIIVNGKSGYHIDPYHGDQAAEILVDFFEKNKADPSHWDKISQGGLQRIYEKYTWQIYSERLLTLTGVYGFWKDVSNLDRLESRRYLEMFYALKFRKLAASVPLAVEE

SEQ ID NO: 10413 - protein, 808 aa, Arabidopsis lyrata
MANAERVITRVHSQRERLDATLIAQKNEVLALLSRVEAKGKGILQYHQIIAEFEAMPLETQKKLQGGAFFEILRSAQEAIVLPPFVALAVRPRPGVWEYVRVNLHDLVVDELQASEYLQFKEELVDGIRNGNFTLELDFEPFNAAFPRPTLNKYIGNGVEFLNRHLSAKLFHDKESLHPLLKFLRLHSHEGKTLMLNDRIQNLNTLQHNLRKAEEYLMELKPETPYSEFDHKFQGIGLERGWGDTAVRVLDMIRLLLDLLEAPDPCTLGNFLGRIPMVFNVVILSPHGYFAQDNVLGYPDTGGQVVYILDQVRALETEMLQRTKQQGLTITPRILIITRLLPDAAGTTCGQRLEKVYGSQYCDILRVPFRTEKGIVRKWISRFEVWPYLETFTEDVAAEISKELQGKPDLIIGNYSDGNLVASLLAHKLGVTQCTIAHALEKTKYPDSDIYWKKLDEKYHFSCQFTADLIAMNHTDFIITSTFQEIAGSKDTVGQYESHTAFTLPGLYRVVHGIDVFDPKFNIVSPGADMNIYFAYTEEKRRLTAFHQEIEELLYSDVENEKHLCVLKDKKKPILFTMARLDRVKNLSGLVEWYGKNTRLRELVNLVVVGGDRSKESQDNEEKAEMKKMYDLIEEYKLNGQFRWISSQMNRVRNGELYRYICDTKGAFVQPALYEAFGLTVVEAMTSGLPTFATCNGGPAEIIVHGKSGFHIDPYHGDQAAETLADFFTKCKHDPSHWDQISLGGLERIQEKYTWQIYSERLLTLTGVYGFWKHVSNLDRLESRRYLEMFYALKYRPLAQAVPLAQEE

SEQ ID NO: 10414 - protein, 805 aa, Brassica napus
MVNGVLTRVHSQRERLNETLAAQRNEVLALLSRVEGKGKGILQQNQIIAEFEALPEETQKKIEGGAFFDLLKTTQEAIVLPPWVALAVRPRPGVWEYIRVNLHALVVEELTPAEFLHFKEELVDGVKNGDFTLELDFEPFNASVPRPTLPKYIGDGVEFLNRHLSAKLFHDKESLLPLLKFLRLHSYQGKTLMLNERVQNLNNLQHILRKAEEYLAGLSPETPYEDFEAKFEEIGLERGWGNNAERVLDMIRLLLDLLEAPDPCTLENFLGRVPMVFNVVILSPHGYFAQDNVLGYPDTGGQVVYILDQVRAMETEMLQRIQQQGLNITPRILILTRLLPDAVGTTCGERLERVDGSEYCDILRVPFRTEKGIVRKWISRFEVWPYLETYTEDAAVELAKELKGKPDLIIGNYSDGNLVASLLAHKLGVTQCTIAHALEKTKYPDSDIYWKKLDDKYHFSCQFTADLFAMNHTDFIITSTLQEIAGSKDTVGQYESHTAFTLPGLYRVVHGIDVFDPKFNIVSPGADMSIYFPYTEEKRRLTKFHPEIEELLYSNVENEEHLCVLKDKKKPILFTMARLDRVKNLSGLVEWYGKNKRLRELVNLVVVGGDRRKESKDNEEKAEMKKMYDLIEEYKLNGQFRWISSQMNRVRNGELYRYICDTKGAFVQPALYEAFGLTVVEAMTCGLPTFATCKGGPAEIIVHGKSGFHIDPYHGDQAADTLADFFAKCKEDPSHWDQISKGGLQRIEEKYTWQIYSQRLLTLTGVYGFWKHVSNLDRLESRRYLEMFYALKYRPLAQAVPLAQE

SEQ ID NO: 10415 - protein, 806 aa, Rosa hybrid cultivar
MADSRVLSRVHSLRERLDDTLSAHRNEILGFLSRIEAKGKGFLQPHQLIDEFEAIPEASRQKLSEGAFGEVLKNTQEAIVLPPWVALAVRPRPGVWEYIRVNVHSLVAEELLVPEYLHFKEELVDGSLNGNFVLELDFEPFNASFPKPTLSKSIGNGVEFLNRHLSAKLFHDKESMHPLLEFLRVHCYKGKNMMLNDRIQNVNALQHVLRKAEEFLATLAPETPYKSFEIKLQDLGLERGWGDNAGRVLEMIQLLLELLEAPDPCNLEKFLGRIPMVFNVVIMTPHGYFAQDDVLGYPDTGGQVVYILDQVRALENEMLKRIKEQGLDIIPRILVVTRLLPDAVGTTCGQRLEKVYNTKHSDILRVPFRTEKGIVRKWISRFEVWPYLETYTEDVATELAKEFQGKPDLIIGNYSDGNIVASLLAHKLSVTQCTIAHALEKTKYPDSDLYWKKLDDKYHFSCQFTADLIAMNHTDFIITSTFQEIAGSKDTVGQYESHTAFTMPGLYRVVHGIDVFDPKFNIVSPGADMDIYFPYTEKEKRLTHFHPEIEELIYSQEENKEHLCVLKDRNKPVLFTMARLDRVKNITGLVEWYGKNKKLRELVNLVVVAGDRRKESQDNEEKAELKKMYELIDTYKLNGQFRWISSQMNRVRNGELYRVIADSKGAFVQPAVYEAFGLTVVEAMTCGLPTFATCKGGPAEIIVHGKSGYHIDPYHGEQAAEILVDFFEKCKKDPSHWDKISQGGLERIYEKYTWKIYSERLLTLTGVYGFWKHVSNLDRLESRRYIEMFYALKYKKLAESVPLAKE

SEQ ID NO: 10416 - protein, 805 aa, Brassica rapa
MVNGVLTRVHSQRERLSETLVAQRNEVLALLSRVEAKGKGILQQNQIVAEFEALPEETQKKIEGGAFFDLLKTTQEAIVLPPWVALAVRPRPGVWEYIRVNLHALVVEELTPAEFLHFKEELVDGVKNGDFTLELDFEPFNASVPRPTLPKYIGDGVEFLNRHLSAKLFHDKESLLPLLKFLRLHSHQGKTLMLNERVQNLNSLQHILRKAEEYLAGLAPETPYEDFEAKFEEIGLERGWGNNAERVLDMIRLLLDLLEAPDPCTLENFLGRVPMVFNVVILSPHGYFAQDNVLGYPDTGGQVVYILDQVRAMETEMLQRIQQQGLNITPRILILTRLLPDAVGTTCGERLERVDGSEYCDILRVPFRTEKGIVRKWISRFEVWPYLETYTEDAAVELAKELKGKPDLIIGNYSDGNLVASLLAHKLGVTQCTIAHALEKTKYPDSDIYWKKLDDKYHFSCQFTADLFAMNHTDFIITSTLQEIAGSKDTVGQYESHTAFTLPGLYRVVHGIDVFDPKFNIVSPGADMSIYFPYTEEKRRLTKFHPEIEELLYSNVENEEHLCVLKDKKKPILFTMARLDRVKNLSGLVEWYGKNKRLRDLVNLVVVGGDRRKESKDNEEKAEMKKMYDLIEEYKLNGQFRWISSQMNRVRNGELYRYICDTKGAFVQPALYEAFGLTVVEAMTCGLPTFATCKGGPAEIIVHGKSGFHIDPYHGDQAADTLADFFTKCKEDPSHWDQISKGGLQRIEEKYTWQIYSQRLLTLTGVYGFWKHVSNLDRLESRRYLEMFYALKYRPLAQAVPLAQE

SEQ ID NO: 10417 - protein, 806 aa, Eutrema halophilum
MVNCVLTRVHSQRERLDETLVAQRNEVLALLSRVEAKGKGILQQNQIIAEFEALPEETQKKIEGGAFFHLLKTTQEAIVLPPFVALAVRPSPGVWEYLRVNIDALIVDELQPAEYLQFKEELVDGVKNGDFMLELDFEPFCASIPRPTLPKYIGDGVEFLNRHLSAKLFHDKESLFPLLKFLQRHSHEGQTLMLNEKIQSLNTLQRILRKAEDYLAELKPETPYEEFETKFEEIGLERGWGDNAERVLDMIRLLLDLLEAPDPCTLENFLGRIPMVFNVVILSPHGYFAQDNVLGYPDTGGQVVYILDQVRALETEMLQRIKHQGLNITPRILILTRLLPDAVGTTCGERLERVDGSEYCDILRVPFRTEKGIVRKWISRFEVWPYLETYTEDAAVELLKELKGKPDLIIGNYSDGNLVASLLAHKLGVTQCTIAHALEKTKYPDSDIYWKKLDDKYHFSCQFTADLFAMNHTDFIITSTLQEIAGSKDTVGQYESHTAFTLPGLYRVVHGIDVFDPKFNIVSPGADMSIYFPYTEEKRRLTKFYPEIEELLYSDVENEEHLCVLKDKKKPILFTMARLDRVKNLSGLVEWYGKNTRLRELVNLVVVGGDRRKESKDNEEKAEMKKMYDLIEEYKLNGQFRWISSQMNRVRNGELYRYICDTKGAFVQPALYEAFGLTVVEAMTCGLPTFATCKGGPAEIIVHGKSGFHIDPYHGDQAADTLADFFAKCKEDPSHWDEISKGGLQRIEEKYTWQIYSQRLLTLTGVYGFWKHVSNLDHLESRRYLEMFYALKYRPLAQAVPLAQEE

SEQ ID NO: 10418 - protein, 803 aa, Silene vulgaris
MAGRLTRVPSLKERLDETLTAQRNEILSFLSRILSHGKGILQAHEVAAEFEAISDKNKLADGPFGEVLRHTQEAIVLSPWITLAVRPRPGVWEYIRVNVDALAVEELTPSEFLHVKEELVNGTANGNFVLELDFEPFNASFPRPTLSKSIGNGVEFLNRHLSAKMFHDKESMRPLLDFLRMHHYKGKTMMVNDRIQNLDSLQAVIRKAEEFLSTLAPDTPYSEFDHKFQEIGLERGWGDTAERVLDMIQLLLDLLEAPDSCTLEKFLGRIPMVFNVVILSPHGYFAQANVLGYPDTGGQVVYILDQVRALEHEMLLRIKQQGLDIVPRILIVTRLLPDAVGTTCGQRLEKVFGTEHSHILRVPFRTEKGIVRKWISRFEVWPYLETYTEDVANEVTGELQAKPDLIIGNYSDGNIVASLLAHKLGVTQCTIAHALEKTKYPNSDIYWKSFEEKYHFSCQFTADLIAMNHTDFIITSTFQEIAGNKDTVGQYESHMAFTLPGLYRVVHGIDVFDPKFNIVSPGADMSIYFPYTEEKKRLTALHPEIEELLYSDVENEEHICVLKDRNKPIIFSMARLDRVKNMTGLVEWYGKNEKLRELVNLVVVAGDRRKESKDTEEKEEMKKMYELIEQYDLNGQFRWISAQMNRVRNGELYRYIADTKGAFVQPAYYEAFGLTVVEAMTCGLPTFATCHGGPAEIIVNGKSGFHIDPYHGDKAADLLVNFFDKCKADPSHWDAISLGGLKRIEEKYTWQIYSDRLLTLAGVYGFWKYVSNLDRLEARRYLEMFYALKYRKLAESVPHAIDE

SEQ ID NO: 10419 - protein, 806 aa, Vitis vinifera
MADGVLTGVHSLRARVDETLTAHRNEILSFLSRIEGHGKGILQPHQLLAEFEALPEVNRKKLSDGPFGDILKSIQEAIVLPPWIAFAVRPRPGVWEYIRVNVSALVVEELLVPEYLHFKEELVDGSCNGNFVLELDFEPFTASVPRPTLSKSIGNGVEFLNRHLSAKMFHDKDSMQPLLDFLRTHQYKGKTMMLNDRIQNLDTLQFVLRKAEEYLSSQAPETPYPEFEHKFQEIGLERGWGDTAERVLEMIHLLLDLLEAPDPCTLEQFLGRIPMVFNVVILSPHGYFAQDNVLGYPDTGGQVVYILDQVRAMETEMLLRIKQQGLDITPKIIIVTRLLPDAVGTTCNQRIEKVYGTEHSIILRVPFRTEKGIVRKWISRFEVWPYLETYTEDVAKELATELQTKPDFIIGNYSDGNIVASLLAHKLGVTQCTIAHALEKTKYPESDIYWKKLEDKYHFSCQFTADLIAMNHTDFIITSTFQEIAGSKDTVGQYESHTGFTMPGLYRVVHGIDVFDPKFNIVSPGADMTIYFSYTEEKMRLKALHPEIEELLFSPVENKEHLCVLKDRNKPIIFSMARLDRVKNLTGLVEWYGKNTRLRELVNLVVVGGDRRKESKDLEEQSEMKKMHELIETYKLNGQFRWISSQMDRVRNGELYRYIADTKGVFVQPAFYEAFGLTVVEAMTCGLPTFATCNGGPAEIIVHGKSGFHIDPYHGDKAAELLANFFEKCKADPTHWEKISKAGLKRIEEKYTWKIYSERLLTLAGVYGFWKYVSNLDRRETRRYLEMFYALKYRKLAQSVPLAVEE

SEQ ID NO: 10420 - protein, 806 aa, Malus domestica
MAERALTRVQSLRERLDETLSTHRNEILALLSRIESKGKGFLQPHQLHAEFEAIPENNRQKLLDGAFGEVLKHTQEAVVLPPWVAFAVRPRPGVWEYIRVNVHALVLEELRVAEYLQFKEELVDGSSNGNFVLELDFQPFHASFPRPTLSKSIGKGVEFLNRHLSAKLFHDKESLHPLLEFLRVHCYEGRNMMLNNRIKNVNELERVLRKAEDFLSSIVPGTPYKEFEPKLQAIGLERGWGDTAERVLEMIQLLLDLIEAPDPFTLEKFLGQIPMVFNVVILSPHGYFAQDHVLGFPDTGGQVVYILDQVRALESEMLKRIKQQGLDITPRIIILTRLLPDAVGTTCGDRLEKVYGCEHSDILRVPFRDEKGTIVRRWISRFEVWPYLQTYAEDAIKELSKEMQGKPDLIIGNYSDGNIVASLMAHKLGVTQCTIAHALEKSKYPDSDLYWKKLDENYHFSCQFTADLIAMNHTDFIITSTFQEIAGSKDTVGQYESHTAFTLPGLYRVVHGIDVFDPKFNIVSPGADKDVYFPYSEKEKRLTHFHPEIEELLYGQVENIEQLCVLKDRNKPIIFTMARLDRVKNITGLVEWYGKNAKLRELVNLLVVAGDRRNESKDNEEKAELKKMYELIDTYKLNGQLRWISSQMNRVRNGELYRYICDTRGAFVQPAVYEAFGLTVIEAMTCGLPTFATCKGGPAEIIVNGISGYHIDPYHGDQAAEILVDFFEKSKADPSHWDKISQGGLQRIYEKYTWQIYSERLLTLTGVYGFWKDVSNLDRLECRRYLEMFYALKFRKLAASVPLAVE

SEQ ID NO: 10421 - protein, 806 aa, Brassica rapa
MVNGVLTRVHSQRERLNETLVAQRNEVLALLSRVEAKGKGILQQNQIIAEFEALPEETQKKIEGGAFFDLLKTTQEAIVLPPWVALAVRPRPGVWEYIRVNLHALVVEELQPAEFLHFKEELVDGVKNGDFTLELDFEPFNASVPRPTLPKYIGDGVEFLNRHLSAKLFHEKDSLLPLLKFLQLHSHQGKTLMLNEKIQNLNTLQHILRKAEEYLAKLSPETPYEDFEAKFEEIGLERGWGNNAERVLDMLRLLLDLLEAPDPCTLETFLGRIPMVFNVVILSPHGYFAQDNVLGYPDTGGQVVYILDQVRALETEMLQRIKQQGLNITPRILILTRLLPDAVGTTCGERLERVDGSEYCDILRVPFRTEKGIVRKWISRFEVWPYLETYTEDAAVELAKELKGKPDLIIGNYSDGNLVASLLAHKLGVTQCTIAHALEKTKYPDSDIYWKKLDDKYHFSCQFTADLFAMNHTDFIITSTLQEIAGSKDTVGQYESHTAFTLPGLYRVVHGIDVFDPKFNIVSPGADMSIYFPYTEEKRRLTKFHPEIEELLYSDVENQEHLCVLKDKKKPILFTMARLDRVKNLSGLVEWYGKNKRLRDLVNLVVVGGDRRKESKDNEEKAEMKKMYDLIEEYKLNGQFRWISSQMNRVRNGELYRYICDTKGAFVQPALYEAFGLTVVEAMTCGLPTFATCKGGPAEIIVHGKSGFHIDPYHGDQAADTLADFFTKCKEDPSHWDEISKGGLQRIEEKYTWQIYSQRLLTLTGVYGFWKHVSNLDRLESRRYLEMFYALKYRPLAKAVPLAEEE

SEQ ID NO: 10422 - protein, 808 aa, Arabidopsis thaliana
MANAERMITRVHSQRERLNETLVSERNEVLALLSRVEAKGKGILQQNQIIAEFEALPEQTRKKLEGGPFFDLLKSTQEAIVLPPWVALAVRPRPGVWEYLRVNLHALVVEELQPAEFLHFKEELVDGVKNGNFTLELDFEPFNASIPRPTLHKYIGNGVDFLNRHLSAKLFHDKESLLPLLKFLRLHSHQGKNLMLSEKIQNLNTLQHTLRKAEEYLAELKSETLYEEFEAKFEEIGLERGWGDNAERVLDMIRLLLDLLEAPDPCTLETFLGRVPMVFNVVILSPHGYFAQDNVLGYPDTGGQVVYILDQVRALEIEMLQRIKQQGLNIKPRILILTRLLPDAVGTTCGERLERVYDSEYCDILRVPFRTEKGIVRKWISRFEVWPYLETYTEDAAVELSKELNGKPDLIIGNYSDGNLVASLLAHKLGVTQCTIAHALEKTKYPDSDIYWKKLDDKYHFSCQFTADIFAMNHTDFIITSTFQEIAGSKETVGQYESHTAFTLPGLYRVVHGIDVFDPKFNIVSPGADMSIYFPYTEEKRRLTKFHSEIEELLYSDVENKEHLCVLKDKKKPILFTMARLDRVKNLSGLVEWYGKNTRLRELANLVVVGGDRRKESKDNEEKAEMKKMYDLIEEYKLNGQFRWISSQMDRVRNGELYRYICDTKGAFVQPALYEAFGLTVVEAMTCGLPTFATCKGGPAEIIVHGKSGFHIDPYHGDQAADTLADFFTKCKEDPSHWDEISKGGLQRIEEKYTWQIYSQRLLTLTGVYGFWKHVSNLDRLEARRYLEMFYALKYRPLAQAVPLAQDD

SEQ ID NO: 10423 - protein, 808 aa, Arabidopsis thaliana
MANAERMITRVHSQRERLNETLVSERNEVLALLSRVEAKGKGILQQNQIIAEFEALPEQTQKKLEGGPFFDLLKSTQEAIVLPPWVALAVRPRPGVWEYLRVNLHALVVEELQPAEFLHFKEELVDGVKNGNFTLELDFEPFNASIPRPTLHKYIGNGVDFLNRHLSAKLFHDKESLLPLLKFLRLHSHQGKNLMLSEKIQNLNTLQHTLRKAEEYLAELKPETLYEEFEAKFEEIGLERGWGDNAERVLDMIRLLLDLLEAPDPCTLETFLGRVPMVFNVVILSPHGYFAQDNVLGYPDTGGQVVYILDQVRALEIEMLQRIKQQGLNIKPRILILTRLLPDAVGTTCGERLERVYDSEYCDILRVPFRTEKGIVRKWISRFEVWPYLETYTEDAAVELSKELNGKPDLIIGNYSDGNLVASLLAHKLGVTQCTIAHALEKTKYPDSDIYWKKLDDKYHFSCQFTADIFAMNHTDFIITSTFQEIAGSKETVGQYESHTAFTLPGLYRVVHGIDVFDPKFNIVSPGADMSIYFPYTEEKRRLTKFHSEIEELLYSDVENKEHLCVLKDKKKPILFTMARLDRVKNLSGLVEWYGKNTRLRELANLVVVGGDRRKESKDNEEKAEMKKMYDLIEEYKLNGQFRWISSQMDRVRNGELYRYICDTKGAFVQPALYEAFGLTVVEAMTCGLPTFATCKGGPAEIIVHGKSGFHIDPYHGDQAADTLADFFTKCKEDPSHWDEISKGGLQRIEEKYTWQIYSQRLLTLTGVYGFWKHVSNLDRLEARRYLEMFYALKYRPLAQAVPLAQDD

SEQ ID NO: 10424 - protein, 806 aa, Eutrema parvulum
MVNGAITRVHSQRERLNETLVDQRNEVLALLSRVEAKGKGILQQNQIIAEFEALPEETQKKIEGGAFFDLLKTTQEAIVLPPWVALAVRPRPGVWEYLRVNLHALVVEELQPAEFLHFKEELVDGVKNGNFTLELDFEPFNASVPRPTLPKYIGDGVEFLNRHLSAKLFHDKESLLPLLKFLRLHSHGGKTLMLNEKIQNLNTLQHILRKAEEYLAELKPETPYEDFEAKFEEIGLERGWGNNAERVLDMIRLLLDLLEAPDPCTLENFLGRIPMVFNVVILSPHGYFAQDNVLGYPDTGGQVVYILDQVRALETEMLQRIKQQGLNITPRILILTRLLPDAVGTTCGERLERVDGSEYCDILRVPFRTEKGIVRKWISRFEVWPYLETYTEDAAVELAKELKGKPDLIIGNYSDGNLVASLLAHKLGVTQCTIAHALEKTKYPDSDIYWKKLDDKYHFSCQFTADLFAMNHTDFIITSTLQEIAGSKDTVGQYESHTAFTLPGLYRVVHGIDVFDPKFNIVSPGADMSIYFPYTEEKRRLTKFHPEIEELLYSDVENEEHLCVLKDKKKPILFTMARLDRVKNLSGLVEWYGKNTRLRELVNLVVVGGDRRKESKDNEEKAEMKKMYDLIEEYKLNGQFRWISSQMNRVRNGELYRYICDTKGAFVQPALYEAFGLTVVEAMTCGLPTFATCKGGPAEIIVHGKSGFHIDPYHGDQAAETLADFFTKCKEDPSHWDQISKGGLQRIEEKYTWQIYSQRLLTLTGVYGFWKHVSNLDRLESRRYLEMFYALKYRPLVCILSSLVPC

SEQ ID NO: 10425 - protein, 806 aa, Brassica napus
MVNGVLTRVHSQRERLNETLVAQRNEVLALLSRVEAKGKGILQQNQIIAEFEALPEETQKKIEGGAFFDLLKTTQEAIVLPPWVALAVRPRPGVWEYIRVNLHALVVEELQPAEFLHFKEELVDGVKNGDFTLELDFEPFNASVPRPTLPKYIGDGVEFLNRHLSAKLFHEKDSLLPLLKFLQLHSHQGKTLMLNEKIQNLNTLQHILRKAEEYLAELSPETPYEDFEAKFEEIGLERGWGNNAERVLDMLRLLLDLLEAPDPCTLETFLGRIPMVFNVVILSPHGYFAQDNVLGYPDTGGQVVYILDQVRALETEMLQRIKQQGLNITPRILILTRLLPDAVGTTCGERLERVDGSEYCDILRVPFRTEKGIVRKWISRFEVWPYLETYTEDAAVELAKELKGKPDLIIGNYSDGNLVASLLAHKLGVTQCTIAHALEKTKYPDSDIYWKKLDDKYHFSCQFTADLFAMNHTDFIITSTLQEIAGSKDTVGQYESHTAFTLPGLYRVVHGIDVFDPKFNIVSPGADMSIYFPYTEEKRRLTKFHPEIEELLYSDVENQEHLCVLKDKKKPILFTMARLDRVKNLSGLVEWYGKNKRLRELVNLVVVGGDRRKESKDNEEKAEMKRMYDLIDEYKLNGQFRWISSQMNRVRNGELYRYICDTKGAFVQPALYEAFGLTVVEAMTCGLPTFATCKGGPAEIIVHGKSGFHIDPYHGDQAADTLADFFTKCKEDPSHWDEISKGGLQRIEEKYTWQIYSQRLLTLTGVYGFWKHVSNLDRLESRRYLEMFYALKYRPLAKAVPLAEEE

SEQ ID NO: 10426 - protein, 808 aa, Eutrema parvulum
MANAERVLTRVQSQRDRLDETLVAQRNEVLALLSRIEARGKGILQHHQIIAEFEAMPKEIQSKLEGGAFFELLRSTQEAIVLLPWVALAVRPRPGVWEYIRVNLHALVVDELQASEYLHFKEELVDGTNNGNFTLELDFEPFNATFPRPTLSKYIGDGVEFLNRHLSAKLFHDKESLHPLLKFLRLHSHEGKTLMLNDRIQNLNTLQRILRKAEEYLMELKPETLYSEFEHKFQEIGLERGWGDTAERVLDMIRLLLDLLEAPDPCTLENFLGRIPMVFNVVILSPHGYFAQDNVLGYPDTGGQVVYILDQVRALETEMLQRIKQQGLNITPRILIITRLLPDATGTTCGQRLEKVYGSQYCDILRVPFRTEKGIVRKWISRFEVWPYLEIFTEDVATEISRELQGKPDLIIGNYSDGNLVASLLAHKLGVTQCTIAHALEKTKYPDSDIYWKKLDEKYHFSCQFTADLIAMNHTDFIITSTFQEIAGSKDTIGQYESHTAFTLPGLYRVVHGIDVFDPKFNIVSPGADMSIYFAYTEENRRLTSFHQELEELLYSDVENEEHLCVLKDKNKPIIFTMARLDRVKNLSGLVEWYGKNSRLRELVNLVVVGGDRRKESQDNEEKAEMKKMYDLIEEYKLNGQFRWISSQMNRVRNGELYRYICDTKGAFVQPALYEAFGLTVVEAMTCGLPTFATCNGGPAEIIVHGKSGFHIDPYHGDQAAETLADFFTKCKQDPSHWDQISMGGLQRIQEKYTWQIYSQRLLTLTGVYGFWKHVSNLDRLESRRYLEMFYALKYRPLVRTDHTSFDT

SEQ ID NO: 10427 - protein, 806 aa, Brassica napus
MVNGVLTRVHSQRERLNETLVAQRNEVLALLSRVEAKGKGILQQNQIIAEFEALPEETQKKIEGGAFFDLLKTTQEAIVLPPWVALAVRPRPGVWEYIRVNLHALVVEELQPAEFLHFKEELVDGVKNGNFTLELDFEPFNASVPRPTLPKYIGDGVEFLNRHLSAKLFHEKDSLLPLLKFLQLHSHQGKTLMLNEKIQNLNTLQHILRKAEEYLAELSPETPYEDFEAKFEEIGLERGWGNNAERVLDMLRLLLDLLEAPDPCTLETFLGRIPMVFNVVILSPHGYFAQDNVLGYPDTGGQVVYILDQVRALETEMLQRIKQQGLNFTPRILILTRLLPDAVGTTCGERLERVDGSEYCDILRVPFRTEKGIVRKWISRFEVWPYLETYTEDAAVELAKELKGKPDLIIGNYSDGNLVASLLAHKLGVTQCTIAHALEKTKYPDSDIYWKKLDDKYHFSCQFTADLFAMNHTDFIITSTLQEIAGSKDTVGQYESHTAFTLPGLYRVVHGIDVFDPKFNIVSPGADMSIYFPYTEEKRRLTKFHPEIEELLYSDVENQEHLCVLKDKKKPILFTMARLDRVKNLSGLVEWYGKNKRLRELVNLVVVGGDRRKESKDNEEKAEMKKIYDLIDEYKLNGQFRWISSQMNRVRNGELYRYICDTKGAFVQPALYEAFGLTVVEAMTCGLPTFATCKGGPAEIIVHGKSGFHIDPYHGEQAADTLADFFTKCKEDPSHWDEISKGGLQRIEEKYTWQIYSQRLLTLTGVYGFWKHVSNLDRLESRRYLEMFYALKYRPLAKAVPLAEEE

SEQ ID NO: 10428 - protein, 787 aa, Brassica napus
TLVAQRNEVLALLSRVEAKGKGILQQNQIVAEFEALPEETQKKIEGGAFFDLLKTTQEAIVLPPWVALAVRPRPGVWEYIRVNLHALVVEELTPAEFLHFKEELVDGVKNGDFTLELDFEPFNASVPRPTLPKYIGDGVEFLNRHLSAKLFHDKESLLPLLKFLRLHSHQGKTLMLNERVQNLNSLQHILRKAEEYLAGLAPETPYEDFEAKFEEIGLERGWGNNAERVLDMIRLLLDLLEAPDPCTLENFLGRVPMVFNVVILSPHGYFAQDNVLGYPDTGGQVVYILDQVRAMETEMLQRIQQQGLNITPRILILTRLLPDAVGTTCGERLERVDGSEYCDILRVPFRTEKGIVRKWISRFEVWPYLETYTEDAAVELAKELKGKPDLIIGNYSDGNLVASLLAHKLGVTQCTIAHALEKTKYPDSDIYWKKLDDKYHFSCQFTADLFAMNHTDFIITSTLQEIAGSKDTVGQYESHTAFTLPGLYRVVHGIDVFDPKFNIVSPGADMSIYFPYTEEKRRLTKFHPEIEELLYSNVENEEHLCVLKDKKKPILFTMARLDRVKNLSGLVEWYGKNKRLRELVNLVVVGGDRRKESKDNEEKAEMKKMYDLIDEYKLNGQFRWISSQMNRVRNGELYRYICDTKGAFVQPALYEAFGLTVVEAMTCGLPTFATCKGGPAEIIVHGKSGFHIDPYHGDQAADTLADFFTKCKEDPSHWDQISKGGLQRIEEKYTWQIYSQRLLTLTGVYGFWKHVSNLDRLESRRYLEMFYALKYRPLAQAVPLAQE

SEQ ID NO: 10429 - protein, 806 aa, Chelidonium majus
MPERVLTRVHSHRERFDEALTSYRNELLALLARLESQGKGILQPHHLLAEVEAIFQGDKNKLSEGVFGEVLRSTQEAIVLPPWIALAVRPRPGVWEYIRVNLNALVTDELTASEYLQFKEELVNGRSNDNFTLELDFEPFNASFPRPTLSKSIGNGVQFLNRHLSAKMFHDKDSLQPLLDFLRQHNYKGMTMMLNDRVQNLDGLQSILRKADEYLSLLSPSTPYSEFDHKFQEIGLEKGWGDTAERVLEMIQLLLDLLEAPDPCTLENFLGRIPMVFNVVILSPHGYFAQNDVLGYPDTGGQIVYILDQVKALEIEMLKRIKQQGLDITPKIIIVTRLLPDAVGTTCGQRNEKVFGTEYASILRVPFRTEKGILRKWISRFEVWPYLETFAEDVAHEIAGELQGKPDLVIGNYSDGNLVASLLAHKLKVTQCTIAHALEKTKYPDSDIYWKKFDDKYHFSCQFTADLYAMNHTDFIITSTFQEIAGSKDTVGQYESHTAFTLPGLYRVVHGIDVFDPKFNIVSPGADMDVYFPYTEEQKRLTAFHPEIEELLYSSTQNEEHIGVLKDRSKPIIFSMARLDRVKNITGLVEWYGKNSRLRELVNLVVVAGDRRKESKDLEEKEEMKKMYALIETYNLNGDFRWISSQMNRVRNGELYRYIADTKGAFVQPAFYEAFGLTVVEAMTCGLPTFATSHGGPAEIIVHGKSGFHIDPYLGDKAAELLVGFFDNCKSDPSHWDEISAEGLKRIYEKYTWQIYSERLMTLSGVYGFWKFVSNLERRETRRYLEMFYALKYRKLALSVPLAVDE

SEQ ID NO: 10430 - protein, 803 aa, Silene vulgaris
MAGRLTRVPSLKERLDETLTAQRNEILPFLSRISSHGKGILQAHEVAAEFEATSGTNKLADGPFGDILRHTQEAIVMAPWITLAVRPRPGVWEYIRINTDALAVQELTPSEFLHMKEELVDGNLNGNFVLELDFEPFTASVPRPTLSKSIGNGVEFLNRHLSAKMFHDKESMRPLLDFLRMHHYKGKTMMLNDRIQNLDSLQSVLRKAEDYLSALPADTPYSEFDHKFQEIGLERGWGDTAERVLDMIQLLLDLLEAPDSCTLEKFLGQIPMVFNVVILSPHGYFAQANVLGYPDTGGQVVYILDQVRALENEMLQRIKQQGLDIVPRILIITRLLPDAVGTTCGQRLEKVYGTEHSHILRVPFRTEKGIVRRWISRFEVWPYLETFTEDVANEISGELQAKPDLIIGNYSDGNIVASQLAHKLGVTQCTIAHALEKTKYPNSDIYWKSFEEKYHFSCQFTADLIAMNHTDFIITSTFQEIAGNKDTIGQYESHMAFTLPGLYRVVHGIDVFDPKFNIVSPGADLSVYFPYTEEKRRLTALHPEIEELLYSDVENEEHTCVLKARNKPIIFSMARLDRVKNMTGLVEWYGKNDKLRELVNLVVVAGDRRKESKDTEEKEEMKKMWDLIDQYKLNGQFRWISAQMNRVRNGELYRYIADTKGAFVQPAYYEAFGLTVVEAMTCGLPTFATCHGGPAEIIVNGKSGFHIDPYHGEKAGELLVDFFQKSKADPSHWDAISLGGLKRIEEKYTWKIYSDRLLTLAGVYGFWKYVSNLDRREARRYIEMFHALKYRKLAEAVPLAVEE

SEQ ID NO: 10431 - protein, 215 aa, Unknown
  Sequence found in Organisms: Sorghum bicolor, Saccharum officinarum
MVFYFKVRPEAGDYTIFMGLDKYENEDLIKYGFPEDIWFHVDKMSSAHVYVRLNKGQTMDDMSEGLLEDCAQLVKANSIQGNKVNNIDVVYTPWYNLKKTPSMDVGQVGFHNPKLVRTIKVEKRINEIVNRLNKTKVERKPDLKAEREAVSAAEKAERKAQLRDKKRREEMERLEKEKQADIRSYKGLMVQEKMTSNKQIASGSKTLQELEEDFM

SEQ ID NO: 10432 - protein, 215 aa, Setaria italica
MVFYFKARPEAGDYTIFMGLDKYENEDLIKYGFPEDIWFHVDKMSSAHVYVRLNKGQTMDDMSEGLLEDCAQLVKANSIQGNKVNNIDVVYTPWYNLKKTPSMDVGQVGFHNPKLVRTIKVEKRINEIVNRLNKTKVERKPDLKAEREAVSAAEKAERKAQLRDKKRREEMERLEKEKQAEIRSYKGLMVQEKMTSNKQIASGSKTLQELEEDFM

SEQ ID NO: 10433 - protein, 215 aa, Panicum virgatum
MVFYFKARPEAGDYTIFMGLDKYENEDLIKYGFPEDIWFHVDKMSSAHVYVRLNKGQTMDDMSEGLLEDCAQLVKANSIQGNKVNNIDVVYTPWYNLKKTPSMDVGQVGFHNPKLVRTIKVEKRINEIVNRLNKTKVEQKPDLKAEREAVSAAEKAERKVQLRDKKRREEMERLEKEKQAEIRSYKGLMVQEKMTSNKQVASGSKTLQELEEDFM

SEQ ID NO: 10434 - protein, 215 aa, Pennisetum glaucum
MVFYFKARPEVGDYTIFMGLDKHENEDLIKYGFPEDIWFHVDKMSSAHVYVRLNKGQTMDDMSEGLLEDCAQLVKANSIQGNKVNNIDVVYTPWYNLKKTPSMDVGQVGFHNSKMVRTIKVEKRINEIVNRLNKTKVERKPDFKAEREAVSAAEKAERKAQLRDKKRREEMERLEKEKQAEIRSYKGLMVQEKMTSNKQIASGSKTLQELEEDFM

SEQ ID NO: 10435 - protein, 215 aa, Panicum virgatum
MVFYFKARPEAGDYTIFMGLDKYENEDLIMYGFPEDIWFHVDKMSSAHVYVRLNKGQTMDDMSEGLLEDCAQLVKANSIQGNKVNNIDVVYTPWYNLKKSPSMDVGQVGFHNPKLVRTIKVEKRINEIVNRLNKTKVERKPDLKAEREAVSAAEKTERKVQLRDKKRREEMERLEKEKQAEIRSYKGLMVQEKMTSNRQIASGSKTLQELEEDFF

SEQ ID NO: 10436 - protein, 215 aa, Brachypodium distachyon
MVFYFKARPEAGDYTIFMGLDKHENEDLIKYGFPEDIWFHVDKMSSAHVYLRLNKGQTMDDISEGVLEDCAQLVKANSIQGNKVNNVDVVYTPWYNLKKTPSMDVGQVGFHNSKLVRTVQVEKRINEVVNRLNKTKVERTPDLKAEREAVSAAEKAERKLQLRDKKRREEMERLEKEKQAEIRSYKGLMVQDKMTSNKQVASGSKTLQELEEDFM

SEQ ID NO: 10437 - protein, 215 aa, Unknown
  Sequence found in Organisms: Secale cereale, Triticum aestivum
MVFYFKARPDAGDYTIFMGLDKHENEDLIKYGFPEDIWFHVDKMSSAHVYVRLNKGQTMDDISEGLLEDCAQLVKANSIQGNKVNNVDVVYTPWYNLKKTPSMDVGQVGFHNSKLVRTVQVEKRINEVVNRLNKTKVERTPDLKAEREAVSAAEKAERKLQLRDKKRKEEMERLEKEKQAEIRSYKGLMVQDKMTSNKQVASGSKTLQELEEDFM

SEQ ID NO: 10438 - protein, 215 aa, Oryza sativa
MVFYFKVRPEAGDYTIFMGLDKFENEDLIKYGFPEDIWFHVDKMSSAHVYLRLNKGQTMDDISEGVLEDCAQLVKANSIQGNKTNNIDVVYTPWYNLKKTPSMDVGQVGFHNSKLVRIVKVEKRINEIVNRLNKTKVERKPDLKAEREAVSAAEKAERKVQLRDKKRREEMERVEKEKQAEIRSYKNLMVQEKMTSNKQVASGSKTLEELEDDFM

SEQ ID NO: 10439 - protein, 215 aa, Unknown
  Sequence found in Organisms: Festuca arundinacea, Lolium multiflorum
MVFYFKARPDAGDYTIFMGLDKHENEDLIKYGFPEDIWFHVDKMSSAHVYLRLNKGQTMDSISEGVLEDCAQLVKANSIQGNKVNNVDVVYTPWYNLKKTPSMDVGQVGFHNSKLVRTVQVEKRLNEVVNRLNKTKVERTPDLKAEREAVSAAEKAERKVQLRDKKRKEEMERMEKEKQAEIRSYKGLMVQDKMTSNKQIASGSKTLQELEEDFM

SEQ ID NO: 10440 - protein, 215 aa, Amborella trichopoda
MVFYFKARPEAGDYTIFMGLDKHENEELIKYGFPEDIWFHVDKMSSAHVYVRLNKGQTIDDISEGLLEDCAQLVKANSIQGNKVNNVDVVYTPWYNLKKTPSMDVGQVGFHNPKMVRTVRVEKRINEIVNRLNKTKVERKPDLKAEREAVNAAERAERKLQLRDKKRREEMERLEKEKQVEIRSYKGLMVSDKMTSNKQIASTNKSLQELEEDFM

SEQ ID NO: 10441 - protein, 215 aa, Avena sativa
MVFYFKARPDAGDYTIFMGLDKHENEDLIKYGFPEDIWFHVDKMSSAHVYLRLNKGQTMDDISEGVLEDCAQLVKANSIQGNKVNNVDVVYTPWFNLKKTPSMDVGQVGFHNSKLVRTVQVEKRLNEVVNRLNKTKVERTPDLKAEREAVSAAEKAERKLQLRDKKRKEEMERLEKEKQAEIRSYKGLMVQDKMTSNKQVASGSKTLQELEEDFM

SEQ ID NO: 10442 - protein, 215 aa, Aristolochia fimbriata
MVFYFKARPEAGDYTIFMGLDKHENEELIRYGFPEDIWFHVDKMSSAHVYVRLNKGQTIDDISEGLLEDCAQLVKANSIQGNKVNNVDVVYTPWYNLKKTPSMDVGQVGFHNPKMVRTVRVEKRINEVVNRLNKTKVERKPDLKAEREAVNAAERAERKMLLRDKKRREEMERLEKEKQAEIRSYKGLMVSEKMTSNKQIASANKSLQELEEDFM

SEQ ID NO: 10443 - protein, 215 aa, Unknown
  Sequence found in Organisms: Citrus clementina, Citrus sinensis
MVFYFKARPEAGDYTIFMGLDKYENEELIKYGFPEDIWFHVDKMSSAHVYLRLHKGQTIDDISEGVLEDCAQLVKANSIQGNKVNNIDVVYTPWANLKKTASMDVGQVGFHNPKMVRTVKVEKRINEIVNRLNKTKVERKPDLKAEREAANAAERAERKLQLRDKKRREEMERLEKERQAEVRSYKGLMVAEKMTSNKQIASESKSLQELEEDFM

SEQ ID NO: 10444 - protein, 215 aa, Platanus occidentalis
MVFYFKARPEAGDYTIFMGLDKHENEELIKYGFPEDIWFHVDKMSSAHVYVRLNKGQTIDDISEGLLEDCAQLVKANSIQGNKVNNIDVVYTPWYNLKKTPSMDVGQVGFHNPKMVRTVRVEKRINEMVNRLNKTKVERKPDLKAEREAVNSAERAERKLQLRDKKRREEMERLEKERQAEIRSYKGLMVSEKMTSNKQIASTNKSMQELEEDFM

SEQ ID NO: 10445 - protein, 215 aa, Eschscholzia californica
MVFYYKARPETGDYTIFMGLDKHENEELIKYGFPEDIWFHVDKMSSAHVYVRLNKGQTIDDISEGLLEDCAQLVKANSIQGNKVNNIDVVYTPWFNLKKTPSMDVGQVGFHNSKMVRTVRVEKRINEVVNRLNKTKVERKPDLKAEREAVNAAERAERKVHLRDKKRREEMERLEKEKQAEIRSYKGLMVSEKMTSNKQIASASKSLQELEEDFM

SEQ ID NO: 10446 - protein, 215 aa, Elaeis guineensis
MVFYFKARPEVGDYTIFMGLDKYENEELIKYGFPEDIWFHVDKMSSAHVYLRLKKGQTIDDISEGLLEDCAQLVKANSIQGNKVNNVDVVYTPWYNLKKTPSMDVGQVGFHNPKMVRTVKVDKRINEIVNRLNKTKVERKPDLKAEREAVNAAEKAERKLQLREKKRREEMERLEKERQAEVRSYKGLMVSEKMTSNKQIASTNKSLQELEEDFM

SEQ ID NO: 10447 - protein, 215 aa, Amorphophallus konjac
MVFYFKARPEAGDYTIYMGVDKHENEELIKYGFPEDIWFHVDKMSSAHVYLRLNKGQTIDDISEGLLEDCVQLVKANSIQGNKVNNIDVVYTPWYNLKKTPSMDVGQVGFHNPKMVRTVRVEKRINEIVNRLNKTKVERKPDLKAERESVNAAERAERKLQLRDKKRREEMEKLEKERQAEIRSYKGLMVSEKMTSNKQIASTTKSLQELEEDFM

SEQ ID NO: 10448 - protein, 215 aa, Ricinus communis
MVFYFKARPEVGDYTIFMGLDKYENEELIRYGFPEDIWFHVDKMSSAHVYLRLNKGQTIDDISEGLLEDCAQLVKANSIQGNKVNNIDVVYTPWANLKKTASMDVGQVGFHNSKMVRTVRVEKRINEIVNRLNRTKVERKPDLKAEREAVNAAERAERKLQLRDKKRREEMERLEKERQAEIRSYKGLMVSEKMTSNKQIASENKSLQELEEDFM

SEQ ID NO: 10449 - protein, 215 aa, Cajanus cajan
MVFYFKARPEAGDYTIFMGLDKFENEELIKYGFPEDIWFHVDKMSSAHVYVRLHRGQTIDGMSEGLLEDCAQLVKANSIQGNKVNNIDVVYTPWSNLKKTASMDVGQVGFHNPKMVRTVRVEKRINEIVNRLNKTKVERKPDLKAEREAVNAAERAERKQQLREKKRREEMERLEKERQAELRSYKGLMVAENMTSNKDIASGSKSLQELEEDFM

SEQ ID NO: 10450 - protein, 215 aa, Arachis hypogaea
MVFYFKARPEAGDYTIFMGLDKYENEELIKYGFPEDIWFHVDKMSSAHVYVRLHKGQTIDDISEGLLEDCAQLVKANSIQGNKVNNIDVVYTPWANLKKTASMDVGQVGFHNPKMVRTVRVEKRINEIVNRLNKTKVERKPDLRAEREAVNAAERAERKQQMRDKKRREELERLEKERQAELRSYKGLMVAENMTSNKHIASGSKTLQEMEDDFM

SEQ ID NO: 10451 - protein, 215 aa, Glycyrrhiza uralensis
MVFYFKARPEAGDYTIFMGLDKFENEELIKYGFPEDIWFHVDKMSSAHVYVRLHKGQTIDNMSEGLLEDCAQLVKANSIQGNKVNNIDVVYTPWSNLKKTASMDVGQVGFHNPKMVRTVRVEKRINEIVNRLNKTKVERKPDLKAEREAVNAAERAERKQQLREKKRREELERLEKEKQAELRSYKGLMVAENMTSNKEIASGSKSFQEVEEDFM

SEQ ID NO: 10452 - protein, 215 aa, Glycine max
MVFYFKARPEAGDFTIFMGLDKYENEELIKYGFPEDIWFHVDKMSSAHVYVRLHKGQTIDDMSEGLLEDCAQLVKANSIQGNKVNNVDVVYTPWSNLKKTASMDVGQVGFHNSKMVRTVRVEKRINEIVNRLNKTKVERKPDLKAEREAVNAAERAERKQQLREKKRREELGRLEKEKQTELRSYKGLMVAENMTSNKQIASGSKSLQELEEDFM

SEQ ID NO: 10453 - protein, 168 aa, Tripterygium wilfordii
MVFYFKARPEVGDYTIFMGLDKFENEELIKYGFPEDIWFHVDKMSSAHVYVRLHKGQTIDYISEGLLEDCAQLVKANSIQGNKVNNVDVVYTPWANLKKTASMDVGQVGFHNPKNVRTVRVEKRINEIVNRLNKTKVERKPDLKAEREAVGAAERAERKLQQRDKKRP

SEQ ID NO: 10454 - protein, 215 aa, Gossypium raimondii
MVFYFKARPEVGDYTIFMGLDKYENEELIKYGFPEDIWFHVDKMSSAHVYVRLHKGQTIDDISEGLLEDCAQLVKANSIQGNKVNNVDVVYTPWSNLKKTPSMDVGQVGFHNSKMVRTVRVEKRINEIVNRLNKTKVERKPDLKAEREAVNAAERAERKQQLREKKRHEELQRLEKERQAEIRSYKGLMVSEKMTSNKQIATTSKSLQELEEDFM

SEQ ID NO: 10455 - protein, 215 aa, Musa acuminata
MVFYFKALPEAGDYTIFMGLDKHENEELIKYGFPEDIWFHVDKMSSAHVYLRLNKGQTIDDINEGLLEDCAQLVKANSIQGNKVNNVDVVYTPWFNLKKTPSMDVGQVGFHNPKMVRTVKVEKRINEIVNRLNKTKVERKPDLKAEREAVNAVERAERKAQLRDKKKREELERLEKEKQSEIRSYKSLMVSEKMTSNKQIASANKSLQELEDDFM

SEQ ID NO: 10456 - protein, 215 aa, Elaeis guineensis
MVFYFKARPEAGGYTIFMGLDKYENEELIKYGFPEDIWFHVDKISSAHVYLRLNKGQTIDDISEGLLEDCAQLVKANSIQGNKMNSIDVVYTPWYNLKKTPSMDVGQVGFHNPKMVRTVRVEKRINEIVNRLNKTKVERKPDLKAEREAVSAAERAEKKLQQREKKRREEMERLQKEKQAEIRSYKGLMVADKMTSNKQIASNDKSLQELEEEFM

SEQ ID NO: 10457 - protein, 215 aa, Unknown
  Sequence found in Organisms: Gossypium hirsutum, Gossypium raimondii
MVFYFKARPEAGDYTIFMGLDKYENEELIKYGFIEDIWFHVDKMSSAHVYLRLKKGQTIDDISEGVLEDCAQLVKANSIQGNKVNNIDVVYTPWSNLKKTPSMDVGQVGFHNSKMVRTVRVEKRINEIVNRLNKTKVERKPDLKAEKEAVYAAEKAERKQQLREKKRREEMQRLEKERQAEIRSYKGLMVSEKMTSNKQIAATSKSFQEVEEDFM

SEQ ID NO: 10458 - protein, 215 aa, Vitis vinifera
MVFYFKARPEAGDYTIFMGLDKHENEELIKYGFPEDIWFHVDKMSSAHVYVRLHKGQTIDDISEGLLEDCAQLVKANSIQGNKVNNVDVVYTPWHNLKKSASMDVGQVGFYNSKMVRTVRVEKRINEIVNRLNRTKVERKPDLKAEREAVNAAERAERKLQLRDKKRREEMERLEKERQAEIRSYKGLMVSEKMTSNKQIASANKSLQELEDDFM

SEQ ID NO: 10459 - protein, 215 aa, Lupinus angustifolius
MVFYFKARPEAGDFTIFMGLDKYENEELIRYGFPEDIWFHVDKMSSAHVYVRLHKGQGIDDISEGLLEDCVQLVKANSIQGNKVNNIDVVYTPWSNLKKTPSMDVGQVGFHNSKMVRTVRVEKRINEIVNRLNKTKVERKPDLKAEREAVNAAERAERKLHLREKKRREELERLEKERQAEMRSYKGLMVSENMVSNKQIASGSKSLQELEEDFM

SEQ ID NO: 10460 - protein, 215 aa, Flaveria ramosissima
MVFYFKARPEAGDYTIFMGLDKFENEELIKYGFPEDIWFHVDKMSSAHVYVRLHKGQTIDDISEGLLEDCAQLVKANSIQGNKVNNIDVVYTPWQNLKKTPSMDVGQVGFHNNKAVRTVRVEKRINEIVNRLNRTKVERKPDLKAEREAVNAAERAERKQLLRDKKRREEMERLEKERQAEVRSYKNLMVADKMTSNKEIASTHKSLQELEEDFM

SEQ ID NO: 10461 - protein, 215 aa, Gossypium raimondii
MVFYFKARPEAGDYTIFMGLDKYENEELIKYGFPEDIWFHVDKMSSAHVYLRLQKGQTIDDISEGLLEDCAQLVKANSIQGNKVNNIDVVYTPWSNLKKTPSMDVGQVGFHNSKMVRTLRVEKRINEIVNRLNRTKVERTPDLKAEREAVNAAERAERKQHMREKKRREELERLEKERQAEIRSYKGLMVSEKMTSNKQIAETSKSLQELEEDFM

SEQ ID NO: 10462 - protein, 215 aa, Vitis vinifera
MVFYFKARPEAADYTIFMGLDKHENEELIKYGFPEDIWFHVDKMSSAHVYVRLHKGQTIDDISEGLLEDCAQLVKANSIQGNKVNNVDVVYTPWHNLKKTASMDVGQVGFYNSKMVRTVRVEKRINEIVNRLNRTKVERKPDLKAEREAVNAAERAERKLQLRDKKRREEMERLEKERQAEIRSYKGLMVSEKMTSNKQIASANKSLQELEDDFM

SEQ ID NO: 10463 - protein, 215 aa, Sarracenia psittacina
MVFYFKARPEAGDYTIFMGLDKHENEELIKYGFPEDIWFHIDKMSSAHVYVRLHKNQTIDDLSEGLLEDCAQLVKANSIQGNKVNNVDVVYTPWHNLKKTASMDVGQVGFHNSKMVRTVRVEKRINEIVNRLNRTKVERKPDLKAEREAVNAAERAERKQQLRDKKRREEMERLEKEKQAEIRSYKNLMVAEKMTSNKEIASANKSLQELEEDFM

SEQ ID NO: 10464 - protein, 215 aa, Gossypium raimondii
MVFYFKARPEAGDYTIFMGLDKYENEELIKYGFPEDIWFHVDKMSSAHVYLRLQKGQTIDDISEGLLEDCAQLVKANSIQGNKVNNIDVVYTPWSNLKKTPSMDVGQVGFHNSKMVRTLSVEKRINEIVNRLNRTKVERTPDLKAEREAVNAAERAERKQHMREKKRREELERLEKERQAEIRSYKGLMVSEKMTSNKQIAETSKSLQELEDDFM

SEQ ID NO: 10465 - protein, 215 aa, Aquilegia formosa
MVFYFKARPDVGDYTIFMGLDKHENEELIRYGFPEDIWFHVDKMSSAHVYVRLNKGQTIDDISEGLLEDCAQLVKANSIQGNKVNNVDVVYTPWYNLKKTASMDVGQVGFHNPKMVRTVKVEKRLNEVVNRLNKTKVERTPDLKAEREAIGAAERSEKKVQMRDKKRREEMERLEKEKLADIRSYKGLMVSEKMTSNKQIASENRSLQEMEEDFM

SEQ ID NO: 10466 - protein, 215 aa, Arnica chamissonis
MVFYFKARPEAGDYTIFMGLDKFENEELIKYGFPEDIWFHVDKMSSAHVYVRLRKGQTIDDISEGLLEDCTQLVKANSIQGNKVNNIDVVYTPWQNLKKTPSMDVGQVGFHNNKAVRTVRVEKRINEIVNRLNRTKVERKPDLKAEREAVNAAERAERKQLLRDKKRREEMERLEKERQAEVRSYKNLMVADKMTSNKEIASTHKSLQELEEDFM

SEQ ID NO: 10467 - protein, 215 aa, Beta vulgaris
MVFYFKARPEAGDFTIFMGLDKYENEELIKYGFPEDIWFHVDKMSSAHVYVRLHKGQSLDDISEALLEDCAQLVKANSIQGNKVNNIDVVYTPWANLKKTASMDVGQVGFHNSKMVRTVRVEKRINEIVNRLNRTKVERTPDFKAEREAYSAAEKAERKAHLREKKRREEMDRLEKERQAETRSYKNLMVSDKMTSNKQIASAEKSLQELEEDFM

SEQ ID NO: 10468 - protein, 215 aa, Vaccinium corymbosum
MVFYFKARPEAGDYTIFMGLDKFENEELIKYGFPEDIWFHVDKMSSAHVYVRLHKGQTIDDMSEGLLEDCAQLVKANSIQGNKVNNVDVVYTPWHNLKKTASMDVGQVGFHNSKMVRTVRVEKRINEIVNRLNRTKVERKPDLKAEREAVNAAERAERKQHLRDKKRREEMEKLEKERQAEVRSYKNLMVAEKMTSNKEIASANKSLQELEEDFM

SEQ ID NO: 10469 - protein, 215 aa, Castanea mollissima
MVFYFKARPEAGDYTIFMGLDKFENEELIKYGFPEDIWFHVDKMSSAHVYIRLHKGQTIDDISEGVLEDCVQLVKANSIQGNKVNNIDVVYTPWSNLKKTASMDVGQVGFHNPKMVRTVRVEKRINEIVNRLNRTKVERKPDLKAEREAVNAAERAERKLQLRDKKRREEMERLEKERQSELRSYKGLMVSENMTSNKQIATTSKSLQELEEDFM

SEQ ID NO: 10470 - protein, 215 aa, Cicer arietinum
MVFYFKARPEAGDYTIFMGLDKFENEELIKYGFIEDIWFHVDKMSSAHVYVRLHKGQTIDDMSEGLLEDCAQLVKANSIQGNKVNNVDVVYTPWSNLKKTASMDVGQVGFHNPKMVRTVRVEKKINEIVNRLNKTKVERKPDLKAEREAVNAAERAERKHQLREKKRREELERLEKEKQSELRSYKGLMVAENMTSNKDIASGSKSFQEVEEDFM

SEQ ID NO: 10471 - protein, 215 aa, Gossypium hirsutum
MVFYFKARPEAGDYTIFMGLDKYENEELIKYGFIEDIWFHVDKMSSAHVYLRLKKGQTIDDISEGVLEDCVQLVKANSIQGNKVNNIDVVYTPWSNLKKTPSMDVGQVGFHNSKMVRTVRVEKRINEIVNRLNKTKVERKPDLKAEKEAVYAAEKAERKQQLREKKRREEMQRLEKERQAEIRSYKGLMVSEKMTSNKQIAATSKSFQEVEEDFM

SEQ ID NO: 10472 - protein, 215 aa, Gossypium hirsutum
MVFYFKARPEAGDYTIFMGLDKYENEELIKYGFPEDIWFHVDKMSSAHVYLRLQKGQTIDDISEGLLEDCAQLVKANSIQGNKVNNIDVVYTPWSNLKKTPSMDVGQVGFHNSKMVRTLRVEKRINEIVNRLNRTKVERTPDLKAEREAVNAAERAERKQHMREKKRREELERLEKERQAEIRSYKGLMVSEKMTSNKQIAETSKSLQELEDDFM

SEQ ID NO: 10473 - protein, 215 aa, Cucumis sativus
MVFYFKARPDVGDYTIFMGLDKYENEELIKYGFIEDIWFHVDKMSSAHVYVRLQKGQTIDDISEGLLEDCAQLVKANSIQGNKVNNIDVVYTPWSNLKKTASMDVGQVGFHNPKMVRTVRVEKRINDIVNRLNRTKVERKPDLKAEREAVNAAERAERKQHLRDKKRREEMERLEKERQAELRSYKGLMVSEKMTSNKQIAATSKSLQELEDDFM

SEQ ID NO: 10474 - protein, 215 aa, Flaveria ramosissima
MVFYFKARAEAGDYTIFMGLDKFENEELIKYGFPEDIWFHVDKMSSAHVYVRLHKGQTIDDISEGLLEDCAQLVKANSIQGNKVNNIDVVYTPWQNLKKTPSMDVGQVGFHNNKAVRTVRVEKRINEIVNRLNRTKVERKPDLKAEREAVNAAERAERKQLLRDKKRREEMERLEKERQAEVRSYKNLMVADKMTSNKEIASTHKSLQELEEDFM

SEQ ID NO: 10475 - protein, 215 aa, Plantago ovata
MVFYFKARPEAGDYTIFMGLDKFENEELIKYGFPEDIWFHVDKMSSAHVYVRLHKGQSIDDISEGLLEDCVQLVKANSIQGNKVNNIDVVYTPWQNLKKTPSMDVGQVGFYNSKMVRTVRVEKRINEIVNRLNRTKVERKPDLKAEREAVNAAERAERKQQLRDKKRREELDRLEKERQAEMRSYKNLMVAEKMTSNKDIASANKSLQELEEDFM

SEQ ID NO: 10476 - protein, 215 aa, Populus trichocarpa
MVFYFKARPEAGDYTIFMGLDKYENEELIKYGFPEDIWFHVDKMSSAHVYVRLHKGQTIDDISEGVLEDCVQLVKANSIQGNKVNNIDVVYTPWANLKKTASMDVGQVGFHNSKMVRTVRVEKRLNEVVNRLNKTKVERKPDLKAEREAVNAAERAERKLLLRDKKRREEMERLEKERQTEIRSYKGLMVAEKMTSNKQIASENKSLQELEDDFM

SEQ ID NO: 10477 - protein, 215 aa, Glycine max
MVFYFKARPEAGDFTIFMGLDKFENEELIKYGFPEDIWFHVDKMSSAHVYVRLHKGQTLDDLSEALLEDCAQLVKANSIQGNKVNNVDVVYTPWSNLKKTASMDVGQVGFHNSKMVRTVRVEKRINEIVNRLNKTKVERKPDLKGEREAVGAAERAERKQQLREKKRREELERLEKEKQTELRSYKGLMVAENMTSNKQIASGSKSLQELEEDFM

SEQ ID NO: 10478 - protein, 215 aa, Helianthus annuus
MVFYFKARPEAGDYTIFMGLDKFENEELIKYGFPEDIWFHVDKMSSAHVYVRLRKGQTIDDISEGLLEDCAQLVKANSIQGNKVNNIDVVYTPWQNLKKTPSMDVGQVGFHNNKSVRTVRVEKRINEVVNRLNRTKVERKPDLKAEREAVNAAERAERKQLLRDKKRREEMERLEKERQAEVRSYKNLMVADKMTSNKEIASTQKSLQELEEDFM

SEQ ID NO: 10479 - protein, 215 aa, Trigonella foenum-graecum
MVFYFKARPEAGDYTIFMGLDKFENEELIKYGFIEDIWFHVDKMSSAHVYVRLHKGQTIDGMSEGLLEDCAQLVKANSIQGNKVNNVDVVYTPWSNLKKTASMDVGQVGFHNPKMVRTVRVEKKINEIVNRLNKTKVERKPDLKAEREAVAAAERAERKHQLREKKRREEMERLEKEKQSELRSYKGLMVAENMTSNKDIASGSKSFQEVEEDFM

SEQ ID NO: 10480 - protein, 61 aa, Linum usitatissimum
MVFYFKARPEVGDYTISWVSTSMKTRSSSNTASPKISGFMWTKCLQLMFMFGCTRVRLWTT

SEQ ID NO: 10481 - protein, 83 aa, Ambrosia trifida
MVFYFKARPEAGDYTIFMGLDKFENEELIKYGFPEDIWFHVDKMSSAHVYVRLHKGQTIDDISEGLLEDCAQLVKANSIQGIK

SEQ ID NO: 10482 - protein, 215 aa, Theobroma cacao
MVFYFKARPEAGDYTIFMGLDKYENEELIRYGFPEDIWFHVDKMSSAHVYLRLQKGQTIDDISEGVLEDCAQLVKANSIQGNKVNNIDVVYTPWSNLKKSASMDVGQVGFHNPKMVRTVRVEKRINEIVNRLNRTKVERKPDLKAEREAVNAAERAERKQQLREKKRCEELEKLEKERQAEIRSYKGLMVSEKMTSNKQIAETSKSLQELEEDFM

SEQ ID NO: 10483 - protein, 215 aa, Chenopodium quinoa
MVFYFKARPEAGDYTIFMGLDKFENEELIKYGFPEDIWFHVDKMSSAHVYVRLNRGQTMDSISEGLLEDCAQLVKANSIQGNKVNNIDVVYTPWANLKKTASMDVGQVGFHNSKMVRTVRVEKRINEVVNRLNRTKVERTPDFKAEREAYGAAEKAERKAQLREKKRREEMDRLEKERVAEMRSYKNLMVSDKMTSNKQIASGEKSLQELEEDFM

SEQ ID NO: 10484 - protein, 215 aa, Phaseolus vulgaris
MVFYFKARPESGDYTIFMGLDKFENEELIKYGFPEDIWFHVDKMSSAHVYVRLHRGQTIDGMSEGLLEDCAQLVKANSIQGNKVNNIDVVYTPWSNLKKTASMDVGQVGFHNSKMVRTVRVEKRINEIVNRLNKTKVERKPDLKAEREAVNAAERAERKQQLREKKRREELERLDKERQAELRSYKGLMVAENMTSNKHVASGSKSLQELEEDFM

SEQ ID NO: 10485 - protein, 215 aa, Cichorium intybus
MVFYFKARPEAGDYTIFMGLDKFENEELIKYGFPEDIWFHVDKMSSAHVYLRMRKGQTIDDISEGLLEDCAQLVKANSIQGNKVNNIDVVYTPWQNLKKTPSMDVGQVGFHNNKAVRTVRVEKRINEVVNRLNRTKVERKPDLKAEREAVNAAERAERKQQLRDKKRREEMERLEKERQAEVRSYKNLMVADKMTSNKEIASTHKSLQELEEDFM

SEQ ID NO: 10486 - protein, 215 aa, Cirsium arvense
MVFYFKARPEAGDYTIFMGLDKFENEELIKYGFPEDIWFHVDKMSSAHVYLRMRKGQTIDDISEGLLEDCAQLVKANSIQGNKVNNIDVVYTPWQNLKKTPSMDVGQVGFHNNKSVRTVRVEKRINEVVNRLNRTKVERKPDLKAEREAVNAAERAERKQQLRDKKRREEMERLEKERQAEVRSYKNLMVADKMTSNKDIASTHKSLQELEEDFM

SEQ ID NO: 10487 - protein, 215 aa, Cleome spinosa
MVFYFKARPEAGDYTIFMGLDKYENEELIKYGFPEDIWFHVDKMSSAHVYVRLHKGQTIDDISEGVLEDCAQLVKANSIQGNKVNNVDVVYTPWANLKKTASMDVGQVGFHNSKMVRTTRVEKRINEIVNRLNKTKVERKPDLKAEREAVNAAERAERKQHLREKKKREDMDRLEKERQAEIRSYKGLMVSEKMTSNKDIASSNKSLQELEEDFM

SEQ ID NO: 10488 - protein, 215 aa, Gossypium hirsutum
MVFYFKARPEAGDYTIFMGLDKYENEELIKYGFPEDIWFHVDKMSSAHVYLRLQKGQTIDDISEGLLEDCAQLVKANSIQGNKVNNIDVVYTPWSNLKKTSSMDVGQVGFHNSKMVRTLRVEKRINEIVNRLNRTKVERTPDLKAEREAVNAAERAERKQHMREKKRREELERLEKERQAEIRSYKGLMVSEKMTSNKQIAETSRSLQELEEDFM

SEQ ID NO: 10489 - protein, 215 aa, Euonymus alatus
MVFYFKARSEAGDYTIFMGLDKFENEELIKYGFPEDIWFHVDKMSSAHVYVRLHKGQTIDGISEGLLEDCAQLVKANSIQGNKVNNVDVVYTPWANLKKTASMDVGQVGFHNPKNVRTVRVEKRVNEIVNRLNKTKVERKPDLKAEREAVGSAERAERKLQQRDKKRREEMARLEKEKQAEIRSYKGLMVSENMTSNKDIASVNKSLQELEEDFM

SEQ ID NO: 10490 - protein, 215 aa, Euonymus alatus
MVFYFKARPEAGDYTIFMGLDKFENEELIKYGFPEDIWFHVDKMSSAHVYLRVHKGQTIDNISEGLLEDCVQLVKANSIQGNKVNNVDVVYTPWANLKKTASMDVGQVGFHNPKMVRTVRVEKRINEIVNRLNKTKVERKPDLKAEREAVGAAERAERKLQQRDKKRREEMERLEKERQAEVRSYKGLMVSEKMTSNKEIASGNKSLQELEDDFM

SEQ ID NO: 10491 - protein, 215 aa, Fagopyrum esculentum
MVFYFKARPEAGDYTIFMGLDKYENEELIKYGFPEDIWFHVDKMSSAHVYLRLQKYQSMDDIPEGVLEDCVQLVKANSIQGNKVNNIDVVYTPWSNLKKTPSMDVGQVGFYNSKMVRTVRVEKRINEIVNRLNRTKVERKPDLKAEREAYGNAEKAERKAQLRDKKRREDMDRLEKERQAEMRSYKNLMVSDKMTSNKQIASENKSLQELEEDFM

SEQ ID NO: 10492 - protein, 215 aa, Quercus alba
MVFYFKARPEAGDYTIFMGLDKFENEELIKYGFPEDIWFHVDKMSSAHVYIRLHKGQTIDDISEGVLEDCVQLVKANSIQGNKVNNIDVVYTPWSNLKKTASMDVGQIGFHNPKMVRTVRVEKRINEIVNRLNRTKVERKPDLKAEREAVNAAERAERKLQLRDKKRREEMERLEKERQSELRSYKGLMVSENMTSNKQIATTSKSLQELEEDFM

SEQ ID NO: 10493 - protein, 215 aa, Orobanche aegyptiaca
MVFYFKARPEAGDYTIFMGLDKHENEELIKYGFPEDIWFHVDKMSSAHVYVRLHKGQSIDDMSEGLLEDCVQLVKANSIQGNKVNNVDVVYTPWQNLKKTASMDVGQVGFHNSKMVRTVRVEKRINEIVNRLNKTKVERTPDLKAEREAVNAAERAERKLQLRDKKRREDIERIEKERQAELRSYKNLMVAEKMTSNKDIASTNKSLQELEEDFM

SEQ ID NO: 10494 - protein, 215 aa, Parthenium argentatum
MVFYFKARAEAGDYTIFMGLDKFENEELIKYGFPEDIWFHVDKMSSAHVYVRLQKGQTIDDISEGLLEDCAQLVKANSIQGNKVNNIDVVYTPWQNLKKTPSMDVGQVGFHNNKAVRTVRVEKRINEVVNRLNRTKVERKPDLKAEREAVNAAERAERKQLLRDKKRREEMERLEKERQAEVRSYKNLMVADKMTSNKEIASTQKSLQELEEDFM

SEQ ID NO: 10495 - protein, 215 aa, Populus trichocarpa
MVFYFKARPEAGDYTIFMGLDKHENEELIKYGFPEDIWFHVDKMSSAHVYLRLHKGQTIDGISEGVLEDCVQLVKANSIQGNKVNNIDVVYTPWANLKKTASMDVGQVGFHNSKMVRTVRVEKRINEIVNRLNKTKVERKPDLKAEREAVNAAERAERKLHLRDKKRREEMERLEKERQAEMRSYKGLMVAEKMTSNKQIASENKSLQELEDDFM

SEQ ID NO: 10496 - protein, 215 aa, Helianthus annuus
MVFYFKARPEAGDYTIFMGLDKFENEELIKYGFPEDIWFHVDKMSSAHVYVRLRKGQTIDDISEGLLEDCAQLVKANSIQGNKVNNIDVVYTSWQNLKKTPSMDVGQVGFHNNKAVRTVRVEKRINEVVNRLNRTKVERKPDLKAEREAVNAAERAERKQLLRDKKRREEMERLEKERQAEVRSYKNLMVADKMTSNKEIASTQKSLQELEEDFM

SEQ ID NO: 10497 - protein, 215 aa, Citrullus lanatus
MVFYFKARPDVGDYTIFMGLDKYENEELIKYGFIEDIWFHVDKMSSAHVYVRLHKGQTIDDISEGLLEDCAQLVKANSIQGNKVNNIDVVYTPWSNLKKTASMDVGQVGFHNPKMVRTVRVEKRINDIVNRLNRTKVERKPDLKAEREAVNAAERAERKQHLREKKRREEMERLEKERQAELRSYKGLMVSEKMTSNKQIAATSKSLQELEDDFM

SEQ ID NO: 10498 - protein, 81 aa, Fagopyrum esculentum
NRERLGKLRASRSLSPLLFSPLPKATKRIQENRRKKIQRDKMVFYFKARPEAGDYTIFMGLDKYENEELIKYGFPKTSGFM

SEQ ID NO: 10499 - protein, 215 aa, Unknown
  Sequence found in Organisms: Centaurea maculosa, Cirsium arvense, Carthamus tinctorius
MVFYFKARPESGDYTIFMGLDKFENEELIKYGFPEDIWFHVDKMSSAHVYLRMRKGQTIDDISEGLLEDCAQLVKANSIQGNKVNNIDVVYTPWQNLKKTPSMDVGQVGFHNNKAVRTVRVEKRINEVVNRLNRTKVERKPDLKAEREAVNAAERAERKQQLRDKKRREEMERLEKERQAEVRSYKNLMVADKMTSNKDIASTHKSLQELEEDFM

SEQ ID NO: 10500 - protein, 215 aa, Echinacea purpurea
MVFYFKARPEVGDYTIFMGLDKFENEELIRYGFPEDIWFHVDKMSSAHVYVRLHKGQTIDDISEGLLEDCAQLVKANSIQGNKVNNIDVVYTPWQNLKKTPSMDVGQVGFHNNKAVRTVRVEKRINEVVNRLNRTKVERKPDLKAEREAVNAAEREERKQLLRDKKRREEMERLEKERQAEIRSYKNLMVADKMTSNKEIASTHKSLQELEEDFM

SEQ ID NO: 10501 - protein, 215 aa, Chenopodium quinoa
MVFYFKARPEAGDYTIFMGLDKFENEELIKYGFPEDIWFHVDKMSSAHVYVRLHRGQSMDSISEGLLEDCAQLVKANSIQGNKVNNIDVVYTPWANLKKTASMDVGQVGFHNSKMVRTVRVEKRINEVVNRLNRTKVERTPDFKAEREAYGAAEKAERKALLREKKRREEMDRLEKERVAEMRSYKNLMVSDKMTSNKQIASGEKSLQELEEDFM

SEQ ID NO: 10502 - protein, 215 aa, Fagus grandifolia
MVFYFKARPEAGDFTIFMGLDKHENEELIKFGFPEDIWFHVDKMSSAHVYVRLHRGQTIDDISEGLLEDCVQLVKANSIQGNKVNNIDVVYTPWSNLKKTASMDVGQVGFHNPKMVRTVRVEKRINEIVNRLNRTKVERKADLKAEREAVNAAERAERKQQLRDKKRREEMDRLEKERQAELRSYKGLMVSENMTSNKQIAATSKSLQELEEDFM

SEQ ID NO: 10503 - protein, 215 aa, Cannabis sativa
MVFYFKARPEAGDYTIFMGLDKHENEELIKYGFPEDIWFHVDKMSSAHVYVRLHKGQTIDDISEGLLEDCAQLVKANSIQGNKVNNIEVVYTPWSNLKKTASMDVGQVGFYNSKMVRTVRVEKRINEIVNRLNRTKVERTPDLKAEREAVNAAERAERKLHLREKKRREEIERLEKERQAEMRSYKGLMVSENMTSNKQIASASKSLQELEEDFM

SEQ ID NO: 10504 - protein, 215 aa, Taraxacum officinale
MVFYFKARPEAGDYTIFMGLDKFENEELIKYGFPEDIWFHVDKMSSAHVYLRMRKGQTIDDISEGLLEDCVQLVKANSIQGNKVNNIDVVYTPWQNLKKTPSMDVGQVGFHNNKSVRTVRVEKRINEVVNRLNRTKVERKPDLKAEREAVNAAERAERKLQLRDKKRREEMERLEKERQAEVRSYKNLMVADKMTSNKEIASTHKSLQELEEDFM

SEQ ID NO: 10505 - protein, 215 aa, Guizotia abyssinica
MVFYFKARPEAGDYTIFMGLDKFENEELIKYGFPEDIWFHVDKMSSAHVYVRLRKGQTIDDISEGLLEDCAQLVKANSIQGNKVNNIDVVYTSWQNLKKTPSMDVGQVGFHNNKAVRTVRVEKRINEVVNRLNRTKVERKPDLKAEREAVNAAERAERKQLLRDKKRREEMERLEKERQAEVRSYKNLMVADKMTSNKEIAATHKSLQELEEDFM

SEQ ID NO: 10506 - protein, 215 aa, Humulus lupulus
MVFYFKARPEAGDYTIFMGLDKYENEELIKYGFPEDIWFHVDKMSSAHVYVRLHKGQTIDDISEGLLEDCAQLVKANSIQGNKVNNIEVVYTPWSNLKKTPSMDIGQVGFYNSKMVRSVRVEKRINEIVNRLNRTKVERTPDLKAEREAVNAAERAERKLHLREKKRREEMDRLEKERQAEMRSYKGLMVSENMTSNKQIASASKSLQELEEDFM

SEQ ID NO: 10507 - protein, 215 aa, Lactuca sativa
MVFYFKARPEAGDYTIFMGLDKFENEELIKYGFPEDIWFHVDKMSSAHVYLRMRKGQTIDDISEGLLEDCVQLVKANSIQGNKVNNIDVVYTPWQNLKKTPSMDVGQVGFHNNKAVRTVRVEKRINEVVNRLNRTKVERKPDLKAEREAVNAAERAERKQQLRDKKRREEMERLEKERQAEVRSYKNLMVADKMTSNKEIASTHKSLQELEEDFM

SEQ ID NO: 10508 - protein, 215 aa, Cucumis melo
MVFYFKARPDVGDYTIFMGLDKYENEELIKYGFIEDIWFHVDKMSSAHVYVRLQKGQTIDDISEGLLEDCAQLVKANSIQGNKVNNIDVVYTPWSNLKKTASMDVGQVGFHNPKMVRTVRVEKRINDIVNRLNRTKVERKPDLKAEREAVNAAERAERKQHLREKKRREELERLEKERQAELRSYKGLMVSEKMTSNKQIAATSKSLQELEDDFM

SEQ ID NO: 10509 - protein, 215 aa, Momordica charantia
MVFYFKARPDVGDYTIFMGLDKYENEELIKYGFPEDIWFHVDKMSSAHVYVRLQKGQTIDDISEGLLEDCAQLVKANSIQGNKVNNIDVVYTPWSNLKKTASMDVGQVGFHNPKMVRTVRVEKRINDIVNRLNRTKVERKPDLKAEREAVNAAERAERKQHLREKKRREELDRLEKERQAELRSYKGLMVSEKMTSNKQIAATSKSLQELEDDFM

SEQ ID NO: 10510 - protein, 215 aa, Tropaeolum majus
MVFYFKARPEAGDYTIFMGLDKHENEELIKYGFPEDIWFHVDKMSSAHVYVRLNKGQSIDGISEGLLEDCVQLVKANSIQGNKVNNIDVVYTPWSNLKKTASMDVGQVGFYNTKMVRTVRVEKRINEIVNRLNRTKVERKPDLKAEREAVNAAERAERKQLQREKKRREEMERLEKERQAEVRSYKGLMVSEKMTSNKDIASTNKSLQELEDDFM

SEQ ID NO: 10511 - protein, 215 aa, Pinus taeda
MVFYFKARPEAGDYTIFMGLDKFENEELIKYGFPEDIWFHVDKMSSAHVYLRMRKGQTIDDISEGLLEDCAQLVKANSIQGNKVNNIDVVYTPWQNLKKTPSMDVGQVGFHNNKAVRTVRVEKRINEVVNRLNRTKVERKPDLKAEREAVNAAERAERKQLLRDKKRREEMERLEKERQAEVRSYKNLMVADKMTSNKEIASTHKSLQELEEDFM

SEQ ID NO: 10512 - protein, 215 aa, Papaver somniferum
MVFYFKARPDVGDFTIFMGLDKHENEELIKYGFPEDIWFHVDKMSSAHVYVRMKKGQTIDDISEGLLEDCAQLVKANSIQGNKVNNVDVVYTPWYNLKKTASMDVGQIGFHNSKMVRTVRVEKRINEVVNRLNKTKVERTPDLKAEREAVNAAERAERKLQLRDKKRREEMERLDKERQAEIRSYKGLMVSEKMTSNKQIASASKSLQELEDDFM

SEQ ID NO: 10513 - protein, 215 aa, Rhizophora mangle
MVFYFKARPEAGDYTIFMGIDKYENEELIKYGFPEDIWFHVDKMSSAHVYVRLHKGQTLDDISEGLLEDCAQLVKANSIQGNKVNNVDVVYTPWSNLKKTASMDVGQVGFHNPKMVQTVGVEKRINEIVNRLNKTKFERNPDLKAEREAVNAAEKAKRKLQLREKKRQEEMEGLEKEKQTEIRSYKGLMVSEKMTTNKQIASANKSLQELEDDFM

SEQ ID NO: 10514 - protein, 215 aa, Sesamum indicum
MVFYFKARPEAGDYTIFMGLDKYENEELIKYGFPEDVWFHVDKMSSAHVYLRLNKGQTIDDIPEGVLEDCAQLVKANSIQGNKVNNVDVVYTPWQNLKKTASMDVGQVGFHNSKMVRTVRVEKRINEIVNRLNRTKVERKPDLKAEREAVNAAERAERKQQLRDKKRREELERLEKERQAELRSYKNLMVAEKMTSNKDIASANKSLQELEEDFM

SEQ ID NO: 10515 - protein, 215 aa, Tripterygium wilfordii
MVFYFKAHPDAGDYSIFMGLDKFENEELIKYGFPEDIWFHVDKMSSAHVYVRLHKGQTIDDISEGLLEDCAQLVKANSIQGNKVNNVDIVYTPWANLKKTASMDVGQVGFHNPKMVRTVRVEKRINEIVNRLNKTKVERKPDLKAEREAVGAAERAERKVQQRDKKRREEMDRLAKERQAEIRSYKGLMVSENMTSNKEIASGNKSLQELEEDFM

SEQ ID NO: 10516 - protein, 215 aa, Panax ginseng
MVFYFKARPEAGDYTIFMGLDKHENEELIKYGFPEDIWFHVDKMSSAHVYVRLHKGQTVDDISEGLLEDCAQLVKANSIQGNKVNNIDVVYTPWQNLKKTASMDVGQVGFHNPKMVRTVRVQKRINEVVNRLNKTKVERTPDLKAERESVNAAERAERKQLLRDKKRREELERLEKERQAELRSYKNLMVADKMTSNKDIASTQKSLQELEEDFM

SEQ ID NO: 10517 - protein, 215 aa, Amsonia hubrichtii
MVFYFKARPEAGDYTIFMGLDKFENEELIRYGFPEDIWFHVDKMSSAHVYLRLHKGQTIDDISEGVLEDCAQLVKANSIQGNKVNNVDVVYTPWHNLKKTASMDVGQVGFHNPKMVRTVKVEKRINEIVNRLNRTKVERKPDLKAEREAVNAADRAERKQHLRDKKRREEMERLEKERQAELRSYKNLMVADKMTSNKDIASTNKSLQELEEDFM

SEQ ID NO: 10518 - protein, 215 aa, Artemisia annua
MVFYFKARPEAGDYTIFMGLDKFENEELIKYGFPEDIWFHVDKMSSAHVYLRMRKGQTIDDISEGVLEDCVQLVKANSIQGNKVNNIDVVYTPWQNLKKTPAMDVGQVGFHNNKAVRTVRVEKRINEVVNRLNRTKVERKPDLKAERESVNAAERAERKLQLRDKKRREEMERLEKEKQAEVRSYKNLMVADKMTSNKEIASTHKTLQELEEDFM

SEQ ID NO: 10519 - protein, 215 aa, Cucurbita pepo
MVFYFKARPDVGDYSIFMGLDKYENEELIKYGFPEDIWFHVDKMSSAHVYVRLQKGQTIDDISEGLLEDCAQLVKANSIQGNKVNNIDVVYTPWSNLKKTASMDVGQVGFYNPKMVRTVRVEKRINDIVNRLNRTKVERKPDLKAEREAVNAAERAERKQHLREKKRREELERLEKERQAELRSYKGLMVSEKMTSNKQIAATSKSLQELEDDFM

SEQ ID NO: 10520 - protein, 215 aa, Papaver somniferum
MVFYFKARPDVGDFTIFMGLDKHENEELIKYGFPEDIWFHVDKMSSAHVYVRMKRGQTIDDISEGLLEDCAQLVKANSIQGNKVNNVDVVYTPWYNLKKTASMDVGQIGFHNSKMVRTVRVEKRINEVVNRLNKTKVERTPDLKAEREAVNAAERAERKLQLRDKKRREEMERLDKERQAEIRSYKGLMVSEKMTSNKQIASASKSLQELEDDFM

SEQ ID NO: 10521 - protein, 215 aa, Sequoia sempervirens
MVFYFKARPEAGDYTIYMGLDKHENEELIKYGIPEDIWFHVDKLSSAHVYVRMHKGQTIDDITEPLLEDCAQLVKANSIQGNKTNNLDVVYTPWSNLRKTASMDVGQVGFHNPKNVRTVRVEKRINEIVNRLNKTKVERKPDLKAEREAMNAAERAERKVQLREKKRREELDRLEKEKQAEIRSYKGLMVAEKMTSNKDIASGSKSLQELEEDFM

SEQ ID NO: 10522 - protein, 181 aa, Allium cepa
MVFYFKARPEVGDYTIFMGLDKHENEELIKYGFQEDIWFHVDKMSSAHVYLRMNKGQTIDDISEGLLEDCAQLVKANSIQGNKVNNVDVVYTPWYNLKKTPSMEVGQVGFHNSKMVRTVRVEKRINEIVNRLNKTKVERTPDLKAEKEAVFAAEKAVRKQQLREKKKGKRWTGLKRRNKQK

SEQ ID NO: 10523 - protein, 215 aa, Panax ginseng
MVFYFKGRPEAGDYTIFMGLDKHENEELIKYGFPEDIWFHVDKMSSAHVYVRLHKGQTVDDISEGLLEDCAQLVKANSIQGNKVNNIDVVYTPWQNLKKTASMDVGQVGFHNPKMVRTVRVEKRINEVVNRLNKTKAERTPDLKAEREAVNAAERAQRKQQLRDKKRREEIERLEKERQAELRSYKNLMVADKMTSNKDIAATQKSLQELEEDFM

SEQ ID NO: 10524 - protein, 215 aa, Panax ginseng
MVFYFKGRPEAGDYTIFMGLDKHENEELIKYGFPEDIWFHVDKMSSAHVYVRLHKGQTVDDISEGLLEDCAQLVKANSIQGNKVNNIDVVYTPWQNLKKTASMDVGQVGFHNPKMVRTVRVEKRINEVVNRLNKTKVERTPDLKAELEAVNAAERAQRKQQLRDKKRREEIERLEKERQAELRSYKNLMVADKMTSNKDIAATQKSLQELEEDFM

SEQ ID NO: 10525 - protein, 215 aa, Medicago truncatula
MVFYFKARPEAGDYTIFMGLDKFENEELIKYGFIEDIWFHVDKMSSAHVYVRLHKGQTIDDMSEGLLEDCAQLVKANSIQGNKVNNVDVVYTPWSNLKKTASMDVGQVGFHSSKMVRTVRVEKKINEIVNRLNKTKVERKPDLKAEREAVAAAERAERKHQLREKKRREEIDRLEKEKQSELRSYKGLMVAENMTSNKDIASGSRSFQEVEEDFM

SEQ ID NO: 10526 - protein, 215 aa, Carica papaya
MVFYFKARPEAGDYTVFMGLDKYENEELIKYGFPEDIWFHVDKMSSAHVYLRLHKGQTIDDISEGVLEDCAQLVKANSIQGNKVNNIDVVYTPWSNLKKTAAMDVGQVGFHNSKMVRTVRVEKRINEVVNRLNRTKVERKPDLKAEREAVNAAERAERKQHLREKKRREEMERMEKERQAEIRSYKGLMVAEKMTSNKEIASANKSLQELEDDFM

SEQ ID NO: 10527 - protein, 215 aa, Unknown
  Sequence found in Organisms: Prunus persica, Prunus mume
MVFYFKARSEVGDYTIFMGLDKFENEELIKYGFPEDIWFHVDKMSSAHVYVRLHKGQTIDGISEGLLEDCAQLVKANSIQGNKVNNVDVVYTPWSNLKKTASMDVGQVGFYNSKMVRTVRVEKRINEVVNRLNRTKVERKPDLKAEREAVNAAERAERKQLLRDKKRREEMERLEKERQAELRSYKGLMVSENMTSNKQIASANKSLQELEEDFM

SEQ ID NO: 10528 - protein, 215 aa, Sciadopitys verticillata
MVFYFKARPEAGDYTIYMGLDKHENEELIKYGIPEDIWFHVYKLSSAHVYLRLHKGQTIDAITEPLLEDCAQLVKANSIQGNKVNNLDVVYTPWSNLRKTAAMDVGQVGFHNSKLVRTVRVEKRINEVVNRLNKTKVERKPDLKAEREAINAAERAERKTQLREKKRREELERLEKEKQAEIRSYKGLMVSEKMTSNKDIASGSKTFQELEEDFM

SEQ ID NO: 10529 - protein, 215 aa, Tabernaemontana elegans
MVFYLKARPEAGDYTIFMGLDKYENEELIKYGFPEDIWFHVDKMSSAHVYLRLHKGQTIDDIPEGVLEDCAQLVKANSIQGNKVNNIDVVYTPWHNLKKTASMDVGQVGFHNSKMVRTVRVEKRINEIVNRLNRTKVERNPDLKAEREAVNAAERAERKQQLRDKKRREEMERLDKERQAELRSYKNLMVADKMTSNKDIASANKSLQELEEDFM

SEQ ID NO: 10530 - protein, 215 aa, Tragopogon dubius
MVFYFKARPESGDYTIFMGLDKFENEELIKYGFPEDIWFHVDKMSSAHVYLRMRKGQTIDDISEGLLEDCAQLVKANSIQGNKVNNIDVVYTPWQNLKKTPSMDVGQVGFHNNKAVRTVRVEKRINEVVNRLNRTKVERKPDLKAEREAVNAAERAERKQLLRDKKRREEMERMEKERQAEVRSYKNLMVADKMTSNKEIASTQKSLQELEEDFM

SEQ ID NO: 10531 - protein, 215 aa, Panax ginseng
MVFYFKGRPEASDYTIFMGLDKHENEELIKYGFPEDIWFHVDKMSSAHVYVRLHKGQTVDDISEGLLEDCAQLVKANSIQGNKVNNIDVVYTPWQNLKKTASMDVGQVGFHNPKMVRTVRVEKRINEVVNRLNKTKVERTPDLKAELEAVNAAERAQRKQQLRDKKRREEIERLEKERQAELRSYKNLMVADKMTSNKDIAATQKSLQELEEDFM

SEQ ID NO: 10532 - protein, 215 aa, Bupleurum chinense
MVFYFKARPEVGDYTIFMGLDKHENEELIKYGFPEDIWFHVDKMSSAHVYVRLHKGQGIDDISEGLLEDCVQLVKANSIQGNKVNNIDVVYTPWQNLKKTASMDVGQVGFHNSKMVRTVRVEKRINEVVNRLNKTKVERTPDLKAEREAVNAAERAERKQQLRDKKRREEIARMEKERQAELRSYKNLMVADKMTSNKEIASTQKSLQELEEDFM

SEQ ID NO: 10533 - protein, 222 aa, Manihot esculenta
MVFYFKARPEVGDYTIFMGLDKYENEELIKYGFPEDIWFHVDKMSSAHVYLRLHKGQTIDDISEGLLEDCAQLVKANSIQGKISEKNLHIVNNIDVVYTPWSNLKKTASMDVGQVGFHNPKMVRTVRVEKRINEIVNRLNRTKVERRPDLKAEKEAIHAAERAERKLQLRDKKRREEVERLEKERQAEIRSYKGLMVSEKMTSNKQIAAENKSLQELEEDFM

SEQ ID NO: 10534 - protein, 215 aa, Nicotiana benthamiana
MVFYFKARPESGDYTIFMGLDKYENEELIKYGFPEDIWFHVDKMSSAHVYLRLNKGQTFDDIPESVLEDCAQLVKANSIQGNKVNNVDVVYTPWQNLKKTASMDVGQVSFHNPKMVRTVKVEKRINEIVNRLNRTKVERKPDLKAEREAVNAAERAERKQQLREKKRREDMDRLEKERQAEMRSYKNLMVADKMTSNKDIASTNKSLQELEEDFM

SEQ ID NO: 10535 - protein, 215 aa, Phalaenopsis aphrodite
MVLYFKARPEVGDYTIYMGLDKHENEELIKYGFPEDIWFHVDKMSSAHVYLRLNKSQTIDDISEGLLEDCAQLVKANSIQGNKANNVDVVYTPWYNLKKTPSMDVGQVGFHNSKMVRTVRVEKRVNEIVNRLNKTKVERNPDLKAEREAVNAAERAEKKQLLREKKRREEMERLEKERQTELRSYKGLMVSEKMTSNKQIASTNKSLQELEEDFM

SEQ ID NO: 10536 - protein, 215 aa, Lippia dulcis
MVFYFKARPEAGDYTIYMGLDKYENEELIKYGFPEDVWFHVDKMSSAHVYLRLHKGQTFDDIPEGVLEDCVQLVKANSIQGNKVNNIDVVYTPWQNLKKTASMDVGQVGFHNSKMVRTVRVEKRINEIVNRLNKTKVERTPDLKAEREAVNAAERAERKQQLRDKKRREELERLEKERQTELRSYKNLMVTEKMTSNKDIASGTKSVQELEEDFM

SEQ ID NO: 10537 - protein, 204 aa, Platanus occidentalis
MVFYFKARPDAGDYTIFMGLDKDENEELIKYGFPEDIWFHVDKMSSAHVYLRLNKGQTIDDISEGLLEDCAQLVKANSIQGNKVNNIDVVYTPWYNLKKTASMDVGQVGFHNPKMVKTVRVEKRINEIVNRLNKTKVERKPDLKAEREAINVAERAERKLHLRDKKRREEMERLEKEKQAEIRSYKGLLVSEKMTSNKQIAATS

SEQ ID NO: 10538 - protein, 215 aa, Lupinus angustifolius
MVFYFKARSEAGDYTIFMGLDKHENEELIRYAFPEDIWFHVDKMSSAHVYVRLHKGQTIDDISEGLLEDCVQLVKANSIQGNKVNNIDVVYTPWSNLKKTPSMDVGQVGFHNSKMVRTVRVEKRLNEIVNRLNKTKVERKPDLKAEREAVNATERTEKKLHLREKKRREDLEVLEKEKQAEMRSYKGLMVSENMISNKQIASGSKSLQELEEDFM

SEQ ID NO: 10539 - protein, 215 aa, Cephalotaxus harringtonia
MVFYFKARPEAGDYTIYMGLDKHENEELIKYGIPEDIWFHVDKLSSAHVYLRMRKGQTIDDITEPLLEDCAQLVKANSIQGNKVNNLDVVYTPWSNLRKTASMDVGQVGFHNQKNVRTVRVEKRINEVVNRLNKTKVERKPDLKAEREAMNAAERAERKVHLREKKRREELERLEKEKQAEVRSYKGLMVAEKMTSNKDIASGSKSLQELEEDFM

SEQ ID NO: 10540 - protein, 215 aa, Curcuma longa
MVFYFKARPDVGDYTIFMGLDKHENEELIKYGFPEDIWFHVDKMSSAHVYLRLNKAQTIDDISEGLLEDCIQLVKANSIQGNKMNNVDVVYTPWYNLKKTPSMDVGQVGFHNPKMVKTVRVEKRMNEIVNRLNKTKVERTPDLKAERESVNAAERAERKAQSRDKKKREELERLEKEKQAEVRSYKSLMVSEKMTSNKQIASANKSLEELEDDFM

SEQ ID NO: 10541 - protein, 215 aa, Euphorbia peplus
MVFYFKARPEVGDYTIFMGLDKFENEELIKYGFPEDIWFHVDKMSSAHVYLRLNKGQTIDDISESLLEDCAQLVKANSITGNKVNNIDVVYTPWNNLKKTASMDVGQVGFYNPKMVRTVRVEKRLNDVVNRLNRTKVERKPDLKAEKEAVHAAERAERKLLLRDKKRREDMERMEKERQAEIRSYKGLMVSEKMTSNKDIASGTKSLQELEDDFM

SEQ ID NO: 10542 - protein, 215 aa, Nicotiana benthamiana
MVFYFKARSESGDYTIFMGLDKYENEELIKYGFPEDIWFHVDKMSSAHVYLRLNKGQTFDDIPEGVLEDCAQLVKANSIQGNKVNNVDIVYTPWQNLKKTASMDVGQVSFHNPKMVRTVKVEKRINEIVNRLNRTKVEKKPDLKAEREAVNAAERAERKQQLREKKRREEMDRLEKERQAEMRSYKNLMVADKMTSNKDIASTNKSLQELEEDFM

SEQ ID NO: 10543 - protein, 215 aa, Capsicum annuum
MVFYFKARPEAGDYTIFMGLDKYENEELIKYGFPEDIWFHVDKMSSAHVYLRLNKGQTFDDIPEGVLEDCAQLVKANSIQGNKVNNVDIVYTPWQNLKKTASMDVGQVSFHNPKMVRTVRVEKRINEIVNRLNRTKVERKPDLKAEREAVNAAERAERKQQLREKKRREDMDRLEKERQAEMRSYKNLMVADKMTSNKDVASANKSLQELEEDFM

SEQ ID NO: 10544 - protein, 215 aa, Unknown
  Sequence found in Organisms: Rosa hybrid cultivar, Fragaria vesca
MVFYFKARPEVGDFTIFMGLDKFENEELIKYGFPEDIWFHVDKMSSAHVYVRLHKGQTIDDISEGLLEDCVQLVKANSIQGNKVNNIDVVYTPWSNLKKTASMDVGQVGFYSSKMVRTVRVEKRINEIVNRLNRTKVERKPDLKAEREAVNSAERDERKRFLREKKRREELERLEKEKQAELRSYKGLMVHENMTSNKQIASANKSLQELEEDFM

SEQ ID NO: 10545 - protein, 215 aa, Euphorbia esula
  misc_feature (192)..(193): Xaa can be any naturally occurring amino acid
MVFYFKARPEVGDYTIFMGLDKFENEELIKYGFPEDIWFHVDKMSSAHVYLRLNKGQTIDDISEGLLEDCAQLVKANSIQGNKVNNIDVVYTPWNNLKKTASMDVGQVGFYNPKMVRTVRVEKRLNDVVNRLNRTKVERKPDLKAEKEAVHAAERAERKLLLRDKKRREDMERMEKERQAEIRSYKGLMVSXXMTSNKDIASGTKSLQELEDDFM

SEQ ID NO: 10546 - protein, 180 aa, Lippia dulcis
MVFYFKARPEAADYTIFMGLDKYENEELIKYGFPEDIWFHVDKMSSAHVYLRLQKGQTIDDIPEGVLEDCAQLVKANSIQGNKVNNVDVVYTPWQNLKKTASMDVGQVGFHSSKAVRTIRVEKRINEIVNRLNRTKVERTPDLKAEREAVNAAERAERKQQLRRKKTTRRFRKAGEREAS

SEQ ID NO: 10547 - protein, 215 aa, Antirrhinum majus
MVFYFKARPEAGDYTIFMGLDKYENEELIKYGFVEDIWFHVDKMSSAHVYLRLHKGQTIDNIPEDVLEDCAQLVKANSIQGNKVNNVDVVYTPWQNLKKTASMDVGQVGFYNSKMVRTVRVEKRINEIINRLNKTKVERTPDLKAEREAVNAAERAERKQLLRDKKRREELDRLEKEKQADLRSYKNLMVAEKMTSNKDIASTNKSLQELEEDFM

SEQ ID NO: 10548 - protein, 211 aa, Aquilegia formosa
MVFYFKARPEVGDYTIFMGIDKHENEDLIKYGFPEDIWFHVDKMSSAHVYVRLNKGQAIDNISEGLLEDCAQLYLAGNKVNNVDVVYTPWYNLKKTASMDVGQVGFHNSKMVRTVRVEKRINEIVNRLNKTKVERKPDLKAEREAVNAAERAEKKLLMRDKKRREEMERLERERQAEIRSYKGLMVAEKMTSNKQVASANKSLQELEDDFM

SEQ ID NO: 10549 - protein, 215 aa, Cucurbita pepo
MVFYFKARSDVGDYTIFMGLDKHENEELIKYGFPEDIWFHVDKMSSAHVYVRLRRGQTIDDISEGLLEDCVQLVKANSIQGNKVNNIDVVYTPWANLKKTASMDVGQVGFHNPKMVRTVRVEKRINDIVNRLNRTKVERKPDLKAEREAVNAAERAERKQHLREKKRREEMDRLEKERQAELRSYSGLMVSEKMTSNKQIAAANKSLQELEDDFM

SEQ ID NO: 10550 - protein, 215 aa, Eucalyptus grandis
MVFYFKARPEAGDYTIFMGLDKYENEELIKYGFPEDIWFHVDKMSSAHVYLRMHKCQTIDDISEGVLEDCAQLVKANSIQGNKVNNVDVVYTPWANLKKTASMDVGQVGFHSSKMVRTVRVEKRLNDVVNRLNRTKVERKPDLKAEREAVNAAERAERKLQLRDKKRREEMDRMEKERQAELRSYKGLMVAENMTSNKQIASASKSLQELEDDFM

SEQ ID NO: 10551 - protein, 215 aa, Solanum phureja
MVFYFKARPEAGDYTIFMGLDKYENEELIKFGFPEDIWFHVDKMSSAHVYLRLNKGQTFDDIPEGVLEDCAQLVKANSIQGNKVNNVDVVYTPWQNLKKTASMDVGQVSFHNPKMVRTVRVEKRINEIVNRLNRTKVERKPDLKAEREAVNAAERAERKQQLREKKRREDMDRLEKERQAEMRSYKNLMVADKMTSNKDVASANKSLQEMEEDFM

SEQ ID NO: 10552 - protein, 215 aa, Solanum lycopersicum
MVFYFKARPETGDYTIFMGLDKYENEELIKFGFPEDIWFHVDKMSSAHVYLRLNKGQTFDDIPEGVLEDCAQLVKANSIQGNKVNNVDVVYTPWQNLKKTASMDVGQVSFHNPKMVRTVRVEKRINEIVNRLNRTKVERKPDLKAEREAVNAAERAERKQQLREKKRREDMDRLEKERQAEMRSYKNLMVADKMTSNKDIASANKSLQEMEEDFM

SEQ ID NO: 10553 - protein, 215 aa, Triphysaria pusilla
MVFYFKARPDAGDYTIYMGLDKHENEELIRYGFPEDIWFHVDKMSSAHVYVRLHKGQTIDDISEGLLEDCVQLVKANSIQGNKVNNIDVVYTPWQNLKKTASMDVGQVGFHNSKMVRTVRVEKRVNEIVNRLNKTKVERTPDLKAEREAVNAAERAQRKQLLRDKKRREELDRLEKERQAEVRSYKNLMVAEKMTSNKDIASANKSLQELEEDFM

SEQ ID NO: 10554 - protein, 215 aa, Eutrema parvulum
MVFYFKARPDAGDYTIFMGLDKFENEELIKYGFPEDVWFHVDKMSSAHVYLRLHKGQSFDDISEGVLEDCAQLVKANSIQGNKVNNVDVVYTPWCNLKKTASMDVGQVGFHNSKMVRTIRVEKRVNEIVNRLNKTKVERTPDLRAEREAVNAAERAERKQHLREKKKREEIERLEKERQAEMRSYKGLMVTDKMTSNKDIASSNKSLQELEDDFM

SEQ ID NO: 10555 - protein, 215 aa, Malus domestica
MVFYFKARSDVGDFTIFMGLDKFENEELIKYGFPEDIWFHVDKMSSAHVYVRLHKGQTIDDISEGLLEDCAQLVKANSIQGNKVNNVDVVYTPWSNLKKSASMDVGQVGFYNSKNVRTVRVEKRINEVVNRLNRTKVERKPDLKAEREAVNAAERAERKQFLRDKKRREEMERLEKERQLELRSYKGLMNSENMTSNKQIASTNKSLQELEEDFM

SEQ ID NO: 10556 - protein, 215 aa, Gnetum gnemon
MVFYFKTRPDAGDYIIYMGLDKHENEELIKYGLPEDIWFHVDKMSSAHVYLRMHKGQTMDDISPELLEDCAQLVKANSIQGNKMNNIDVVYTPWSNLRKTASMDVGQVGFHNSKLVRTVKVEKRINEIVNRLNKTKIEKKPDLKAEREAINAAERAERKAQLREQKRREELERLEKERQAEIRSYKGFMVADKMTSNKDIASGSKTFQEIEDDFM

SEQ ID NO: 10557 - protein, 215 aa, Mimulus guttatus
MVFYFKARPEAGDYTIFMGLDKYENEELIKYGFPEDIWFHVDKMSSAHVYLRLHKGQTIDDISEGVLEDCVQLVKANSIQGNKVNNVDVVYTPWQNLKKTPSMDVGQVGFYSSKMVRTVRVEKRVNEIVNRLNRTKVERTPDLKAEREAVNAAERAERKQQLRDKKRREDLDKLEKERQAELRSYKNLMVAEKMTSNKDIASANKSLQELEEDFM

SEQ ID NO: 10558 - protein, 215 aa, Solanum tuberosum
MVFYFKARPEAGDYTIFMGLDKYENEELIKFGFPEDIWFHVDKMSSAHVYLRLNKGQTFDDIPEGVLEDCAQLVKANSIQGNKVNNVDVVYTPWQNLKKTASMDVGQVSFHNPKMVRTVRVEKRINEIVNRLNRTKVERKPDLKAEREAVNAAERAERKQQLREKKRREDMDKLEKERQAEMRSYKNLMVADKMTSNKDVASANKSLQEMEEDFM

SEQ ID NO: 10559 - protein, 161 aa, Zostera marina
MVFYFKALPTLGDYTIFMGLDKHENEDLIKYGFPEDIWFHVDKMSSAHVYLRLHKCQTIDDISEGLLDDCAQLVKANSIQGNKVNNIDVVYTPWFNLKKTTSMDVGQVGFHNSKMVRTVRVVKRLNDTVNRLNKTKVERKPDLKAEREAVNAAEKAERNFN

SEQ ID NO: 10560 - protein, 215 aa, Brassica rapa
MVFYFKARPDAGDYTIFMGLDKFENEELIKYGFPEDVWFHVDKMSSAHVYLRLHKGQGFDDISEGVLEDCAQLVKANSIQGNKVNNVDVVYTPWSNLKKTASMDVGQVGFHNSKMVRTIRVEKRVNDIVNRLNKTKVERTPDLRAEREAVNAAERAERKEHLREKKKREDIERLEKEKQADMRSYKGLMVTDKMTSNKDIASSNKSLQELEDDFM

SEQ ID NO: 10561 - protein, 215 aa, Distylium racemosum
MVFYFQARPEAGDYTIYMGLDKHENEELIKYGFPEDVWFHVDKLSSAHVYLRMHKGQTIDDITEPLLEDCAQLVKANSIQGNKVNNIDIVYTPWSNLRKTPAMDVGQVGFYNAKLVKTARVEKRINEVVNRLNKTKVERKPDFKAEKEAIAAAERAERKAQVREKKRREELERLEKEKQSEIRSYKGLMVADKMTSNKEIASGSKSLQELEEDFM

SEQ ID NO: 10562 - protein, 215 aa, Silene vulgaris
MVFYFKARPEAGDYTIFMGLDKHENEELIKYGVPEDIWFHVDKMSSAHVYVRLHKGQTMDAISEGLLEDCVQLVKANSIQGNKLNNIDIVYTPWANLKKTPSMDVGQVGFHNSKMVRTVRVEKRINEVVNKLNRSKVERTVDFKAEREAYNNAEKAERKAVLREKKRREEMERLEKERQAEQRSYKNLMVSDKMTSNKDIASANKSLQELEEDFM

SEQ ID NO: 10563 - protein, 215 aa, Eutrema halophilum
MVFYFKARPDAGDYTIFMGLDKFENEELIKYGFPEDVWFHVDKMSSAHVYLRLHKGQSFDDISEGVLEDCAQLVKANSIQGNKVNNVDVVYTPWCNLKKTASMDVGQVGFHNSKMVRTIRVEKRVNEIVNRLNKTKVERTPDLRAEREAVNAAERAERKQHLREKKKREEIDRLEKERQAEMRSYKGLMVTDKMTSNKDIASSNKSLQELEDDFM

SEQ ID NO: 10564 - protein, 220 aa, Panax ginseng
GVLLQSPPGSRRLHHFHGSRQARERRAHQIRLPRRHLDFFYRRFHVDKMSSAHVYVRLHKGQTVDDISEGLLEDCAQLVKANSIQGNKVNNIDVVYTPWQNLKKTASMDVGQVGFHNPKMVRTVRVEKRINEVVNRLNKTKVERSPDLKAERESVNAAERAERKQLLRDKKRREELERLEKERQAELRSYKNLMLADKMTSNKDIASTQKSLQELEEDFM

SEQ ID NO: 10565 - protein, 191 aa, Valeriana officinalis
MVFYFKARPDCGDYTIFMGLDKFENEELIKYGFVEDIWFHVDKMSSAHVYVRLHKGQTIDDISEGLLEDCAQLVKANSIQGNKVNNVDVVYTPWQNLKKSASMDVGQVGFHNSKMVHTVRVEKRINEVVNRLNKTKVERTPDLQAEREAVTAAERADRKLQLRDKKRREDVERMEKEKQSRYEKLQKLDGG

SEQ ID NO: 10566 - protein, 215 aa, Gossypium raimondii
MVFYFKSQPKADDYTNFMGLDKYENEELIKYGFIEDIWFHVDKMSSAHVYLRLKKGQTIDDISEGVLEDCAQLVKANSIQGNKVNNIDVVYTPWSNLKKTPSMDVGQVGFHNSKMVRTVRVEKRINEIVNRLNKTKVERKPDLKAEKEAVYAAEKAERKQQLREKKRREEMQRLEKKREVEIRSYEDLMVSEKMTSNKQIAATSKSFQEVEQDFM

SEQ ID NO: 10567 - protein, 215 aa, Brassica juncea
MVFYFKARPDAGDYTIFMGLDKFENEELIKYGFPEDVWFHVDKMSSAHVYLRLHKGQGFDDISEGVLEDCAQLVKANSIQGNKVNNVDVVYTPWSNLKKTASMDVGQVGFHNSKMVRTIRVEKRVNEIINRLNKTKVERTPDLRAEREAVNAAERAERKQHLREKKKREDIERLEKERQADMRSYKGLMVTDKMTSNKDIASSNKSLQELEDDFM

SEQ ID NO: 10568 - protein, 215 aa, Brassica juncea
MVFYFKARPDAGDYTIFMGLDKFENEELIKYGFPEDVWFHVDKMSSAHVYLRLHKGQGFDDINEGVLEDCAQLVKANSIQGNKVNNVDVVYTPWSNLKKTASMDVGQVGFHNPKMVRTIRVEKRVNDIVNRLNKTKVERTPDLRAEREAVNAAERAERKQHLREKKKREEIERLEKERQAEMRSYKGLMVTDKMTSNKDIASSNKSLQELEDDFM

SEQ ID NO: 10569 - protein, 215 aa, Panax ginseng
MVFYFKGRPEAGDYTIFMGLHKHQNEEIIKYGFPQDIWFHVDKMSSPHVYVRLHKGHTADDISEGLMEDCAQLVKANSIQGNKVNNIDVVYTPWQNLKKTASMDVGQVGFHNPKMVRTVRVEKRINEVVNRLNKTKVERTPDLKAEREAVNAAERAQRKQQLRDKKRREEIERLEKERQAELRSYKNLMVADKMTSNKDIAATQKSLQELEEDFM

SEQ ID NO: 10570 - protein, 215 aa, Eutrema parvulum
MVFYFKARPDAGDYTIFMGLDKFENEELIKYGFPEDVWFHVDKMSSAHVYLRLHKGQGFDDISEGVLEDCAQLVKANSIQGNKVNNVDVVYTPWSNLKKTASMDVGQVGFHNSKMVRTIRVEKRVNDIVNRLNKTKVERTPDLRAEREAVNAAERAERKQHLREKKKREEIERLEKERQAEMRSYKGLMVTDKMTSNKDIASSNKSLQELEDDFM

SEQ ID NO: 10571 - protein, 215 aa, Vinca minor
MVFYFKARPDAGDYTIFMGLDKHENEELIKYGFPEDVWFHVDKMSSAHVYLRLNKGQTIDDIPEGVLEDCVQLVKANSIQGNKVNNVDVVYTPWNNLKKTASMDVGQVGFYNSKMVRTVRVEKRINEIVNRLNRTKVERTPDLKAEREAVNAAERAERKQHLRDKKRREEMERLEKERQAELRSYKNLMKADKMTSNKDIAAANKSLQELEEDFM

SEQ ID NO: 10572 - protein, 214 aa, Vinca minor
VFYFKAQPDAGDYTIFMGLDKHENEELIKYGFPEDVWFHVDKMSSAHVYLRLNKGQTIDDIPEGVLEDCVQLVKANSIQGNKVNNVDVVYTPWNNLKKTASMDVGQVGFYNSKMVRTVRVEKRINEIVNRLNRTKVERTPDLKAEREAVNAAERAERKQQLRDKKRREDMERLEKERQAELRSYKNLMVVDKMTSNKDIASANKSLQELEEDFM

SEQ ID NO: 10573 - protein, 198 aa, Antirrhinum majus
  misc_feature (45)..(45): Xaa can be any naturally occurring amino acid
  misc_feature (117)..(117): Xaa can be any naturally occurring amino acid
  misc_feature (143)..(143): Xaa can be any naturally occurring amino acid
  misc_feature (151)..(151): Xaa can be any naturally occurring amino acid
  misc_feature (164)..(164): Xaa can be any naturally occurring amino acid
  misc_feature (185)..(185): Xaa can be any naturally occurring amino acid
  misc_feature (189)..(189): Xaa can be any naturally occurring amino acid
MGLDKFENEELIKFGFPEDIWFHVDKMSSAHVYVRLHKGQTIDDXSEGLLEDCAQLVKANSIQGNKVNNVDVVYTPWQNLKKTASMDVGQVGFYNSKMVRTVRVEKRINEIVNRLNXTKVERKPDLKAEREAVNAAERAQRKXLLRDKKRXEDLERLEKERQAXMRSYKNLMVAEKMTSNKDIAXTNKXLQELEEDFM

SEQ ID NO: 10574 - protein, 215 aa, Unknown
  Sequence found in Organisms: Arabidopsis thaliana, Arabidopsis lyrata
MVFYFKARPDAGDYTIFMGLDKFENEELIKYGFPEDVWFHVDKMSSAHVYLRLHRGQSFDDISEGVLEDCAQLVKANSIQGNKVNNVDVVYTPWSNLKKTASMDVGQVGFHNSKMVRTIRVEKRVNEIVNRLNKTKVERTPDLRAEREAVNAAERAERKQHLREKKKREEIDRLEKERQSEMRSYKGLMVTDKMTSNKDIASSNKSLQELEDDFM

SEQ ID NO: 10575 - protein, 207 aa, Acacia harpophylla
MVFYFKARPEAGDYTIFMGLDKHENEELIKYGFIEDIWFHVDKMSSAHVYLRLHKGQTIDDISEGVLEDCAQLVKANSIQGNKVNNVDVVYTPWSNLKKTASMDVGQVGFHNPKMVRTVRVEKRINEIVNRLNKTKVERTPDFKAEREAVNAAERAERKQQLREKKRREELERMEKERQAELRSYKGLMVSENMTSNKQIASASKSL

SEQ ID NO: 10576 - protein, 215 aa, Unknown
  Sequence found in Organisms: Brassica napus, Brassica rapa
MVFYFKARPDAGDYTIFMGLDKFENEELIKYGFPEDVWFHVDKMSSAHVYLRLHKGQGFDDINEGVLEDCAQLVKANSIQGNKVNNVDVVYTPWSNLKKTASMDVGQVGFHNSKMVRTIRVEKRVNDIVNRLNKTKVERTPDLRAEREAVNAAERAERKQHLREKKKREEIERLEKERQAEMRSYKGLMVTDKMTSNKDIASSNKSLQELEDDFM

SEQ ID NO: 10577 - protein, 215 aa, Lippia dulcis
MVFYFKARPEAGDFTIFMGLDKYENEELIKYGFPEDIWFHVDKMSSAHVYLRLHKGQTIDDISEDVLEDCVQLVKANSIQGNKVNNVDVVYTPWQNLKKTASMDVGQVGFYNSKMVRTVRVEKRINEIVNRLNRTKVERTPDLKAEREAVNAAERAERKQQLRDKKRREDLDKLEKDRQAELRSYKNLMVAEKMTSNKDIASTNKSLEELEEDFM

SEQ ID NO: 10578 - protein, 215 aa, Raphanus sativus
MVFYFKARPDAGDYTIFMGLDKFENEELIKYGFPEDVWFHVDKMSSAHVYLRLHKGQGFDDISEGVLEDCAQLVKANSIQGNKVNNVDVVYTPWSNLKKTASMDVGQVGFHNSKMVRTIRVEKRVNEIINRLNKTKVERTPDLRAEREAVNAAERAERKQHLREKKKREDIERLEKERQADMRSYKGLMVTDKMTSNKDIASSNKSIQELEDDFM

SEQ ID NO: 10579 - protein, 214 aa, Lotus japonicus
MVFYFKARPEAGDFTIFMGLDKYENEELIKYGFPEDIWFHVDKMSSAHVYVRLHKGQTIDDMSEGLLEDCAQLVKANSIQGNKVNNVDVVYTPWSNLKKTASMDVGQVGFYNSKMVRTVRVEKRINEIVNRLNKTKVERTPDLKAEREAVNAAERAERKQHLREKKRREEMERLEKERQSELRSYKGLMVAENMTSNKDIASWTKYWRTIGGLL

SEQ ID NO: 10580 - protein, 216 aa, Eschscholzia californica
KNGFYFQARPEAGDFTIFMGLDKHENEDLIKYGFPEDIWFHVDKMSSAHVYLRLNKGQTMDDISEGVLEDCVQLVKANSIQGNKLNNIDVVYTPWQNLKKTASMDVGQVGFHNHKTVRTVRVEKRINDVINRLNKTKVERKTDLKAEWEDVNAAERMEKKVVLRDKKRREEMERLEKERQAEMRSYKGLMVSENMTSNKQNASTSKSLQEMEEDFM

SEQ ID NO: 10581 - protein, 215 aa, Triphysaria pusilla
MVFYFKARPEAGDYTIFMGLDKYENEELIKYGFPEDIWFHVDKMSSAHVYVRLHKGQTIDDISEDVLEDCAQLVKANSIQGNKANNVDIVYTPWQNLKKTASMDVGQVGFYSSKAVRTVRVEKRINEIVNRLNKTKVERQPDLKAEREAVNAAEKAEKKQQMRVKKRHEDLEKLEKDKQAELRSYKNLMVADKMTSNKDIASTHKSLQEMEEDFM

SEQ ID NO: 10582 - protein, 215 aa, Brassica napus
MVFYFKARPDAGDYTIFMGLDKFENEELIKYGFPEDVWFHVDKMSSAHVYLRLHKGQGFDDISEGVLEDCAQLVKANSIQGNKVNNVDVVYTPWSNLKKTASMDVGQVGFHNSKMVRTIRVEKRVNDIINRLNKTKVERTPDLRAEREAVNAAERAERKEHLREKKKREDIERLEKERQADMRSYKGLMVTDKMTSNKDIASSNKSIQELEDDFM

SEQ ID NO: 10583 - protein, 215 aa, Brassica napus
MVFYFKARPDAGDYTIFMGLDKFENEELIKYGFPEDVWFHVDKMSSAHVYLRLHKGQGFDDISEGVLEDCAQLVKANSIQGNKVNNVDVVYTPWSNLKKTASMDVGQVGFHNSKMVRTIRVEKRVNDIINRLNKTKVEKTPDLRAEREAVNAAERAERKQHLREKKKREDIERLEKERQADMRSYKGLMVTDKMTSNKDIASSNKSLQELEDDFM

SEQ ID NO: 10584 - protein, 215 aa, Raphanus sativus
MVFYFKARPDAGDYTIFMGLDKFENEELIKYGFPEDVWFHVDKMSSAHVYLRLHKGQGFDNINEGVLEDCAQLVKANSIQGNKVNNVDVVYTPWSNLKKTASMDVGQVGFHNSKMVRTIRVEKRVNDIVNRLNKTKVERTPDLRAEREAVNAAERAERKQHLREKKKREEIERLEKERQAEMRSYKGLMVTDKMTSNKDIASSNKSLQELEDDFM

SEQ ID NO: 10585 - protein, 226 aa, Manihot esculenta
MVFYFKARPEVGDYTIFMGLDKYENEELIKYGFPEDIWFHVDKMSSAHVYLRLRKGQTIDDITEGLLEDCAQLVKANSIQGKISKFFYHFYGNKVNNIEVVYTPWSNLKKTASMDVGQVSFHNPKMVRTVRVEKRINEVVNRLNKTKVERNTDLKAEKEAVNAAERAERKLQLRDKKRQEEMERLEKERQAEIRSYKGLMVSEKMTSNKQIAADNKSLQELEDDFM

SEQ ID NO: 10586 - protein, 203 aa, Panax ginseng
MVFYFKARPEAGDYTIFMGLDKHENEELIKYGFPEDIWFHVDKMSSAHVYVRLHKGQTVDDISEGLLEDCAQLVKANSIQGNKVNNIDVVYTPWQNLKKTASMDVGQVGFHNPKMVRTVRVEKRINEVVNRLNKTKVERTPDLKAERESVNAAERAERKQLLRDKKRREELERLEKERQAELRSYKNLMVADKNWKRISCRKK

SEQ ID NO: 10587 - protein, 169 aa, Lippia dulcis
MVFYFKARPEAGEYTIFMGLDKYENEDLIKFGLPEDIWFHVDKMSSAHVYLRLPKGQTIDDIPESVLEDCAQLVKANSIQGNKVNNISIVYTPWQNLKKTASMEVGQVGFYNQTMVRTMKVEKRINEIVNRLNKTKVERKPDLKAEREAVNASEIAERKHQLRDKKRTR

SEQ ID NO: 10588 - protein, 215 aa, Abies balsamea
MVFYFKATPEAGDYTIYMGLDKFENEELIRYGIPEDIWFHVDKLSSAHVYLRMRKGQTIDDISQPVLDDCAQLVKANSIQGNKLNNVDVVYTPWSNLRKTSSMDVGQVGFHNPKLVRTVRVEKRINEIVNRLNKTKVERKPDLKAEREAMNAAERAQIKAQGREKKRREELERLEKERQAEIRSYKGFMVAEKMTSNKDIASGSKSAQEIEDDFM

SEQ ID NO: 10589 - protein, 215 aa, Cedrus atlantica
MVFYFKATPEAGDYTIYMGIDKFENEELIRYGIPEDIWFHVDKLSSAHVYLRMHKGQTIDDISPAVLDDCAQLVKANSIQGNKLNNIDVVYTPWSNLRKTSSMDVGQVGFHNPKLVRTIRVEKRINEIVNRLNKTKVERKPDLKAEREAINAAERAQIKAQGREKKRREELERLEKERQAEIRSYKGFMVAEKKTSNKDVASGSKSAQEIEDDFM

SEQ ID NO: 10590 - protein, 215 aa, Pseudotsuga menziesii
MVFYFKATPEAGDYTIYMGIDKFENEELIRYGIPEDIWFHVDKHSSAHVYLRMHKGQTIDDINPPVLDDCAQLVKANSIQGNKLNNIDVVYTPWSNLRKTSSMDVGQVGFHNPKLVRTIRVEKRVNEIVNRLNKTKVERKPDLKAEREAINAAERAQIKAQGREKKRREELERLEKERQAEIRSYKGFMVAEKMTSNKDIASGSKSAQEIEDDFM

SEQ ID NO: 10591 - protein, 176 aa, Lotus japonicus
MSSAHVYVRLHKGQTIDDMSEGLLEDCAQLVKANSIQGNKVNNVDVVYTPWSNLKKTASMDVGQVGFYNSKMVRTVRVEKRINEIVNRLNKTKVERTPDLKAEREAVNAAERAERKQHLREKSSVQKRREEMERLEKERQSELRSYKGLMVAENMTSNKDIASGSKSLQELEEDFM

SEQ ID NO: 10592 - protein, 198 aa, Arachis hypogaea
MGLDKYENEELIKYGFPEDIWFHVDKMSSAHVYVRLHKGQTIDDISEGLLEDCAQLVKANSIQGNKVNNIDVVYTPWANLKKTASMDVGQVGFHNPKMVRTVRVEKRINEIVNRLNKTKVERKPDLRAEREAVNAAERAERKQQMRDKKRREELERLEKERQAELRSYKGLMVAENMTSNKNIASGSKTLQEMEDDFM

SEQ ID NO: 10593 - protein, 215 aa, Pinus pinaster
MVLYFKATPEAGDYTIYMGIDKFENEELIRYGIPEDIWFHVDKLSSAHVYLRMHKGQTIDNISQPVLDDCAQLVKANSIQGNKLNNIDIVYTPWSNLRKTSSMDVGQVGFHNPKLVRTIRVEKRINEIVNRLNKTKVERKPDLKAEREAINAAERAQIKAQGREKKRREELERLEKERQAEIRSYKGFMVAEKMTSNKDIASGSKSAQEVEDDFM

SEQ ID NO: 10594 - protein, 215 aa, Picea glauca
MVFYFKATPEVGDYTIYMGIDKFENEELIRYGIPEDIWFHVDKLSSAHVYLRMHKGQTIDNISQPVLDDCAQLVKANSIQGNKINNIDVVYTPWSNLRKTSSMDVGQVGFHNPKLVRTIRVEKRINEVVNRLNKTKVERKPDLKAEREAINAAERAQIKAQGREKKRREELERLEKERQAEIRSYKGFMVAEKMTSNKDIASGSKSAQEIEDDFM

SEQ ID NO: 10595 - protein, 211 aa, Chelidonium majus
RPEVGDFTIFMGLDKHENEELIKYGFPEDIWFHVDKMSSAHVYVRLNKGQTIDDISEGLLEDCAQLVKANSIQGNKVNNVDVVYTPWYNLKKTASMDVGQVGFHNPKMVRTVRVERRINEVVNRLNKSKVERKPDLKAEREAVNAAERAERKLQLRDKKRREEMERLDKERQAEIRSYKGLMVSEKMTSNKQIASGKQILAGTGRGFHVRQ

SEQ ID NO: 10596 - protein, 198 aa, Heritiera littoralis
MGLDKYENEELIKYGFLEDIWFHVDKMSSAHVYLRLQKGQTIDDISEGLLEDCAQLVKANSIQGNKVNNIDVVYTPWSNLKKTPSMDVGQVGFHNSKMVRTVRVEKRINETVNRLNRTKVERKPDLKAEREAVNAAERAERKQQLREKKRREELERLEKERQAEIRSYKGLMVSEKMTSNKQIATTSKSLQELEEDFM

SEQ ID NO: 10597 - protein, 215 aa, Pinus taeda
MVLYFKATPEAGDYTIYMGIDKFENEELIRYGIPEDIWFHVDKLSSAHVYLRMHKGQTIDAISQPVLDDCAQLVKANSIQGNKLNNVDIVYTPWSNLRKTSSMDVGQVGFHNPKLVRTIRVEKRINEIVNRLNKTKVERKPDLKAEREAINAAERAQIKAQGREKKRREELERLEKERQAEIRSYKGFMVAEKMTSNKDIASGSKSAQEVEDDFM

SEQ ID NO: 10598 - protein, 215 aa, Pteridium aquilinum
MVYYFKARPEVGDYVIYMGLDKYENEDLIKYGIPEDVWFHVDKLSSAHVYVRLHKGQSIENISPELLEDCVQLVKANSIQGNKLNNLDVVYTPWSNLRKTAAMDVGQVGFHNPKNVKTVRVEKRINEVVNRLNKTKVERTPDLKAERESYNAAERAERKAFLRDKKRREEMARIEKDKQAEIRSYKGLMVSEKMTSNKDLASKGKSLQELEDDFM

SEQ ID NO: 10599 - protein, 115 aa, Sorghum bicolor
MALEKAKEIVASSPVVVFSKTYCPFCARVKQLLAQLGASYKAIELDVESDGADLQSALAEWTGQKTVPNVFVKGERIGGCDATMAMHDGGKLVPLLTEAGAIVTASATATTTPSL

SEQ ID NO: 10600 - protein, 380 aa, Sorghum bicolor
MASVAELKEKHAAATASVNSLRERLRQRRETLLDTDVARYSKSQGRLPVSFNPTDLVCCRTLQGHSGKVYSLDWTPEKNWIVSASQDGRLIVWNALTSQKTHAIKLHCPWVMTCAFAPNGQSVACGGLDSACSIFNLNSQADRDGNMPVSRILTGHKGYVSSCQYVPDQETRLITSSGDQTCVLWDVTTGQRISIFGGEFPSGHTADVQSVSINSSNTNMFVSGSCDTTVRLWDIRIASRAVRTYHGHEGDVNSVKFFPDGHRFGTGSDDGTCRLFDMRTGHQLQVYSRVPDRNDDELPTVTSIAFSISGRLLFAGYSNGDCYVWDTLLAEVVLNLGNLQNSHDGRISCLGMSSDGSALCTGSWDKNLKIWAFSGHRKIV

SEQ ID NO: 10601 - protein, 380 aa, Setaria italica
MASVAELKEKHAAATASVNSLRERLRQRREMLLDTDVARYSKAQGRTPVSFNPTDLVCCRTLQGHSGKVYSLDWTPEKNWIVSASQDGRLIVWNALTSQKTHAIKLHCPWVMTCAFAPNGQSVACGGLDSACSIFNLNSQADRDGNMPVSRILTGHKGYVSSCQYVPDQESRLITSSGDQTCVLWDVTTGQRISIFGGEFPSGHTADVQSVSINSSNTNMFVSGSCDATVRLWDIRIASRAVRTYHGHEADVNSVKFFPDGHRFGTGSDDGTCRLFDMRTGHQLQVYSREPNRDDNELPTVTSIAFSISGRLLFAGYSNGDCYVWDTLLAEVVLNLGNLQNSHDGRISCLGMSSDGSALCTGSWDKNLKIWAFSGHRKIV

SEQ ID NO: 10602 - protein, 229 aa, Saccharum officinarum
MASVAELKEKHAAATASVNSLRERLRQRRETLLDTDVARYSKSQGRAPVSFNPTDLVCCRTLQGHSGKVYSLDWTPEKNWIVSASQDGRLIVWNALTSQKTHAIKLHCPWVMTCAFAPNGQSVACVVLIAHALFSISTLKQTEMGTCRYQEFLLDTRAMFRHANMSQIRKLVLLLAPVIRHVFFGMLLLDRGYQYLAVNFHQGIQLMFKVCPSTHQIRICLSLAHVIQL

SEQ ID NO: 10603 - protein, 380 aa, Oryza sativa
MASVAELKEKHAAATASVNSLRERLRQRRQMLLDTDVERYSRTQGRTPVSFNPTDLVCCRTLQGHSGKVYSLDWTPEKNWIVSASQDGRLIVWNALTSQKTHAIKLHCPWVMTCAFAPNGQSVACGGLDSACSIFNLNSQADRDGNIPVSRILTGHKGYVSSCQYVPDQETRLITSSGDQTCVLWDVTTGQRISIFGGEFPSGHTADVLSLSINSSNSNMFVSGSCDATVRLWDIRIASRAVRTYHGHEGDINSVKFFPDGQRFGTGSDDGTCRLFDVRTGHQLQVYSREPDRNDNELPTVTSIAFSISGRLLFAGYSNGDCYVWDTLLAEVVLNLGNLQNSHEGRISCLGLSSDGSALCTGSWDKNLKIWAFSGHRKIV

SEQ ID NO: 10604 - protein, 380 aa, Oryza sativa
MASVAELKEKHAAATASVNSLRERLRQRRQMLLDTDVERYSRTQGRTPVSFNPTDLVCCRTLQGHSGKVYSLDWTPEKNWIVSASQDGRLIVWNALTSQKTHAIKLHCPWVMTCAFAPNGQSVACGGLDSACSIFNLNSQADRDGNIPVSRILTGHKGYVSSCQYVPDQETRLITSSGDQTCVLWDVTTGQRISIFGGEFPSGHTADVLSLSINSSISNMFVSGSCDATVRLWDIRIASRAVRTYHGHEGDINSVKFFPDGQRFGTGSDDGTCRLFDVRTGHQLQVYSREPDRNDNELPTVTSIAFSISGRLLFAGYSNGDCYVWDTLLAEVVLNLGNLQNSHEGRISCLGLSSDGSALCTGSWDKNLKIWAFSGHRKIV

SEQ ID NO: 10605 - protein, 368 aa, Pennisetum glaucum
AATASVNSLRERLRQRREMLLDTDVARYSKAQGRAPVNFNPTDLVCCRTLQGHSGKVYSLDWTPEKNWIVSASQDGRLIVWNALTSQKTHAIKLHCPWVMTCAFAPNGQSVACGGLDSACSIFNLNSQADRDGNMPVSRILTGHKGYVSSCQYVPDQETRLITSSGDQTCVLWDVTTGQRISIFGGEFPSGHTADVQSVSINSSNTNMFVSGSCDATVRLWDIRIASRAVRTYHGHEADVNSVKFFPDGHRFGTGSDDGTCRLFDMRTGHQLQVYSREPNRDDNELPTVTSIAFSISGRLLFAGYSNGDCYVWDTLLAEVVLNLGNLQNSHDGRISCLGMSSDGSALCTGSWDKNLKIWAFSGHRKIV

SEQ ID NO: 10606 - protein, 380 aa, Brachypodium distachyon
MASVADLKEKHAAATASVNSLRERLRQRRQLLLDTDVERYSKAQGRTAVSFNQTDLVCCRTLQGHSGKVYSLDWTPEKNWIVSASQDGRLIVWNALTSQKTHAIKLHCPWVMTCAFAPNGQSVACGGLDSACSIFNLNSQVDRDGNMPVSRILTGHKGYVSSCQYVPDQETRLITGSGDQTCVLWDVTTGQRISIFGGEFPSGHTADVLSLSINPLNTNMFVSGSCDTTVRLWDLRIASRAVRTYHGHEGDINSVKFFPDGQRFGTGSDDGTCRLFDMRTGHQLQVYNREPDRNDNELPIVTSIAFSISGRLLFAGYSNGDCYVWDTLLAEVVLNLGTLQNSHDGRISCLGLSSDGSALCTGSWDKNLKIWAFSGHRKIV

SEQ ID NO: 10607 - protein, 380 aa, Unknown
  Sequence found in Organisms: Hordeum vulgare, Leymus cinereus x Leymus triticoides
MASVAELKEKHAAATASVNSLRERLRQRRQTLLDTDVEKYSKAQGRTAVSFNPTDLVCCRTLQGHSGKVYSLDWTPEKNWIVSASQDGRLIVWNALTSQKTHAIKLHCPWVMTCAFAPNGQSVACGGLDSACSIFNLSSQVDRDGNMPVSRVLTGHKGYVSSCQYVPDQETRLITGSGDQTCVLWDVTTGQRISIFGGEFPSGHTADVLSLSINSLNTNMFVSGSCDTTVRLWDLRIASRAVRTYHGHEGDINSVKFFPDGQRFGTGSDDGTCRLFDMRTGHQLQVYNREPDRNDNELPIVTSVAFSISGRLLFAGYSNGDCYVWDTLLAEVVLNLGTLQNSHEGRISCLGLSSDGSALCTGSWDKNLKIWAFSGHRKIV

SEQ ID NO: 10608 - protein, 380 aa, Triticum aestivum
MASVAELKEKHAAATASVNSLRERLRQRRQTLLDTDVEKYSKAQGRTAVSFNPTDLVCCRTLQGHSGKVYSLDWTPEKNWIVSASQDGRLIVWNALTSQKTHAIKLHCPWVMTCAFAPNGQSVACGGLDSACSIFNLSSQADRDGNMPVSRVLTGHKGYVSSCQYVPDQETRLITGSGDQTCVLWDVTTGQRISIFGGEFPSGHTADVLSLSINSLNTNMFISGSCDTTVRLWDLRIASRAVRTYHGHEGDINSVKFFPDGQRFGTGSDDGTCRLFDMRTGHQLQVYNREPDRNDNELPIVTSVAFSISGRLLFAGYSNGDCYVWDTLLAEVVLNLGTLQNSHEGRISCLGLSSDGSALCTGSWDKNLKIWAFSGHRKIV

SEQ ID NO: 10609 - protein, 380 aa, Lolium multiflorum
MASVAELKERHAAATASVNSLRERLRQRRQTLLDTDVEKYSKAQGRTAVSFNQTDLVCCRTLQGHSGKVYSLDWTPEKNWIVSASQDGRLIVWNALTSQKTHAIKLHCPWVMTCAFAPNGQSVACGGLDSACSIFNLNSQVDRDGNMPVSRVLTGHKGYVSSCQYVPDQETRMITGSGDQTCVLWDVTTGQRISIFGGEFPSGHTADVLSLSINSLNTNMFVSGSCDTTVRLWDLRIASRAVRTYHGHEGDINSVKFFPDGQRFGTGSDDGTCRLFDMRTGHQLQVYSRSPDRNDNEPPTVTSIAFSISGRLLFAGYSNGDCYVWDTLLAEVVLNLGTLQNSHEGRISCLGLSSDGSALCTGSWDKNLKIWAFSGHRKIV

SEQ ID NO: 10610 - protein, 380 aa, Triticum aestivum
MASVAELKEKHAAATASVNSLRERLRQRRQTLLDTDVEKYSKAQGRTAVSFNPTDLVCCRTLQGHSGKVYSLDWTPEKNWIVSASQDGRLIVWNALTSQKTHAIKLHCPWVMTCAFAPNGQSVACGGLDSACSIFNLSSQADRDGNMPVSRVLTGHKGYVSSCQYVPDQETRLITGSGDQTCVLWDVTTGQRISIFGGEFPSGHTADVLSLSINSLNTNMFISGSCDTTVRLWDLRIASRAVRTYHGHEGDINSVKFFPDGQRFGTGSDDGTCRLFDMRTGHQLQVYNREPDRNDNELPIVTSVAFSISGRLLFAGYSNGDCYVWDTLLAEMVLNLGTLQNSHEGRISCLGLSSDGSALCTGSWDKNLKIWAFSGHRKIV

SEQ ID NO: 10611 - protein, 380 aa, Avena sativa
MASVAELKERHAAATASVNSLRERLRQRRQTLLDTDVEKYSKAQGRTAVSFNQTDLVCCRTLQGHSGKVYSLDWTPEKNWIVSASQDGRLIVWNALTSQKTHAIKLHCPWVMTCAFAPNGQSVACGGLDSACSIFNLNSQVDRDGNMPVSKVLTGQKGYVSSCQYVPDQETRMITGSGDPTCVLWDVTTGQRISIFGGEFPSGHTADVLSLSINSLNTNMFVSGSCDTTVRLWDLRIASRAVRTYHGHEGDINSVKFFPDGHRFGTGSDDGTCRLFDMRIRHQLQVYSREPDRNDNELPSVTSIAFSISGRLLFAGYSNGDCYAWDTLLAEVVLNLGTLQNSHEGRISCLGLSSDGSALCTGSWDKNLKIWAFSGHRKIV

SEQ ID NO: 10612 - protein, 70 aa, Secale cereale
EPGRSPPAHEAQGRQAARPAHLMASVAELKEKHAAATASVNSLRERLRSAGRRSSTPTWRSTPRRGGGRR

SEQ ID NO: 10613 - protein, 382 aa, Secale cereale
PPDGVRGGAQGEARAATASVNSLRERLRQRRQTLLDTDVEKYSKAQGRTAVSFNPTDLVCCRTLQGHSGKVYSLDWTPEKNWIVSASQDGRLIVWNALTSQKTHAIKLHCPWVMTCAFAPNGQSVACGGLDSACSIFNLSTQADRDGNMPASRVLTGHKGYVSSCQYVPDQETRLITGSGDQTCVLWDVTTGQRISIFGGEFPSGHTADVLSLSINSLNTNMFISGSCDTTVRLWDLRIASRAVRTYHGHEGDINSVKFFPDGQRFGTGSDDGTCRLFDMRTGHQLQVYNREPDRNDNELPIVTSVAFSISGRLLFAGYSNGDCYVWDTLLAEVVLNLGTLQNSHEGRISCLGLSSDGSALCTGSWDKNLKIWAFSGHRKIV

SEQ ID NO: 10614 - protein, 379 aa, Elaeis guineensis
MSVAELKERHIAATANVNALRERLKQRRQELLDTDVAGYAKSHGKTAIGFGSTDLVCCRTLQGHTGKVYSLDWTPERNRIVSASQDGRLIVWNALTSQKTHAIKLHCAWVMTCAFAPNGQSVACGGLDSACSIFNLNSQVDRDGNIPISRVLTGHKGYVSSCQFVPDQETRLITGSGDQTCVLWDVTTGQRISVFGGEFPSGHTADVFSVSINSSNSNMFVSGSCDATARLWDTRIASRAVRTYHGHEGDVNAVKFFPDGQRFGTGSDDGTCRLFDMRTGHQLQIYSQQLDNNDNEVPTVTSIAFSISGRLLFAGYSNGNCYVWDTLVAEVVLNLGALQNSHEGRISCLGLSADGSALCTGSWDKNLKIWAFGGHRRVI

SEQ ID NO: 10615 - protein, 379 aa, Musa acuminata
MSVAELKERHIAATATVNSLRERLKQRRQLLLDTDVAAFAKSQGRSAISFNSTDLICCRTLQGHTGKVYSLDWTPERNRIVSASQDGRLIVWNALTSQKTHAIKLQCPWVMTCAFAPNGQSVACGGLDSACSIFNLNSQVDRDGNIPVSRILTGHKGYVYSCQYVPDQETRLITSSGDQTCVLWDVTTGQRISVFGGEFPSGHTADVLSVSINSSNSNMFVSGSCDMTARLWDTRIASRAVGTYHGHQGDVNTVKFFPDGQRFGTGSDDSTCRLYDMRTGHQLQVYSQQHEGDDNDVPIVTSIAFSISGRLLFAGYSSGDCYVWDTLMAEVVLNLGTSQNSHEARISCLGLSSDGSALCTGSWDKNLKIWAFGGHRKVI

SEQ ID NO: 10616 - protein, 347 aa, Secale cereale
DTDVEKYSKAQGRTAVSFNPTDLVCCRTLQGHSGKVYSLDWTPEKNWIVSASQDGRLIVWNALTSQKTHAIKLHCPWVMTCAFAPNGQSVACGGLDSACSIFNLSTQADRDGNMPASRVLTGHKGYVSSCQYVPDQETRLITGSGDQTCVLWDVTTGQRISIFGGEFPSGHTADVLSLSINSLNTNMFISGSCDTTVRLWDLRIASRAVRTYHGHEGDINSVKFFPDGQRFGTGSDDGTCRLFDMRTGHQLQVYNREPDRNDNELPIVTSVAFSISGRLLFAGYSNGDCYVWDTLLAEVVLNLGTLQNSHEGRISCLGLSSDGSALCTGSWDKNLKIWAFSGHRKIV

SEQ ID NO: 10617 - protein, 379 aa, Musa acuminata
MSVAELKERHIAATATVNSLRERLKQRQQLLVDTDMAAYGRSQGRSAISFGSTDLVCCRTLQGHTGKVYSLDWTPERNRIVSASQDGRLIVWNALTSQKTHAIKLQCPWVVTCAFAPNGQSVACGGLNSACSIFNLNSQVDRDGNIPVSQILTGHKGYVYSCQYVPDQETRLITSSGDQTCILWDVTTGQRISVFGGEFPSGHTADVLSVSINSSNSNMFVSGSCDTTARLWDTRIASRAVRTYHGHQGDVNTVKFFPDGQRFGTGSNDSTCRLYDMRTGHQLQVYSQQHDGDDNDIPTVTSIAFSISGRLLFAGYSSGACYVWDTLLAEVVLNLGELQNSHEGCISCLDLSSDGSALCTGSWDKKLKIWAFGGQRRVI

SEQ ID NO: 10618 - protein, 379 aa, Musa acuminata
MSFSELKDRHVAATATVNTLRDRLNQKRQQLLDTDVAGYAKSQGRTAVNFSSTDLVCCRTLQGHTGKVYSLDWTPEKNRIVSASQDGRLIIWNALTSQKTHAIKLPCAWVMTCAFAPNGHSVACGGLDSECSIFNLNSQVDRDGNIPVSRVLTGHKGYVSSCEFVRDQDTRLITGSGDQTCVLWDVTTGQRISVFGGEFPSGHTSDVLSISINSSNSNMFVSGSCDATARLWDTRIASRAIRTYHGHHGDVNSVKFFPDGQRFGTGSDDGTCRLFDMRTGHQLQVYSQQQANNDQDIPIVTSIAFSISGRLLFAGYSNGDCYVWDTLLAEVVVNLGKLQNSHEGRISCLGLSADGSALCTGSWDKNLKIWAFGGHRKVI

SEQ ID NO: 10619 - protein, 377 aa, Amborella trichopoda
MSVAELKEKHLAATATVNSLRERLKQKRLQLLDTDVAGYAKSIGKTPVSFGPTDLVCCRTLQGHTGRVYSLDWTSEKNRIVSASQDGRLIVWNALTSQKTHAIKLPCAWVMTCAFSPTGQSVACGGLDSACSIFNLNSQTDKDGNLPVSRILSGHKGYVSCCQYVPDGDTHLITSSGDQTCILWDVTTGQRLSVFGGEFPSGHTADVLSVSINSSNTKMFVSGSCDATARLWDTRIASRAVRTYHGHEGDVNTVKFFPDGQRFGTGSDDGTCRLFDMRTGHQLQVYYQSHGENEVPMVTSIAFSISGRLLFVGYSNGDCYVWDTIVAKVVLNLGSLQTSHESRITCLGMSADGSALCTGSWDRNLKIWAFGGYRTVI

SEQ ID NO: 10620 - protein, 379 aa, Amorphophallus konjac
MSMTEVKERHVAATAAVNNLRERLRQRRQLLLDTDIAGYSRTHGKAAVSFNSTDLVCCRTLQGHTGKVYSLDWSPERNRIVSASQDGRLIVWNALTSQKTHAIKLPCAWVMTCAFSPNGQSVASGGLDSACSIFNLNSQVDRDGNLPVARILTGHKGYVSSCQYVPDEESHLITSSGDQTCVLWDVTTGQRLSVFGGEFPSGHTADVSSISINSANTKMFVSGSCDSTARLWDTRIASRAVRTYHGHEGDVNTVKFFPDGHRFGTGSDDGTCRLFDMRTGHQLQVYNQQRGENCSDLPIVTSIAFSISGRLLFTGYSNGDCYVWDTLVAKVVLNLGTVQNSHEGRISCLGLSTDGSAICTGSWDRNLKIWAFSGHRRVI

SEQ ID NO: 10621 - protein, 328 aa, Festuca arundinacea
QTDLVCCRTLQGHSGKVYSLDWTPEKNWIVSASQDGRLIVWNALTSQKTHAIKLHCPWVMTCAFAPNGQSVACGGLDSACSIFNLNSQVDRDGNMPVSRVLTGHKGNVSSCQYVPDQETHMITGSGDQTCVLWDVTTGQRISIFGGEFPSGHTADVLSLSINSLNTNMFVSGSCDTTVRLWDLRIASRAVRTYHGHEGDINSVKFFPDGQRFGTGSDDGTCRLFDMRTGHQLQVYSREPDRNDNELPTVTSIAFSISGRLLFAGYSNGDCYVWDTLLAEVVLNLGTLQNSHEGRISCLGLSSDGSALCTGSWDKNLKIWAFSGHRKIV

SEQ ID NO: 10622 - protein, 377 aa, Aquilegia formosa
MSVAELKERHSAATATVNGLRDRLKQKRLLLLDTDVAGYAKSLGRPAVSFGQTDLVCCRTLQGHTGKVYSLDWTPDKNRIVSASQDGRLIVWNALTSQKTHAIKLPCAWVMTCAFSPSGQSVASGGLDSVCTIFNLNSPIDKDGNLPVSRLLNGHKGYVSSCQYVPDEDTHLITSSGDQTCVLWDVTTGQRISVFGGEFPSGHTADVLSVSINKSNPKMFVSGSCDATARLWDTRIASRAVRTFHGHEGDVNTVKFFPDGQRFGTGSDDGTCRLFDMRTGHQLQVYYQQHGNNDVPIATSIDFSISGRLLFVGYSNGDCYVWDTLVAEVVLNLGSLQNSHEGRITCLGLSTDGSALCTGSWDKNLKIWAFGGHRSVV

SEQ ID NO: 10623 - protein, 377 aa, Coffea canephora
MSVAELKERHLAATQTVSALRDRLKQKRLLLLDTDVAGYSRSQGRTPVSFGPTDLVCCRTLQGHNGKVYSLDWTPEKNRIVSASQDGRLIVWNALTSQKTHAIKLPCAWVMTCAFSPTGQSVACGGLDSVCSIFNLNSPTDRDGNLPVSKMLSGHKGYVSSCQYVPDEDAHLITSSGDQTCGLWDITTGLRTSVFGGEFQSGHTADVLSVSINGSNSRMFVSGSCDSTARLWDTRVASRAVRTFHGHEGDVNAVKFFPDGNRFGTGSDDGTCRLFDIRTGHQLQVYYQQHGDNEVPPVTSIAFSISGRLLFAGYSNGDCYVWDTLLGQVVLNLGTLQNSHEGRISCLGLSADGSALCTGSWDSNLKIWAFGGHRKVI

SEQ ID NO: 10624 - protein, 377 aa, Triphysaria pusilla
MSVAELKERHMAATETVNTLRDRLKQKRLLLLDTDVAGYARSQGKTPVTFGPTDLVCCRTLQGHTGKVYSLDWTPEKNRIVSASQDGRLIVWNALTSQKTHAIKLPCAWVMTCAFSPNGQSVACGGLDSMCSIFNLNSQTDKDGNLPVSRTLSGHKGYVSSCQYVPDEDTHLITASGDQTCVLWDITTGLRTSVFGGEFQSGHSADVLSVSINGSNSRMFVSGSCDSTARLWDTRVASRAVRTFHGHEGDVNTVKFFPDGNRFGTGSDDGTCKLFDIRTGHQLQEYSQPSNDNEARHVTSIAFSNSGRLLFAGYTNGDCYVWDTLLAQVVLNLGSLQNSHDGRISCLGLSADGSALCTGSWDTNLKIWAFGGYRKVI

SEQ ID NO: 10625 - protein, 379 aa, Aristolochia fimbriata
MSVAELKERHAAATTAVNALRERLKQRRLHLLDTDVAGYARAQGRTPVTFGLTDLVCCRTLQGHTGKVYSLDWTSEKNRIVSASQDGRLIVWNALTSQKTHAIKLPCAWVMTCAFSPSGQSVACGGLDSVCSIFNLSSQTVRDGNLPISRTLTGHKGYVSSCQYVPDEDTHLITGSGDQTCVLWDITTGQRISVFGGEFPSGHTSDVSSVSINGSNSKMFVSGSCDTTARLWDTRIASRAVRTFHGHAGDVNTVKFFPDGMRFGTGSNDGTCRLFDMRTGHQLQVYYQPHGDSDNDVPYVTSIAFSISGRLLFVGYSNGDCYVWDTLVAKVVLNLGSLQNSHESRITCLGLSADGSALCTGSWDRNLKIWAFGGHRKVI

SEQ ID NO: 10626 - protein, 377 aa, Cannabis sativa
MSVAELKERHVAANETVNSLRERLKQRRLALLDTDVAGYARSQGRTPVRFGPTDLVCCRTLQGHAGKVYSLDWTPEKNRIVSASQDGRLIVWNALTSQKTHAIKLPCAWVMTCAFSPTGQSVACGGLDSVCSIFNLSSQTDKDGNLPVAKMLSGHKGYVSSCQYVPEEDAHLITSSGDQTCVLWDITTGLRTSVFGGEFQSGHTADVLSVSINGSNPRMFVSGSCDTTARLWDTRVASRAVRTFHGHEGDVNSVKFFPDGNRFGTGSDDGTCRLFDIRTGHQLQVYHQRHGDNDNPHVTSIAFSTSGRLLFVGYTNGDCYVWDTLLAEVVLNLGSLQNSHEGRISCLGLSADGSALCTGSWDTNLKIWAFGGHRRVL

SEQ ID NO: 10627 - protein, 377 aa, Populus trichocarpa
MSVSELKERHVAATETVNSLRERLKQKRLLLLDTDMARYARAQERSPVSFGPTDLVCCRTLQGHTGKVYSLDWTPERNRIVSASQDGRLIVWNALTSQKTHAIKLPCAWVMTCAFSPTGQSVACGGLDSVCSIFNLNSPTDKDGNLPVSRMLSGHKGYVSSCQYVPDEDTHLITSSGDQTCVLWDITTGIRTSVFGGEFQSGHTADVLSVSINGSNSRMFVSGSCDSTARLWDTRVASRAVRTFHGHEGDVNAVKFFPDGNRFGTGSDDGTCRLFDIRTGHQLQVYYHQHGDTEIPHVTSIAFSISGRLLFAGYSNGDCYVWDTLLAEAVLNLGSLQNSHEGRISCLGLSADGSALCTGSWDTNLKIWAFGGHRQVI

SEQ ID NO: 10628 - protein, 377 aa, Catharanthus roseus
MSVAELKERHATATQTVNTLRERLRQRRQLLLDTDVAGYARSQGKTPVTFGPTDLVCCRTLQGHTGKVYSLDWTPERNRIVSASQDGRLIVWNALTSQKTHAIKLPCAWVMTCAFSPSGQSVACGGLDSVCSIFNLNCPTDKDGNLPVSRMLSGHKGYVSSCQYVPDEDTHLITSSGDQTCVLWDITTGLRTSVFGGEFQSGHTADVLSISINGSNSRMFVSGSCDSTARLWDTRVASRAVRTFHGHEGDVNAVKFFPDGNRFGTGSDDGTCRLFDIRTGHQLQVYYQQHGDNEVPHVTSIAFSVSGRLLFAGYSNGDCFVWDTLLAQMVLNLGSLQNSHEGRISCLGLSADGSALCTGSWDSNLKIWAFGGHRRVV

SEQ ID NO: 10629 - protein, 379 aa, Citrus clementina
MSSSVSELKERHAAAIETVNSLRERLKQKRQQLLDVDVAGYSRSQGRAPVSFGPTDLVCCRTLQGHAGKVYSLDWTSERNRIVSASQDGRLIVWNALTSQKTHAIKLPCAWVMTCAFSPTGQSVACGGLDSVCSIFNLNSPTDKDGNLPVSRMLSGHKGYVSCCQYVPDEDTHLITSSGDQTCVLWDITTGLRTSVFGGEFQSGHTADVLSVSISGSNSRMFVSGSCDSTARLWDTRVASRAVRTFHGHEGDVNTVKFFPDGNRFGTGSDDGTCRLFDIRTGHQLQVYYQQHGENEIPHVTSIAFSISGRLLFAGYSNGDCYVWDTLLAKVVLNLGSLQNSHEGRITCLGLSADGSALCTGSWDTNLKIWAFGGHRRVL

SEQ ID NO: 10630 - protein, 377 aa, Quercus alba
MSVAELKERHAAATETVNTLRERLKQRRRSLLDTDVAGYARSQNRTPVTFGPTDLVCCRTLQGHTGKVYSLDWTPERNRLVSASQDGRLIVWNALTSQKTHAIKLPCAWVMTCAFSPTGQSVACGGLDSVCSIFNLNSPTDKDGNLPVSRMLSGHKGYVSSCQYVPDEDTHLITSSGDQTCVLWDITTGLRTSVFGGEFQSGHTADVLSVSINGTNSRLFVSGSCDGTARLWDTRVASRAVKTFHGHEGDVNTVKFFPDGNRFGTGSDDGTCRLFDIRTGHQLQVYYQQHGDNDVPHVTSIAFSISGRLLFAGYSNGDCYVWDTLLAKVVLNLGSLQNSHDNRISCLGLSADGSALCTGSWDTNLKIWAFGGHRKVI

SEQ ID NO: 10631 - protein, 376 aa, Papaver somniferum
MSVAELKERHVAAAATVNSLRERLKQKRLLLLDTDVAGYSRLQGRSAISFGPTDLVCCRTLQGHTGKVYSLDWTPEKNRIVSASQDGRLIVWNALTSQKIHAIKLPCAWVMACAFSSSGQTVASGGLDSVCTIFNLNSPIDKDGNLPVSRILSGHKGYVSSCQYVPDDDTHLITSSGDQTCVLWDVTTGQRISVFGGEFPSGHTGDVLSVSINGSNSKMFVSGSCDATARLWDTRIASRAVRTYHGHDGDVNTVKFFPDGQRFGTGSDDGTCRLFDMRTGHQLQVYQQPGGIDVPTVTSIAFSSSGRLLFAGYSNGDCFVWDTLLAKVVHNLGSLQTSHEGRITCLGLSADGSALCTGGWDRNLKIWAFGGLRKVT

SEQ ID NO: 10632 - protein, 377 aa, Pseudotsuga menziesii
MSVAELRERHVAATAKVNALRERIKDKRLQLLDTDVATYAKNNGRTPISFSFTDLVCCRTLQGHTGKVYSLDWTSEKNRIVSASQDGRLIVWNALTSQKTHAIKLPCAWVMTCAFSPSGQAVACGGLDSACSIFQLNSQFDRDGHLPVSRILSGHKGYVSSCQYVPDGDTHVITGSGDRTCVQWDVTTGQRIAIFGGEFPLGHTADVMSVSISSTNPKEFVSGSCDTTTRLWDTRIASRAIRTFHGHEADVNTVKFFPDGLRFGTGSDDGTCRLFDIRTGHQLQVYRQPPRDIEMPTVTSIAFSFSGRLLFAGYSNGDCFVWDTILDKVVLNLGELQNTHNGRISCLGLSADGSALCTGSWDKNLKIWAFGGHRKIV

SEQ ID NO: 10633 - protein, 263 aa, Brachypodium distachyon
MLELRLVQGSLLKKVLEAIRDLVTDANFDCSGTGFSLQAMDSSHVALVALLLRSEGFEHYRCDRNLSMGMNLNNMAKMLRCAGNDDIITIKADDGSDTVTFMFESPNQDKIADFEMKLMDIDSEHLGIPDSEYQAIVRMPSSEFSRICKDLSSIGDTVVISVTKEGVKFSTAGDIGTANIVCRQNKTVDKPEEATIIEMQEPVSLTFALRYMNSFTKASPLSDQVTISLSSELPVVVEYKIAEMGYIRFYLAPKIEEDEEMKS

SEQ ID NO: 10634 - protein, 263 aa, Unknown
  Sequence found in Organisms: Secale cereale, Triticum aestivum
MLELRLVQGSLLKKVLEAIKELVTDANFDCSGTGFSLQAMDSSHVALVALLLRSEGFEHYRCDRNLSMGMNLGNMAKMLRCAGNDDIITIKADDGSDTVTFMFESPNQDKIADFEMKLMDIDSEHLGIPDSEYQAIVRMPSSEFSRICKDLSSIGDTVIISVTKEGVKFSTAGDIGTANIVCRQNKTVDKPEESTIIEMQEPVSLTFALRYMNSFTKASPLSDQVTISLSSELPVVVEYKIGEMGYIRFYLAPKIEEDEEMKA

SEQ ID NO: 10635 - protein, 263 aa, Lolium multiflorum
MLELRLVQGSLLKKVLEAIKDLVNDANFDCSGTGFSLQAMDSSHVALVALLLRSEGFEHYRCDRNLSMGMNLTNMAKMLRCAGNDDIITIKADDGSDTVTFMFESPNQDKIADFEMKLMDIDSEHLGIPDSEYQAIVRMPSSEFSRICKDLSSIGDTVIISVTKEGVKFSTAGDIGTANIVCRQNKTVDKPEESTIIEMQEPVSLTFALRYMNSFTKASPLSDQVTISLSSELPVVVEYKIGEMGYIRFYLAPKIEEDEEMKA

SEQ ID NO: 10636 - protein, 263 aa, Avena sativa
MLELRLVQGSLLKKVLEAIKDLVNDANFDCSGTGFSLQAMDSSHVALVALLLRSEGFEHYRCDRNLSMGMNLGNMSKMLRCAGNDDIITIKADDGSDTVTFMFESPNQDKIADFEMKLMDIDSEHLGIPDSEYQAIVRMPSSEFSRICKDLSSIGDTVIISVTKEGVKFSTAGDIGTANIVCRQNKTVDKPEESTIIEMQEPVSLTFALRYMNSFTKASPLSDQVTISLSSELPVVVEYKIAEMGYIRFYLAPKIEEDEEMKA

SEQ ID NO: 10637 - protein, 263 aa, Secale cereale
MLELRLVQGSLLKKVLEAIKDLVTDANFDCSGTGFSLQAMDSSHVALVALLLRSEGFEHYRCDRNLSMGMNLGNMAKMLRCAGNDDIITIKADDGSDTVTFMFESPNQDKIADFEMKLMDIDSEHLGIPDSEYQAIVRMPSSEFSRICKDLSSIGDTVIISVTKEGVKFSTAGDIGTANIVCRQNNTVDKPEQSTIIEMQEPVSLTFALRYMNSFTKASPLSDQVTISLSSELPVVVEYKIGEMGYIRFYLAPKIEDDEEMKA

SEQ ID NO: 10638 - protein, 263 aa, Cenchrus ciliaris
MLELRLVQGSLLKKVLEAIRELVTDANFDCSGTGFSLQAMDSSHVALVALLLRAEGFEHYRCDRNLSMGMNLNNMAKMLRCAGNDDIITIKADDGSDTVTFMFESPKQDKIADFEMKLMDIDSEHLGIPDSEYQAIVRMPSAEFMRICKDLSSIGDTVIISVTKEGVKFSTSGEIGSANIVCRQNQTVDKPEEATIIEMQEPVSLTFALRYMNSFTKASSLSDQVTISLSSELPVVVEYKIAEMGYIRFYLAPKIEEDEEMKP

SEQ ID NO: 10639 - protein, 263 aa, Pennisetum glaucum
MLELRLVQGSLLKKVLEAIRELVTDANFDCSGTGFSLQAMDSSHVALVALLLRAEGFEHYRCDRNLSMGMNLNNMAKMLRCAGNDDIITIKADDGSDTVTFMFESPKQDKIADFEMKLMDIDSEHLGIPDSEYQAIVRMPSAEFMRICKDLSSIGDTVVISVTKEGVKFSTSGEIGSANIVCRQNQTVDKPEEATIIEMQEPVSLTFALRYMNSFTKASTLSEQVTISLSSELPVVVEYKIAEMGYIRFYLAPKIEEDEEMKP

SEQ ID NO: 10640 - protein, 263 aa, Festuca arundinacea
QGELRLVQGSLLKKVLEAIKDLVNDANFDCSGTGFSLQAMDSSHVALVALLLRSEGFEHYRCDRNLSMGMNLTNMSKMLRCAGNDDIITIKADDGSDTVTFMFESPNQDKIADFEMKLMDIDSEHLGIPDSEYQAIVRMPSSEFSRICKDLSSIGDTVVISVTKEGVKFSTAGDIGTANIVCRQNKTADKPEDSTIIEMQEPVSLTFALRYMNSFTKASPLSDQVTISLSSELPVVVEYKIGEMGYIRFYLAPKIEEDEEMKA

SEQ ID NO: 10641 - protein, 263 aa, Setaria italica
MLELRLVQGSLLKKVLEAIRELVTDANFDCSGTGFSLQAMDSSHVALVALLLRAEGFEHYRCDRNLSMGMNLNNMAKMLRCAGNDDIITIKADDGSDTVTFMFESPKQDKIADFEMKLMDIDSEHLGIPDSEYQAIVRMPSAEFMRICKDLSSIGDTVIISVTKEGVKFSTSGEIGSANIVCRQNQTVDKPEEATVIEMQEPVSLTFALRYMNSFTKASSLSDQVTISLSSELPVVVEYKIAEMGYIRFYLAPKIEEDEEMKP

SEQ ID NO: 10642 - protein, 263 aa, Sorghum bicolor
MLELRLVQGSLLKKVLEAIRELVTDANFDCSGTGFSLQAMDSSHVALVALLLRAEGFEHYRCDRNLSMGMNLNNMAKMLRCAGNDDIITIKADDGSDTVTFMFESPKQDKIADFEMKLMDIDSEHLGIPDSEYQAIVRMPSAEFMRICKDLSSIGDTVVISVTKEGVKFSTSGEIGSANIVCRQNQTIDKPEEATIIEMQEPVSLTFALRYMNSFTKASSLSEQVTISLSSELPVVVEYKIAEMGYIRFYLAPKIEEDEEMKA

SEQ ID NO: 10643 - protein, 263 aa, Saccharum officinarum
MLELRLVQGSLLKKVLEAIRELVTDANFDCSGTGFSLQAMDSSHVALVALLLRAEGFEHYRCDRNLSMGMNLNNMAKMLRCAGNDDIITIKADDGSDTVTFMFESPKQDKIADFEMKLMDIDSEHLGIPDSEYQAIVRMPSAEFMRICKDLSSIGDTVVISVTKEGVKFSTSGEIGSANIVCRQNQTIDKPEEATIIEMQEPVSLTFALRYMNSFTKASSLSEQVTISLSSELPVVVEYKIAEMGYIRFYLAPKIEEDEEMKP

SEQ ID NO: 10644 - protein, 263 aa, Zea mays
MLELRLVQGSLLKKVLEAIRELVNDANFDCSGTGFSLQAMDSSHVALVALLLRAEGFEHYRCDRNLSMGMNLNNMAKMLRCAGNDDIITIKADDGSDTVTFMFESPKQDKIADFEMKLMDIDSEHLGIPDSEYQAIVRMPSSEFMRICKDLSSIGDTVVISVTKEGVKFSTSGEIGSANIVCRQNQTIDKPEEATIIEMQEPVSLTFALRYMNSFTKASSLSEQVTISLSSELPVVVEYKIAEMGYIRFYLAPKIEDDEEMKP

SEQ ID NO: 10645 - protein, 263 aa, Festuca arundinacea
  misc_feature (188)..(188): Xaa can be any naturally occurring amino acid
  misc_feature (193)..(193): Xaa can be any naturally occurring amino acid
QGELRLVQGSLLKKVLEAIKDLVNDANFDCSGTGFSLQAMDSSHVALVALLLRSEGFEHYRCDRNLSMGMNLTNMSKMLRCAGNDDIITIKADDGSDTVTFMFESPNQDKIADFEMKLMDIDSEHLGIPDSEYQAIVRMPSSEFSRICKDLSSIGDTVVISVTKEGVKFSTAGDIGTANIVCRQNKTXDKPEXSTIIEMQEPVSLTFALRYMNSFTKASPLSDQVTISLSSELPVVVEYKIGEMGYIRFYLAPKIEEDEEMKA

SEQ ID NO: 10646 - protein, 263 aa, Zea mays
MLELRLVQGSLLKKVLEAIRELVTDANFDCSGTGFSLQAMDSSHVALVALLLRAEGFEHYRCDRNLSMGMNLNNMAKMLRCAGNEDIITIKADDGSDTVTFMFESPKQDKIADFEMKLMDIDSEHLGIPDSEYQAIVRMPSAEFMRICKDLSSIGDTVVISVTKEGVKFSTSGEIGSANIVCRQNQTIDKPEEATIIEMQEPVSLTFALRYMNSFTKASSLSEQVTISLSSELPVVVEYKIAEMGYIRFYLAPKIDDDEEMKP

SEQ ID NO: 10647 - protein, 263 aa, Musa acuminata
MLELRLVQGSLLKKVLESIRELVTDANFDCSATGFSLQAMDSSHVALVALLLRSEGFEHYRCDRNLSMGMNLNNVSKMLRCAGNDDIITVKADDGSDTVTFMFESPNQDKIADFEMKLMDIDSEHLGIPDAEYQAIVRMPSSEFARICKDLSSIGDTVIISVTKEGVKFSTAGDIGTANIVCRQNKTVDKPEEATIIEMQEPVSLTFALRYLNSFTKATPLSETVAISLSSDLPVVVEYKIAEMGYIRFYLAPKIEEDDDMKP

SEQ ID NO: 10648 - protein, 263 aa, Cenchrus ciliaris
  misc_feature (158)..(159): Xaa can be any naturally occurring amino acid
  misc_feature (179)..(179): Xaa can be any naturally occurring amino acid
MLELRLVQGSLLKKVLEAIRELVTDANFDCSGTGFSLQAMDSSHVALVALLLRAEGFEHYRCDRNLSMGMNLNNMAKMLRCAGNDDIITIKADDGSDTVTFMFESPKQDKIADFEMKLMDIDSEHLGIPDSEYQAIVRMPSAEFMRICKDLSSIGDTXXISVTKEGVKFSTSGEIGSAXIVCRQNQTVDKPEEATIIEMQEPVSLTFALRYMNSFTKASSLSDQVTISLSSELPVVVEYKIAEMGYVRFYLAPKIEEDEEMKP

SEQ ID NO: 10649 - protein, 263 aa, Panicum virgatum
MLELRLVQGSLLKKVLEAIRDLVNEANFDCSGTGFSLQAMDSSHVALVALLLRAEGFEHYRCDRNLSMGMNLNNMAKMLRCAGNEDIITIKADDGSDTVTFMFESPKQDKIADFEMKLMDIDSEHLGIPDSEYQAIVRMPSAEFMRICKDLSSIGDTVVISVTKEGVKFSTSGEIGSANIVCRQNQTVDKPEEATIIEMQEPVSLTFALRYMNSFTKASTLSDQVTISLSSELPVVVEYKIAEMGYIRFYLAPKIEEDEEMKP

SEQ ID NO: 10650 - protein, 255 aa, Cenchrus ciliaris
GSLLKKVLEAIRELVTDANFDCSGTGFSLQAMDSSHVALVALLLRAEGFEHYRCDRNLSMGMNLNNMAKMLRCAGNDDIITIKADDGSDTVTFMFESPKQDKIADFEMKLMDIDSEHLGIPDSEYQAIVRMPSAEFMRICKDLSSIGDTVVISVTKEGVKFSTSGEIGSANIVCRQNQTVDKPEEATTIEMQEPVSLTFALRYMNSFTKASTLSEQVTISLSSELPVVVEYKIAEMGYIRFYLAPKIEEDEEMKP

SEQ ID NO: 10651 - protein, 264 aa, Orobanche aegyptiaca
MLELRLVQGSLLKKVLEAIKDLVNDANFDCSATGFSLQAMDSSHVALVALLLRSEGFEHYRCDRNLSMGMNLNNMAKMLKCAGNDDIITIKADDGSDTVTFMFESPTQDKIADFEMKLMDIDSEHLGIPEAEYHAIVRMPSSEFARICKDLSSIGDTVVISVTKEGVKFSTRGDIGTANVVCRQNTTVDKPEDATVIEMNEPVSLTFALRYLNSFTKATPLSNTVTISLSSELPVVVEYKIAEMGYIRFYLAPKIEEDDEETKP

SEQ ID NO: 10652 - protein, 266 aa, Vitis vinifera
MLELRLVQGSLLKKVLEAIKDLVNDANFDCSATGFSLQAMDSSHVALVALLLRSEGFEHYRCDRNISMGMNLNNMSKMLKCAGNDDIITIKADDGSDTVTFMFESPTQDKIADFEMKLMDIDSEHLGIPEAEYHAIVRMPSSEFQRICKDLSSIGDTVVISVTKEGVKFSTRGDIGTANIVCRQNTTVDKPEEATVIEMNEPVSLTFALRYMNSFTKATPLSNTVTISLSSELPVVVEYKIAEMGYIRFYLAPKIEEDEDETKPQA

SEQ ID NO: 10653 - protein, 264 aa, Artemisia annua
MLELRLVQGSLLKKVMESIKDLVNDANFDCSSTGFSLQAMDSSHVALVSLLLRSEGFEHYRCDRNISMGMNLGNMSKMLKCAGNDDIITIKADDGSDTVTFMFESPTQDKIADFEMKLMDIDSEHLGIPEAEYHAIVRMPSAEFARICKDLSSIGDTVVISVTKEGVKFSTRGDIGTANIVCRQNTTVDKPEEATIIEMNEPVSLTFALRYMNSFTKASPLSSTVTISLSSELPVVVEYKIAEMGYIRFYLAPKIEEDDEENKS

SEQ ID NO: 10654 - protein, 264 aa, Panax ginseng
MLELRLVQGSLLKKVMDSIKDLVNDANFDCSATGFSLQAMDSSHVALVALLLRSEGFEHYRCDRNISMGMNLNNMAKMLKCAGNDDIITIKADDGSDTVTFMFESPTQDKIADFEMKLMDIDSEHLGIPEAEYQAIVRMPSAEFARICKDLSSIGDTVVISVTKEGVKYSTRGDIGTANVVCRQNTTVDKPEEATIIEMNEPVSLTFALRYMNSFTKASPLSSTVTISLSSELPVVVEYKIAEMGYIRFYLAPKIEEDDDESKP

SEQ ID NO: 10655 - protein, 264 aa, Vaccinium corymbosum
MLELRLVQGSLLKKVLESIKDLVNDANFDCSATGFSLQAMDSSHVALVALLLRSEGFEHYRCDRNISMGMNLNNMAKMLKCAGNDDIITLKADDGSDTVTFMFESPTQDKIADFEMKLMDIDSEHLGIPEAEYHAIVRMPSSEFARICKDLSSIGDTVVISVTKEGVRFSTRGDIGTANVVCRQNTTVDKPEEATIIEMNEPVSLTFALRYMNSFTKATPLSSTVTISLSSELPVVVEYKIAEMGYIRFYLAPKIEEDDDEAKP

SEQ ID NO: 10656 - protein, 264 aa, Flaveria ramosissima
MLELRLVQGSLLKKVMESIKDLVTDANFDCSATGFSLQAMDSSHVALVSLLLRSEGFEHYRCDRNISMGMNLNNMSKMLKCAGNDDIITLKADDGSDTVTFMFESPTQDKIADFEMKLMDIDSEHLGIPEAEYHAIVRMPSSEFARICKDLSSIGDTVVISVTKEGVKFSTRGDIGTANVVCRQNTTVDKPEEATVIEMNEPVSLTFALRYMNSFTKATPLSSTVTISLSSELPVVVEYKIAEMGYIRFYLAPKIEEDDEENKS

SEQ ID NO: 10657 - protein, 264 aa, Actinidia deliciosa
MLELRLVQGSLLKKVMESIKDLVNDANFDCSATGFSLQAMDSSHVALVALLLRSEGFEHYRCDRNISMGMNLNNMAKMLKCAGNDDIITLKADDGSDTVTFMFESPTQDKIADFEMKLMDIDSEHLGIPEAEYHAIVRMPSSEFARICKDLSSIGDTVVISVTKEGVRFSTRGDIGTANVVCRQNTTVDKPEEATIIEMNEPVSLTFALRYMNSFTKATPLSNTVTISLSSELPVVVEYKIAEMGYIRFYLAPKIEEDDEETKP

SEQ ID NO: 10658 - protein, 109 aa, Fagus grandifolia
MLELRLVQGSLLKKVLESIKDLVNDANFDCSATGFSLQAMDSSHVALVALLLRSEGFEHYRCDRNMSMGMNLNNMSKMLKCAGNDDIITIKADDGSDTVTFMFETPHPR

SEQ ID NO: 10659 - protein, 263 aa, Carica papaya
MLELRLVQGSLLKKVLEAIKDLVNDANFDCSATGFSLQAMDSSHVALVALLLRSEGFEHYRCDRNISMGMNLNNMSKMLKCAGNDDIITIKADDGSDTVTFMFESPTQDKIADFEMKLMDIDSEHLGIPEAEYHAIVRMPSSEFARICKDLSSIGDTVVISVTKEGVKFSTRGDIGTANIVLRQNTTVDKPEEATIIEMNEPVSLTFALRYMNSFTKATPLSNTVTISLSSDLPVVVEYKVAEMGYIRFYLAPKIEEEEGEAS

SEQ ID NO: 10660 - protein, 266 aa, Theobroma cacao
MLELRLVQGSLLKKVLEAIKDLVTDANFDCSATGFSLQAMDSSHVALVALLLRSEGFEHYRCDRNISMGMNLNNMSKMLKCAGNDDIITIKADDGSDTVTFMFESPTQDKISDFEMKLMDIDSEHLGIPEAEYHAIVRMPSAEFARICKDLASIGDTVVISVTKEGVKFSTRGDIGTANIVLRQNTTVDKPEEATIIEMNEPVSLTFALRYMNSFTKATPLSNTVTISLSSELPVVVEYKIAEMGYIRFYLAPKIEEDEDETKPQV

SEQ ID NO: 10661 - protein, 266 aa, Quercus alba
MLELRLVQGSLLKKVLESVKDLVNDANFDCSATGFSLQAMDSSHVALVALLLRSEGFEHYRCDRNLSMGMNLNNMSKMLKCAGNDDIITIKADDGSDTVTFMFESPTQDKIADFEMKLMDIDSEHLGIPEAEYHAIVRMPSAEFARICKDLSSIGDTVVISVTKEGVKFSTRGDIGTANIVCRQNTTVDKPEEATIVEMNEPVSLTFALRYMNSFTKATPLSNTVTISLSSELPVVVEYKIAEMGYIRFYLAPKIEEDEDETKPQA

SEQ ID NO: 10662 - protein, 264 aa, Artemisia annua
MLELRLVQGSLLKKVMESIKDLVNDANFDCSATGFSLQAMDSSHVALVSLLLRSEGFEHYRCDRNLSMGMNLGNLSKMLKCAGNDDIITLKADDGSDTVTFMFESPTQDKIADFEMKLMDIDSEHLGIPEAEYHAIVRMPSAEFARICKDLSSIGDTVVISVTKEGVKFSTRGDIGTANVVCRQNTTVDKPEEATIIEMNEPVSLTFALRYMNSFTKASPLSSTVTISLSSELPVVVEYKIAEMGYIRFYLAPKIEEDDEENKS

SEQ ID NO: 10663 - protein, 264 aa, Catharanthus roseus
MLELRLVQGSLLKKVLESLKDLVTDANFDCSASGFSLQAMDSSHVALVALLLRSEGFEHYRCDRNLSMGMNLNNMAKMLKCAGNDDIITLKADDGSDTVTFMFESPTQDKISDFEMKLMDIDSEHLGIPEAEYHAIVRMPSAEFARICKDLSSIGDTVVISVTKEGVKFSTRGDIGTANIVCRQNTTVDKPDEATIIEMNEPVSLTFALRYLNSFTKATPLSNTVTISLSSELPVVVEYKIAEMGYIRFYLAPKIEEDDEEAKP

SEQ ID NO: 10664 - protein, 264 aa, Tropaeolum majus
MLELRLVQGSLLKKVLESIKDLVNDANFDCSATGFSLQAMDSSHVALVALLLRSEGFEHYRCDRNLSMGMNLGNMSKMLKCAGNDDIITIKADDGSDTVTFMFESPTQDKIADFEMKLMDIDSEHLGIPEAEYHAIVRMPSAEFARICKDLSSIGDTVVISVTKEGVKFSTRGDIGTANIVLRQNTTVDKPEEATIIEMKEPVSLTFALRYMNSFTKATPLSNTVTISLSSELPVVVEYKIAEMGHVRFYLAPKIEEDEDETKP

SEQ ID NO: 10665 - protein, 260 aa, Helianthus annuus
MLELRLVQGSLLKKVMESLKDLVTDANFDCSATGFSLQAMDSSHVALVSLLLRSEGFEHYRCDRNLSMGMNLNNMSKMLKCAGNDDIITLKADDGSDTVTFMFESPTQDKIADFEMKLMDIDSEHLGIPEAEYHAIVRMPSSEFARICKDLSSIGDTVVISVTKEGVKFSTRGDIGTANVVCRQNTTVDKPEEATVIEMNEPVSLTFALRYMNSFTKATPLSSTVTISLSSELPVVVEYKIAEMGYIRFYLAPKIEEDEE

SEQ ID NO: 10666 - protein, 264 aa, Nicotiana tabacum
MLELRLVQGSLLKKVLESIKDLVNDANFDCSATGFSLQAMDSSHVALVALLLRSEGFEHYRCDRNISMGMNLANMAKMLKCAGNDDIITLKADDGSDTVTFMFESPTQDKIADFEMKLMDIDSEHLGIPEAEYHAIVRMPSAEFSRICKDLSSIGDTVVISVTKEGVKFSTRGDIGTANIVCRQNTTVDKPEEATVIEMNEPVSLTFALRYLNSFTKATPLSNTVTISLSSELPVVVEYKIAEMGYIRFYLAPKIEEDEEETKP

SEQ ID NO: 10667 - protein, 158 aa, Guizotia abyssinica
MLELRLVQGSLLKKVMESIKDLVTDANFDCSATGFSLQAMDSSHVALVSLLLRSEGFEHYRCDRNLSMGMNLNNMSKMLKCAGNDDIITIKADDGSDTVTFMFESPTQDKIADFEMKLMDIDSEHLEFRKPSTMLLFGCLHPSLPGFVKISAVLVTQL

SEQ ID NO: 10668 - protein, 322 aa, Quercus alba
MLELRLVQGSLLKKVLESVKDLVNDANFDCSATGFSLQAMDSSHVALVALLLRSEGFEHYRCDRNLSMGMNLNNMAKMLKCAGNDDIVTIKADDGGDTVTFMFESPTQDKIADFEMKLMDIDSEHLGIPEAEFQAIVRMPSAEFARICKDLSSIGDTVVISVTKEGVKFSTRGDIGTANIVCRQNTTVDKPDDATIIEMQEPVSLTFALRYMNSFTKATPLSNQVTISLSSELPVVVEYKVAEMGYIRFYLAPKLEEDDIENQAEARPEVNKKPKDEPIVDAKPISEIKPKLEVKAEDENKPQIESTTAVGSKEEIDLMDDE

SEQ ID NO: 10669 - protein, 266 aa, Cyamopsis tetragonoloba
MLELRLVQGSLLKKVLEAIKELVNDANFDCSATGFSLQAMDSSHVALVALLLRSEGFEHYRCDRNISMGMNLNNMSKMLRCAGNDDIITIKADDGSDTVTFMFESPTQDKISDFEMKLMDIDSEHLGIPDAEYHAIVRMPSAEFARICKDLSSIGDTVVISVTKEGVKFSTKGDIGTANIVCRQNTSVDKPEEATVIEMNEPVSLTFALRYMNSFTKATPLSNTVTISLSNELPVVVEYKIAEMGYVRFYLAPKIEEDEEETKPQV

SEQ ID NO: 10670 - protein, 120 aa, Cannabis sativa
MLELRLVQGSLLKKVMEALKDLVTDANFDCSATGFSLQAMDSSHVALVALLLRSEGFEHYRCDRNLSMGMNLNNMSKMLKCAGNDDIITIKADDGSDTVTFMFESPTQDKIADFEMKLMR

SEQ ID NO: 10671 - protein, 261 aa, Abies balsamea
MLELRLVQGSLLKKVLEAIKDLVTDANFDCSATGFSLQAMDSSHVALVSLLLRSEGFEHYRCDRNMSMGMNLNNMAKMLKCAGNDDIITIKADDGGDTVTFMFESPNQDKISDFEMKLMDIDSEHLGIPESEYHAIVRMPSQEFARICKDLSSIGDTVVISVSKEGVKFSTRGDIGSANIVCRQNPSVDKPDEATIIEMQEPVSLTFALRYMNSFTKATPLSNTVTISMSSELPVVVEYKIAEMGYIRFYLAPKIEEEGET

SEQ ID NO: 10672 - protein, 262 aa, Abies balsamea
MLELRLVQGSLLKKVLEAIKDLVTDANFDCSATGFSLQAMDSSHVALVALLLRSEGFEHYRCDRNMSMGMNINNMSKMLKCAGNDDIITIKADDGGDIVTFMFESPNQDKISDFEMKLMDIDTEHLGIPESEYQAIVRMPSHEFARICKDLSTIGDTVVISVTKEGVKFSTRGDIGSANIVCRQNTSVDKPEEATLIEMQEPVSLTFALRYMNSFTKASPLSNIVTISMSSDLPVVVEYKIAEMGYIRFYLAPKIEEEEGES

SEQ ID NO: 10673 - protein, 264 aa, Amorphophallus konjac
MLELRLLQGSLLKKVMEAIKDLVTDANFDCSATGFSLQAMDSSHVALVALLLRSEGFDHYRCDRNLSMGMNLNNMSKMLKCAGNDDIITIKADDGGDTVTFMFESPNQDKIADFEMKLMDIDSEHLGIPEAEYHAIVHMPSSEFSRICKDLSSIGDTVVISVTKEGVKFSTRGDIGAANIVCRQNTTVDKPEEATIIEMHQAVSLTFALRYMNSFTKATPLSSTVTISLSSELPVVVEYKIAEMGYIRFYLAPKIEDEEEDVKP

SEQ ID NO: 10674 - protein, 264 aa, Amsonia hubrichtii
MLELRLVQGSLLKKVLESIKDLVTDANFDCSASGFSLQAMDSSHVALVALLLRSEGFEHYRCDRNISMGMNLNNMAKMLKCAGNDDIITLKADDGSDTVTFMFESPTQDKISDFEMKLMDIDSEHLGIPEAEYHAIVRMPSAEFARICRDLSSIGDTVVISVTKEGVKFSTRGDIGTANIVCRQNTTVDKPDEATIIEMNEPVSLTFALRYLNSFTKATPLSNTVTISLSSELPVVVEYKIAEMGYIRFYLAPKIEEDDEETKP

SEQ ID NO: 10675 - protein, 263 aa, Arabidopsis lyrata
MLELRLVQGSLLKKVLEAVKDLVNDANFDCSSTGFSLQAMDSSHVALVSLLLRSEGFEHYRCDRNLSMGMNLGNMSKMLKCAGNDDIITIKADDGSDTVTFMFESPTQDKIADFEMKLMDIDSEHLGIPDAEYHSIVRMPSGEFSRICKDLSSIGDTVVISVTKEGVKFSTAGDIGTANIVLRQNTTVDKPEDAIVIEMNEPVSLSFALRYMNSFTKATPLSETVTISLSSELPVVVEYKVAEMGYIRYYLAPKIEEEEDTKP

SEQ ID NO: 10676 - protein, 264 aa, Unknown
  Sequence found in Organisms: Solanum lycopersicum, Solanum tuberosum, Solanum phureja
MLELRLVQGSLLKKVLESIKDLVNDANFDCSATGFSLQAMDSSHVALVALLLRSEGFEHYRCDRNISMGMNLTNMAKMLKCAGNDDIITIKADDGSDTVTFMFESPTQDKIADFEMKLMDIDSEHLGIPEAEYHAIVRMPSAEFGRICKDLSSIGDTVVISVTKEGVKFSTRGDIGTANIVCRQNTTVDKPEEATVIEMNEPVSLTFALRYLNSFTKASPLSNTVTISLSSELPVVVEYKIAEMGYVRYYLAPKIEEDEEETKP

SEQ ID NO: 10677 - protein, 262 aa, Pseudotsuga menziesii
MLELRLVQGSLLKKVLEAIKDLVTDANFDCSATGFSLQAMDSSHVALVALLLRSEGFEHYRCDRNMSMGMNINNMSKMLKCAGNDDIITIKADDGGDTVTFMFESPNQDKISDFEMKLMDIDTEHLGIPESEYQAIVRMPSTEFARICKDLSTIGDTVVISVTKEGVKFSTRGDIGSANIVCRQNTSVDKPEEATLIEMQEPVSLTFALRYMNSFTKASPLSNIVTISMSSDLPVVVEYKIAEMGYIRYYLAPKIEEEEGES

SEQ ID NO: 10678 - protein, 264 aa, Helianthus annuus
MLELRLVQGSLLKKVMESIKDLVNDANFDCSATGFSLQAMDSSHVALVSLLLRSEGFEHYRCDRNISMGMNLNNMSKMLKCAGNDDIITLKADDGSDTVTFMFESPTQDKIADFEMKLMDIDSEHLGIPEAEYHAIVRMPSAEFARICKDLSSIGDTVVISVTKEGVKFSTRGDIGTANVVCRQNTTVDKPEEATVIEMNEPVSLTFALRYMNSFTKATPLSSTVTISLSSELPVVVEYKIAEMGYIRFYLAPKIEEDDEENKS

SEQ ID NO: 10679 - protein, 364 aa, Helianthus annuus
MLELRLVQGSLLKKVMESIKDLVNDANFDCSATGFSLQAMDSSHVALVSLLLRSEGFEHYRCDRNLSMGMNLGNMAKMLRCAGNDDIVTIKADDGGDCVTFMFESPNQDKIADFEMKLMDIDSEHLGIPEAEYEAIVRMPSSEFARICKDLSSIGDTVVISVTKEGVKFSTKGDIGTANIVCRQNTSVDKPEEATIIEMQTPVSLTFALRYMNSFTKATPLASQVTVSLSSELPIVVEYKIAEMGYLRFYLAPKIEEDEEMGGQQPEPVETKKQPEKKPKTEPKSNGEPKRRVMKIDLDDEEEELKPKVEAKSDADGYVEVIGSKPGNGIVKPKEEINGGDEVMDVKPKIENGTNGEVQVMDEE

SEQ ID NO: 10680 - protein, 266 aa, Gossypium raimondii
MLELRLVQGSLLKKVLEAIKDLVNDANFDCSATGFSLQAMDSSHVALVALLLRSEGFEHYRCDRNISMGMNLGNMSKMLKCAGNDDIITIKADDGSDTVTFMFESPTQDKISDFEMKLMDIDSEHLGIPEAEYHAIVRMPSAEFARICKDLASIGDTVVISVTKEGVKFSTRGDIGTANIVLRQNTTVDKPEEATIIEMNEPVSLTFALRYMNSFTKATPLSNTVTISLSSELPVVVEYKIAEMGYIRFYLAPKIEEDEDETKPQV

SEQ ID NO: 10681 - protein, 266 aa, Cicer arietinum
MLELRLVQGSLLKKVLEAIKELVNDANFDCSSTGFSLQAMDSSHVALVALLLRSEGFEHYRCDRNISMGMNLNNMAKMLKCAGNDDIITIKADDGSDTVTFMFESPTQDKISDFEMKLMDIDSEHLGIPEAEYHAIVRMPSSEFARICKDLSSIGDTVVISVTKEGVKFSTKGDIGTANIVCRQNTTVDKPEEATVVEMNEPVSLQFALRYMNSFTKATPLSSTVTISLSNELPVVVEYKIAEMGYVRFYLAPKIEEDEEETKPQV

SEQ ID NO: 10682 - protein, 266 aa, Unknown
  Sequence found in Organisms: Citrus clementina, Citrus sinensis
MLELRLVQGSLLKKVLEAIKELVNDANFDCSATGFSLQAMDSSHVALVALLLRSEGFEHYRCDRNISMGMNLNNVSKMLKCAGNDDIITLKADDGSDTVTFMFESPTQDKIADFEMKLMDIDSEHLGIPEAEYHAIVRMPSAEFARICKDLASIGDTVVISVTKEGVKFSTRGDIGTANIVLRQNTTVDKPEEATIIEMHEPVSLTFALRYMNSFTRATPLSNTVTISLSSELPVVVEYKIAEMGYIRFYLAPKIEEDEDETKPQV

SEQ ID NO: 10683 - protein, 266 aa, Euonymus alatus
MLELRLVQGSLLKKVLESIKDLVNDANFDCSATGFSLQAMDSSHVALVALLLRSEGFEHYRCDRNLSMGINLNNMSKMLRCAGNDDIITIKADDGSDTVTFMFESPTQDKISDFEMKLMDIDSEHLGIPEAEYHAIVRMPSAEFARICKDLSSIGDTVVISVTKEGVKFSTRGDIGAANIVLRQNTTVDKPEEATIIEMNEPVSLTFALRYMNSFTKATPLSNTVTISLSSELPVVVEYKIAEMGYIRFYLAPKIEEDDDETKPGI

SEQ ID NO: 10684 - protein, 265 aa, Allium cepa
MLELRLVQGSLLKKVLEAIKDLVTDANFDCSSSGFSLQAMDSSHVALVALLLRSEGFEHYRCDRNISMGMNLNNMAKMLKCAGNDDIITLKADDGGDTVTFMFESPRQDKIADFEMKLMDIDSEHLGIPEAEYQAIVRMPSSEFARICKDLSSIGDTVVISVTKEGVKFSTRGDIGSANIVCRQNTTVDKPDEAIVIEMNEAVSLTFALRYMNSFTKATPLSETVTLSLSSELPVVVEYKIADMGYIRFYLAPKIEDDEEMKEGS

SEQ ID NO: 10685 - protein, 266 aa, Trigonella foenum-graecum
MLELRLVQGSLLKKVLESIKELVNDANFDCSSTGFSLQAMDSSHVALVALLLRSEGFEHYRCDRNLSMGMNLNNMAKMLKCAGNDDIITIKADDGSDTVTFMFESPTQDKISDFEMKLMDIDSEHLGIPEAEYDAIVRMPSAEFARICKDLSSIGDTVVISVTKEGVKFSTKGDIGAANIVCRQNTTVDKPDDATVIEMKEPVSLQFALRYMNSFTKATPLSSTVTISLSNELPVVVEYKIAEMGYVRFYLAPKIEEDDEETKPQV

SEQ ID NO: 10686 - protein, 266 aa, Triphysaria pusilla
MLELRLVQGSLLKKVLDAVKDLVNDANFDCSATGFSLQAMDSSHVALVALLLRSEGFEHYRCDRNLSMGMNLGNMAKMLKCAGNDDIITIKADDGSDTVTFMFESPTQDKIADFEMKLMDIDSEHLGIPEAEYHAIVRMPSSEFGRICKDLSSIGDTVVISVTKEGVKFSTRGDIGTANVVCRQNTTVDKPEDATVIEMNEPVSLTFALRYLNSFTKASPLSNTVTISLSSELPVVVEYKIAEMGYVRFYLAPKIEDDDDETKPMS

SEQ ID NO: 10687 - protein, 266 aa, Triphysaria pusilla
MLELRLVQGSLLKKVLDAVKDLVNDANFDCSATGFSLQAMDSSHVALVALLLRSEGFEHYRCDRNLSMGMNLGNMAKMLKCAGNDDIITIKADDGSDTVTFMFESPTQDKIADFEMKLMDIDSEHLGIPEAEYHAIVRMPSSEFGRICKDLSSIGDTVVISVTKEGVKFSTRGDIGTANVVCRQNTTVDKPEDATVIEMNEPVSLTFALRYLNSFTKASPLSSTVTISLSSELPVVVEYKIAEMGYVRFYLAPKIEDDDDETKPMS

SEQ ID NO: 10688 - protein, 266 aa, Medicago truncatula
MLELRLVQGSLLKKVLESIKELVNDANFDCSSTGFSLQAMDSSHVALVALLLRSEGFEHYRCDRNLSMGMNLNNMAKMLKCAGNDDIITIKADDGSDTVTFMFESPTQDKISDFEMKLMDIDSEHLGIPEAEYDAIVRMPSAEFARICKDLSSIGDTVVISVTKEGVKFSTKGDIGAANIVCRQNTTVDKPDDATVIEMKEPVSLQFALRYMNSFTKATPLSSTVTISLSNELPVVVEYKIAEMGYVRFYLAPKIEEDDEETKPEV

SEQ ID NO: 10689 - protein, 264 aa, Echinacea purpurea
MLELRLVQGSLLKKVMESIKDLVNDANFDCSATGFSLQAMDSSHVALVSLLLRSEGFEHYRCDRNISMGMNLNNMSKMLKCAGNDDIITLKADDGSDTVTFMFESPTQDKIADFEMKLMDIDSEHLGIPEAEYHAIVRMPSAEFARICKDLSSIGDTVVISVSKEGVKFSTRGDIGTANVVCRQNTTVDKPEEATVIEMNEPVSLTFALRYMNSFTKATPLSSTVTISLSSELPVVVEYKIAEMGYIRFYLAPKIEEDDEENKS

SEQ ID NO: 10690 - protein, 264 aa, Arabidopsis thaliana
MLELRLVQGSLLKKVLEAVKDLVNDANFDCSTTGFSLQAMDSSHVALVSLLLRSEGFEHYRCDRNLSMGMNLGNMSKMLKCAGNDDIITIKADDGSDTVTFMFESPTQDKIADFEMKLMDIDSEHLGIPDAEYHSIVRMPSGEFSRICKDLSSIGDTVVISVTKEGVKFSTAGDIGTANIVLRQNTTVDKPEDAIVIEMNEPVSLSFALRYMNSFTKATPLSETVTISLSSELPVVVEYKVAEMGYIRYYLAPKIEEEEDTKPE

SEQ ID NO: 10691 - protein, 263 aa, Unknown
  Sequence found in Organisms: Brassica napus, Brassica rapa
MLELRLVQGSLLKKVLESIKDLVNDANFDCSTTGFSLQAMDSSHVALVSLLLRSEGFEHYRCDRNLSMGMNLGNMSKMLKCAGNDDIITIKADDGGDTVTFMFESPKQDKIADFEMKLMDIDSEHLGIPDAEYHSIVRMPSNEFSRICKDLSTIGDTVVISVTKEGVKFSTAGDIGTANIVLRQNTTVDKPEDAIVIEMNEPVSLSFALRYMNSFTKATPLSDTVTISLSSELPVVVEYKVAEMGYIRYYLAPKIEEDEEDKA

SEQ ID NO: 10692 - protein, 264 aa, Manihot esculenta
MLELRLVQGSLLKKVLEAIKDLVNDANFDCSSTGFSLQAMDSSHVALVALLLRSEGFEHYRCDRNISMGMNLNNMSKMLKCSGNDDIITIKADDGSDTVTFMFESPTQDKISDFEMKLMDIDSEHLGIPEAEYHAIVRMPSAEFAKICKDLASIGDTVVISVTKEGVKFSTRGDIGTANIVVRQNTTVDKPEEATIVEMNEPVSLTFALRYMNSFTKATPLSNTVTISLSSELPVVVEYKIAEMGYIRFYLAPKIEEDEDETKP

SEQ ID NO: 10693 - protein, 262 aa, Cedrus atlantica
MLELRLVQGSLLKKVLEAIKDLVVDANFDCSATGFSLQAMDSSHVALVALLLRSEGFEHYRCDRNMSMGMNINNMSKMLKCAGNDDIITIKADDGGDTVTFMFESPNQDKISDFEMKLMDIDTEHLGIPESEYQAIVRMPSPEFARICKDLSTIGDTVVISVTKEGVKFSTRGDIGSANIVCRQNTSVDKPEEATLIEMQEPVSLTFALRYMNSFTKASPLSNIVTISMSADLPVVVEYKIAEMGYIRFYLAPKIEEEEGES

SEQ ID NO: 10694 - protein, 262 aa, Unknown
  Sequence found in Organisms: Cryptomeria japonica, Sequoia sempervirens
MLELRLVQGSLLKKVLEAIKDLVTDANFDCSATGFSLQAMDSSHVALVALLLRSEGFEHFRCDRNMSMGMNLNNMAKMLKCAGNDDIITIKADDGGDTVTFMFESPNQDKISDFEMKLMDIDTEHLGIPESEYQSIVRMPSQEFARICKDLSTIGDTVVISVTKEGVKFSTKGDIGSANIVCRQNTSVDKPEEATVIEMQEPVSLTFALRYMNSFTKATPLSNSVTISMSSDLPVVVEYKIADMGYIRFYLAPKIEEEEGES

SEQ ID NO: 10695 - protein, 264 aa, Cynara scolymus
  misc_feature (201)..(201): Xaa can be any naturally occurring amino acid
  misc_feature (209)..(209): Xaa can be any naturally occurring amino acid
  misc_feature (216)..(216): Xaa can be any naturally occurring amino acid
MLELGLVQGSLLKKVMESIKDLVNDANFDCSATGFSLQAMDSSHVALVSLLLRSEGFEHYRCDRNLSMGMNLGNMTKMLKCAGNDDIITIKADDGSDTVTFMFESPTQDKIADFEMKLMDIDSEHLGIPEAEYHAIVRMPSSEFARICKDLSSIGDTVVISVTKEGVKFSTRGDIGTANVVCRQNTTVDKPEEATIIEMNXPVSLTFAXRYMNSFXKATPLSSTVTISLSSELPVVVEYKIAEMGYIRFYLAPKIEEDEEDNKS

SEQ ID NO: 10696 - protein, 264 aa, Eucalyptus grandis
MLELRLVQGSLLKKVMESLKDLVNDANFDCSATGFSLQAMDSSHVALVALLLRSEGFEHYRCDRNISMGMNLNNMSKMLKCAGNDDIITIKADDGSDTVTFMFESPTQDKIADFEMKLMDIDSEHLGIPEAEYHAIVRMPSSEFARICKDLSSIGDTVVISVTKEGVKFSTRGDIGTANIVCRQNTTVDKPEEATVIEMNEPVTLTFALRYLNSFTKATPLSNTVTISLSSDLPVVVEYKIAEMGYIRFYLAPKIEEDEDETKP

SEQ ID NO: 10697 - protein, 264 aa, Lactuca sativa
MLELRLVQGSLLKKVMESIKDLVNDANFDCSATGFSLQAMDSSHVALVSLLLRSEGFEHYRCDRNLSMGMNLSNMSKMLKCAGNDDIITLKADDGSDTVTFMFESPTQDKIADFEMKLMDIDSEHLGIPEAEYHAIVRMLSAEFARICKDLSSIGDTVVISVTKEGVKFSTRGDIGTANVVCRQNTTVDKPEEATVIEMNEPVSLTFALRYMNSFTKATPLSSTVTISLSSELPVVVEYKIAEMGYIRFYLAPKIEEDDEENKS

SEQ ID NO: 10698 - protein, 264 aa, Lactuca sativa
MLELRLVQGSLLKKVMESIKDLVNDANFDCSATGFSLQAMDSSHVALVSLLLRSEGFEHYRCDRNISMGMNLSNMSKMLKCAGNDDIITLKADDGSDTVTFMFESPTQDKIADFEMKLMDIDSEHLGIPEAEYHAIVRMPSSEFARICKDLSSIGDTVVISVTKEGVKFSTRGDIGTANVVCRQNTTVDKPEEATVIEMNEPVSLTFALRYMNSFTKATPLSSTVTLSLSSELPVVVEYKIAEMGYIRFYLAPKIEEDDEENKS

SEQ ID NO: 10699 - protein, 264 aa, Unknown
  Sequence found in Organisms: Nicotiana benthamiana, Nicotiana tabacum
MLELRLVQGSLLKKVLESIKDLVNDANFDCSATGFSLQAMDSSHVALVALLLRSEGFEHYRCDRNISMGMNLGNMAKMLKCAGNDDIITLKADDGSDTVTFMFESPTQDKIADFEMKLMDIDSEHLGIPEAEYHAIVRMPSAEFARICKDLSSIGDTVVISVTKEGVKFSTRGDIGTANVVCRQNTTVDKPEEATVIEMNEPVSLTFALRYLNSFTKATPLSNTVTISLSSELPVVVEYKIAEMGYIRFYLAPKIEEDEEETKP

SEQ ID NO: 10700 - protein, 264 aa, Nicotiana benthamiana
MLELRLVQGSLLKKVLESIKDLVNDANFDCSATGFSLQAMDSSHVALVALLLRSEGFEHYRCDRNISMGMNLGNMAKMLKCAGNDDIITLKADDGSDTVTFMFESPTQDKIADFEMKLMDIDSEHLGIPEAEYHAIVRMPSAEFARICKDLSSIGDTVVISVTKEGVKFSTRGDIGTANIVCRQNTTVDKPEEATVIEMNEPVSLTFALRYLNSFTKATPLSNTVTISLSSELPVVIEYKIAEMGYIRFYLAPKIEEDEEETKP

SEQ ID NO: 10701 - protein, 264 aa, Phalaenopsis aphrodite
MLELRLVQGSLLKKVIEAIKDLVTDANFDCSATGFSLQAMDSSHVALVALLLRSEGFEHYRCDRNISMGMNLNNMSKMLKCAGNDDIITIKGDDGSDTVTFMFESPKQDKISDFEMKLMDIDSEHLGIPEAEYHAIVKMPSSEFARICKDLSSIGDTVVISVTKEGVKFSTRGDIGTANIVCRQNKTVDKPEEATIIEMNEPVSLTFALRYLNSFTKATSLSEAVTMSLSSELPLVIEYKIADMGYIRFYLAPKIEDDEEEMKP

SEQ ID NO: 10702 - protein, 262 aa, Pinus taeda
MLELRLVQGSLLKKVLEAIKDLVTDANFDCSATGFSLQAMDSSHVALVALLLRSEGFEHYRCDRNLSMGMNINNMSKMLKCAGNDDIITIKADDGGDTVTFMFESPNQDKISDFEMKLMDIDTEHLGIPESEYQAIVRMPSPEFARICKDLSTIGDTVVISVTKEGVKFSTRGDIGSANIVCRQNTSVDKPEEATLIEMQEPVSLTFALRYMNSFTKASPLSNIVTISMSSDLPVVVEYKIADMGYIRYYLAPKIEEEGGES

SEQ ID NO: 10703 - protein, 261 aa, Pinus taeda
MLELRLVQGSLLKKVLESIKDLVTDANFDCSATGFSLQAMDSSHVALVSLLLRSEGFEHYRCDRNMSMGMNLNNMAKMLKCAGNDDIITIKADDGGDTVTFMFESPNQDKISDFEMKLMDIDSEHLGIPESEYHAIVRMPSQEFARICKDLSSIGDTVVISVSKEGVKFSTRGDIGSANIVCRQNPSVDKPDEATIIEMQEPVSLTFALRYMNSFTKATPLSNTVTISMSSELPVVVEYKIAEMGYIRFYLAPKIEEEGES

SEQ ID NO: 10704 - protein, 262 aa, Sciadopitys verticillata
MLELRLVQGSLLKKVLEAIKDLVNDANFDCSATGFSLQAMDSSHVALVALLLRSEGFEHFRCDRNMSMGMNLNNMAKMLKCAGNDDIITLKADDGGDTVTFMFESPNQDKISDFEMKLMDIDTEHLGIPESEYQAIVRMPSQEFARICKDLSSIGDTVVISVTKEGVKFSTRGDIGSANIVCRQNTSVDKPEEATIIEMQEPVSLTFALRYMNSFSKATPLSNTVTISMSSDLPVVVEYKIADMGYIRFYLAPKIEEEEGES

SEQ ID NO: 10705 - protein, 262 aa, Picea glauca
MLELRLVQGSLLKKVLEAIKDLVTDANFDCSATGFSLQAMDSSHVALVALLLRSEGFEHYRCDRNLSMGMNINNMSKMLKCAGNDDIITIKADDGGDTVTFMFESPNQDKISDFEMKLMDIDTEHLGIPESEYQAIVRMPSHEFARICKDLSTIGDTVVISVTKEGVKFSTRGDIGSANIVCRQNTSVDKPEEATLIEMQEPVSLTFALRYMNSFTKASPLSNIVTISMSADLPVVVEYKIADMGYIRYYLAPKIEEEEGES

SEQ ID NO: 10706 - protein, 264 aa, Tabernaemontana elegans
MLELRLVQGSLLKKVLESVKDLVTDANFDCSASGFSLQAMDSSHVALVALLLRSEGFEHYRCDRNISMGMNLNNMAKMLKCAGNDDIITLKADDGSDTVTFMFESPTQDKISDFEMKLMDIDSEHLGIPEAEYHAIVKMPSAEFARICKDLSSIGDTVVISVTKEGVKFSTRGDIGTANIVCRQNTTVDKPEEATVIEMNEPVSLTFALRYLNSFTKATPLSNTVTISLSSELPVVVEYKIAEMGYIRFYLAPKIEEEDEETKP

SEQ ID NO: 10707 - protein, 227 aa, Gossypium hirsutum
MDSSHVALVALLLRSEGFEHYRCDRNLSMGMNLNNMSKMMKCAGNDDIITIKADDGSDTVTFMFESPTQDKISDFEMKLMDIDSEHLGIPEAEYQSIVRMPSAEFARICKDLASIGDTVVISVTKEGVKFSTRGDIGTANIVLRQNTTVDKPEEATIIEMNEPVSLTFALRYMNSFTKATPLSSTVTISLSSELPVVVEYKIAEMGHIRFYLAPKIEEDEDETNPQG

SEQ ID NO: 10708 - protein, 264 aa, Panax ginseng
MLELRLVQGSLLKKVMDSIKDLVNDANFDCSATGFSLQAMDSSHVALVSLLLRSEGFEHYRCDRNISMGMNLGNMTKMLKCAGNDDIITIKADDGSDTVTFMFESPTQDKIADFEMKLMDIDSEHLGIPEAEYHAIVRMPSAEFARICKDLSSIGDTVVISVTKEGVKFSTRGDIGTANIVCRQNTTVDKPEEATIIEMNEPVSLTFALRYMNSFTKASPLSSTVTISLSSELPVVVEYKIAEMGYIRFYLAPKIEEDDDENKP

SEQ ID NO: 10709 - protein, 266 aa, Lupinus angustifolius
MLELRLVQGSLLKKVLESIRELVNDANFDCSSTGFSLQAMDSSHVALVALLLRSEGFEHYRCDRNMSMGMNLNNMSKMLRCAGNDDIVTIKADDGSDTVTFMFESPTQDKISDFEMKLMDIDSEHLGIPEAEYHAIVRMPSSEFARICKDLSSIGDTVVISVTKEGVKFSTKGDIGAANIVCRQNTSVDKPEEATVIEMTEPVSLTFALRYMNSFTKATPLSSTVTISLSNELPVVVEYKIAEMGYVRFYLAPKIEEDEEETKPQV

SEQ ID NO: 10710 - protein, 266 aa, Arachis hypogaea
MLELRLVQGSLLKKVLEAIRELVNDANFDCSATGFSLQAMDSSHVALVALLLRSEGFEHYRCDRNISMGMNLNNMAKMLRCAGNDDIITVKGDDGSDTVTFMFESPTQDKISDFEMKLMDIDSEHLGIPEAEYHAIVRMPSAEFARICKDLSSIGDTVVISVTKEGVKFSTKGDIGTANIVCRQNSSVDKPEEATTVEMNEPVSLTFALRYMNSFTKATPLSNQVTISLSNELPVVVEYKIAEMGYVRFYLAPKIEEEEEETKPEV

SEQ ID NO: 10711 - protein, 266 aa, Manihot esculenta
MLELRLVQGSLLKKVLEAIKDLVNDANFDCSSTGFSLQAMDSSHVALVALLLRSEGFEHYRCDRNISMGMNLNNMSKMLKCSGNDDIITIKADDGSDTVTFMFESPTQDKISDFEMKLMDIDSEHLGIPEAEYHAIVRMPSAEFAKICKDLSSIGDTVVISVTKEGVKFSTRGDIGTANIVVRQNTTVDKPEEATVIEMNEPVSLTFALRYMNSFTKATPLSNTVTISLSSELPVVVEYKIAEMGYIRFYLAPKIEEDEDETKPHV

SEQ ID NO: 10712 - protein, 264 aa, Cephalotaxus harringtonia
LELRLVQGSLLKKVLEAVKDLVTDANFDCSTTGFSLQAMDSSHVALVALLLRSEGFEHFRCDRNMSMGMNLNNMAKMLKCAGNDDIITLKADDGGDTVTFMFESPNQDKISDFEMKLMDIDSEHLGIPESEYHAIVRMPSQEFARICKDLSSIGDTVVISVTKEGVKFSTRGDIGSANIVCRQNTSVDKPEEATVIEMQEPVSLTFALRYMNSFTKATPLSNTVTISMSSELPVVVEYKIADMGYIRFYLAPKIEEDEEMTAGS

SEQ ID NO: 10713 - protein, 266 aa, Unknown
  Sequence found in Organisms: Gossypium hirsutum, Gossypium raimondii
MLELRLVQGSLLKKVLEAIKDLVNDANFDCSATGFSLQAMDSSHVALVALLLRSEGFEHYRCDRNISMGMNLGNMSKMLKCAGNDDIITIKADDGSDTVTFMFESPTQDKISDFEMKLMDIDSEHLGIPEAEYHAIVRMPSAEFARICKDLASIGDTVVISVTKEGVKFSTRGDIGTANIVLRQNTTVDKPEEATIIEMNEPVSLTFALRYMNSFTKATPLSNTVTISLSSELPVVVEYKIAEMGYVRFYLAPKIEEDEDETKPQV

SEQ ID NO: 10714 - protein, 264 aa, Cucurbita pepo
MLELRLVQGSLLKKVLESIKDLVNDANFDCSATGFSLQAMDSSHVALVALLLRAEGFEHYRCDRNMSMGMNLNNMSKMLKCAGNDDIITIKADDGSDTVTFMFESPTQDKISDFEMKLMDIDSEHLGIPDAEYHAIVRMPSAEFARICKDLSSIGDTVVISVTKEGVKFSTRGDIGSANVVCRQNTTVDKPEEATVIEMNEPVSLTFALRYMNSFTKATPLSNTVTISLSSDLPVVVEYKIAEMGYVRFYLAPKIEEDEDETKP

SEQ ID NO: 10715 - protein, 266 aa, Medicago truncatula
MLELRLVQGSLLKKVLESIKELVNDANFDCSSTGFSLQAMDSSHVALVALLLRSEGFEHYRCDRNLSMGMNLNNMAKMLKCAGNDDIITIKADDGSDTVTFMFESPTQDKISDFEMKLMDIDSEHLGIPEAEYDAIVRMPSAEFARICKDLSSIGDTVVISVTKEGVKFSTKGDIGAANIVCRQNTTVDKPDDATVIEMKEPVSLQFALRYTNSFTKATPLSSTVTISLSNELPVVVEYKIAEMGYVRFYLAPKIEEDDEETKPEV

SEQ ID NO: 10716 - protein, 264 aa, Sequoia sempervirens
MLELRLVQGSLLKKVLEAIKDLVSDANFDCSATGFSLQAMDSSHVALVALLLRSEGFEHFRCDRNMSVGMNLNNMAKMLKCAGNDDIITLKADDGGDTVTFMFESPNQDKISDFEMKLMDIDSEHLGIPESEYHAIVRMPSQEFARICKDLSSIGDTVVISVTKEGVKFTTRGDIGSANIVCRQNTSVDKPEEATIIEMQEPVSLTFALRYMNSFTKATPLSNTVTISLSSELPVVVEYKIADMGYIRFYLAPKIEEEDEMTGT

SEQ ID NO: 10717 - protein, 266 aa, Fragaria vesca
MLELRLVQGSLLKKVLESIKDLVTDANFDCSATGFSLQAMDSSHVALVALLLRSEGFEHYRCDRSISMGMNLGNMSKMLKCAGNDDIITLKADDGSDTVTFMFESPTQDKISDFEMKLMDIDSEHLGIPEAEYHAIVRMPSAEFARICKDLSGIGDTVVISVTKEGVKFSTRGDIGVANIVCRQNTTVDKPEEATIIEMNEPVSLTFALRYMNSFTKASPLSNTVTISLSSELPVVVEYKIAEMGYIRFYLAPKIEEDEDETKPQV

SEQ ID NO: 10718 - protein, 173 aa, Arachis hypogaea
MLELRLVQGSLLKKVLDAIRELVNDANFDCSATGFSLQAMDSSHVALVALLLRSEGFEHYRCDRNISMGMNLNNMAKMLRCAGNDDIITVKGDDGSDTVTFMFESPTQDKISDFEMKLMDIDSEHLGIPEAEYHAIVRMPSAEFARICKDLSSIGDTVVISVTKEGVKFSTKG

SEQ ID NO: 10719 - protein, 263 aa, Raphanus sativus
MLELRLVQGSLLKKVLESVKDLVNDANFDCSSTGFSLQAMDSSHVALVSLLLRSEGFEHYRCDRNLSMGMNLGNMSKMLKCAGNDDIITIKADDGSDTVTFMFESPTQDKIADFEMKLMDIDSEHLGIPDAEYHSIVRMPSGEFSRICKDLSSIGDTVVISVTKEGVKFSTAGDIGTANIVLRQNTTVDKPEDAIVIEMNEPVSLSFALRYMNSFTKATPLSETVTISLSSELPVVVEYKVAEMGYIRYYLAPKIEEEEDTNA

SEQ ID NO: 10720 - protein, 261 aa, Picea glauca
MLELRLVQGSLLKKVLESIKDLVTDANFDCSATGFSLQAMDSSHVALVSLLLRSEGFEHYRCDRNMSMGMNLNNMAKMLKCAGNDDIITIKADDGGDTVTFMFESPNQDKISDFEMKLMDIDSEHLGIPESEYHAIVRMPSQEFARICKDLSSIGDTVVISVSKEGVKFSTRGDIGSANIVCRQNPSVDKPDEATIIEMQEPVSLTFALRYMNSFTKATPLSNTVTISMSSELPVVVEYKIADMGYIRFYLAPKIEEEGES

SEQ ID NO: 10721 - protein, 263 aa, Eutrema halophilum
MLELRLVQGSLLKKVLESIKDLVNDANFDCSSTGFSLQAMDSSHVALVSLLLRSEGFEHYRCDRNLSMGMNLGNMSKMLRCAGNDDIITIKADDGGDTVTFMFESPTQDKIADFEMKLMDIDSEHLGIPDAEYHSIVRMPSNEFSRICKDLSSIGDTVVISVTKEGVKFSTAGDIGTANIVLRQNTSVDKPEDAIVIEMNEPVSLSFALRYMNSFTKATPLSDTVTISLSSELPVVVEYKVAEMGYIRYYLAPKIEEEEDTKP

SEQ ID NO: 10722 - protein, 266 aa, Gossypium raimondii
MLELRLVQGSLLKKVLEAIKDLVNDANFDCSATGFSLQAMDSSHVALVALLLRSEGFEHYRCDRNLSMGMNLNNMSKMMKCAGNDDIITIKADDGSDTVTFMFESPTQDKISDFEMKLMDIDSEHLGIPEAEYQSIVRMPSAEFARICKDLASIGDTVVISVTKEGVKFSTRGDIGTANIVLRQNTTVDKPEEATIIEMNEPVSLTFALRYMNSFTKATPLSSTVTISLSSELPVVVEYKIAEMGHIRFYLAPKIEEDEDETNPQG

SEQ ID NO: 10723 - protein, 266 aa, Glycine max
MLELRLVQGSLLKKVLESVKELVNDANFDCSSTGFSLQAMDSSHVALVALLLRSEGFEHYRCDRNISMGMNLNNMAKMLKCAGNDDIITIKADDGSDTVTFMFESPTQDKISDFEMKLMDIDSEHLGIPEAEYHAIVKMPSSEFARICKDLSSIGDTVVISVTKEGVKFSTKGDIGTANIVCRQNTSVDKPEEATVIEMNEPVSLTFALRYMNSFTKATPLSNTVTISLSNELPVVVEYKIAEMGYVRFYLAPKIEEDEEDTKPQV

SEQ ID NO: 10724 - protein, 266 aa, Ricinus communis
MLELRLVQGSLLKKVLDSIKDLVNDANFDCSSTGFSLQAMDSSHVALVALLLRSEGFEHYRCDRNISMGMNLNNMSKMLRCSGNDDIITIKADDGSDTVTFMFESPTQDKISDFEMKLMDIDSEHLGIPEAEYHAIVRMPSAEFAKICKDLGSIGDTVVISVTKEGVKFSTRGDIGTANIVVRQNTTVDKPEEATIIEMNEPVSLTFALRYMNSFTKATPLSSTVTISLSSELPVVVEYKIAEMGYIRFYLAPKIEEDEDETKPEV

SEQ ID NO: 10725 - protein, 266 aa, Gossypium raimondii
MLELRLVQGSLLKKVLEAIKDLVNDANFDCSATGFSLQAMDSSHVALVALLLRSEGFEHYRCDRNLSMGMNLNNMSKMMKCAGNDDIITIKADDGSDTVTFMFESPTQDKISDFEMKLMDIDSEHLGIPEAEYQSIVRMPSAEFARICKDLASIGDTVVISVTKEGVKFSTRGDIGTANIVLRQNTTVDKPEEATIIEMNEPVSLTFALRYMNSFTKATPLSSTVTISLSSELPVVVEYKIAEMGHIRFYLAPKIEEDEDETNPKG

SEQ ID NO: 10726 - protein, 266 aa, Cucumis melo
MLELRLVQGSLLKKVLESIKDLVNDANFDCSATGFSLQAMDSSHVALVALLLRAEGFEHYRCDRNISMGMNLNNMSKMLKCAGNDDIITIKADDGSDTVTFMFESPTQDKISDFEMKLMDIDSEHLGIPDAEYHAIVRMPSVEFARICKDLSSIGDTVVISVTKEGVKFSTRGDIGSANIVCRQNTTVDKPEEATVIEMNEPVSLTFALRYMNSFTKATPLSNTVTISLSSDLPVVVEYKIAEMGYVRFYLAPKIEEDEDETKPQA

SEQ ID NO: 10727 - protein, 266 aa, Glycine max
MLELRLVQGSLLKKVLESIKELVNDANFDCSSTGFSLQAMDSSHVALVALLLRSEGFEHYRCDRNTSMGMNLNNMAKMLKCAGNDDIITIKADDGSDTVTFMFESPTQDKISDFEMKLMDIDSEHLGIPEAEYHAIVKMPSSEFARICKDLSSIGDTVVISITKEGVKFSTKGDIGTANIVCRQNTSVDKPEEATVIEMNEPVSLTFALRYMNSFTKATPLSNTVTISLSNELPVVVEYKIAEMGYVRFYLAPKIEEDEEDTKPQV

SEQ ID NO: 10728 - protein, 266 aa, Fragaria vesca
MLELRLVQGSLLKKVLESIKDLVTDANFDCSATGFSLQAMDSSHVALVALLLRSEGFEHYRCDRSISMGMNLGNMSKMLKCAGNDDIVTLKADDGSDTVTFMFESPTQDKISDFEMKLMDIDSEHLGIPEAEYHAIVRMPSAEFARICKDLSGIGDTVVISVTKEGVKFSTRGDIGTANIVCRQNTTVDKPEEATIIEMTEPVSLTFALRYMNSFTKASPLSNTVTISLSSELPVVVEYKIAEMGYIRFYLAPKIEEDEEETKPQV

SEQ ID NO: 10729 - protein, 266 aa, Tripterygium wilfordii
MLELRLVQGSLLKKVLESIKDLVNDANFDCSATGFSLQAMDSSHVALVALLLRSEGFEHYRCDRNLSMGINLGNMSKMLRCAGNDDIITIKADDGSDTVTFMFESPTQDKISDFEMKLMDIDSDHLGIPEAEYHAIVRMPSAEFARICKDLSSIGDTVVISVTKEGVKFSTRGDIGAANIVLRQNTTVDKPEEATIIEMNEPVSLTFALRYMNSFTKATPLSSTVTISLSSELPVVVEYKIGEMGYIRFYLAPKIEEDEDETKPGI

SEQ ID NO: 10730 - protein, 264 aa, Panax ginseng
MLELRLVQGSLLKKVMDSIKDLVNDANFDCSATGFSLQAMDSSHVALVSLLLRSEGFEHYRCDRNISMGMNMGNMTKMLKCAGNDDIITIKADDGSDTVTFMFESPTQDKIADFEMKLMDIDSEHLGIPEAEYHAIVRMPSAEFARICKDLSSIGDTVVISVTKEGVKFSTRGDIGTANIVCRQNTTVDKPEEATIIEMNEPVSLTFALRYMNSFTKASPLSSTVTISLSSELPVVVEYKIAEMGYIRFYLAPKIEEDDDENKP

SEQ ID NO: 10731 - protein, 264 aa, Mimulus guttatus
MLELRLVQGSLLKKVLEAVKDLVNDANFDCSATGFSLQAMDSSHVALVALLLRSEGFEHYRCDRNISMGMNLGNMAKMLKCAGNDDIITLKADDGSDVVTFMFESPTQDKIADFEMKLMDIDSEHLGIPEAEYHAIVRMPSSEFARICKDLSSIGDTVVISVTKEGVKFSTRGDIGTANIVCRQNTTVDKPEEATVIEMNEPVSLTFALRYFNSFTKATPLSNTVTLSLSSELPVVVEYKIAEMGYIRFYLAPKIEDDDEDAKP

SEQ ID NO: 10732 - protein, 264 aa, Raphanus sativus
  misc_feature (62)..(62): Xaa can be any naturally occurring amino acid
  misc_feature (64)..(64): Xaa can be any naturally occurring amino acid
  misc_feature (128)..(128): Xaa can be any naturally occurring amino acid
MLELRLVQGSLLKKVLESIKDLVNDANFDCSSTGFSLQAMDSSHVALVSLLLRSEGFEHYRXDXNLSMGMNLGNMSKMLKCAGNDDIITIKADDGGDTVTFMFESPKQDKIADFEMKLMDIDSEHLGXPDAEYQSIVRMPSNEFSRICKDLSSIGDTVVISVTKEGVKFSTAGDIGTANIVLRQNTTVDKPEDAIVIEMKEPVSLSFALRYMNSFTKATPLSDTVTISLSSELPVVVEYKVAEMGYIRYYLAPKIEEDEEDTKA

SEQ ID NO: 10733 - protein, 181 aa, Brassica napus
MLELRLVQGSLLKKVLESIKDLVNDANFDCSTTGFSLQAMDSSHVALVSLLLRSEGFEHYRCDRNLSMGMNLGNMSKMLKCAGNDDIITIKADDGGDTVTFMFESPKQDKIADFEMKLMDIDSEHLGIPDAEYHSIVRMPSNEFSRICKDLSTIGDTVVISVTKEGVKFSTAGDIGTANMC

SEQ ID NO: 10734 - protein, 255 aa, Centaurea maculosa
MLELRLVQGSLLKKVMESIKDLVNDANFDCSATGFSLQAMDSSHVALVSLLLRSEGFEHYRCDRNLSMGMNLGNMTKMLKCAGNDDIITIKADDGSDTVTFMFESPTQDKIADFEMKLMDIDSEHLGIPEAEYHAIVRMPSSEFARICKDLSSIGDTVVISVTKEGVKFSTRGDIGTANVVCRQNTTVDKPEEATIIEMNEPVSLTFALRYMNSFTKATPLSNTVTISLSSELPVVVEYKIAEMGYIRFYLAPKI

SEQ ID NO: 10735 - protein, 261 aa, Chenopodium quinoa
MLELRLVQGSLLKKVIESIKDLVTDANFDCSATGFSLQAMDSSHVALVALLLRAEGFEHYRCDRNISMGMNLTNMSKMLKCSGNDDIITIKADDGSDTVTFMFESPNQDKIADFEMKLMDIDSEHLGIPEAEYHAIVRMPSAEFARICKDLSSIGDTVVISVTKEGVKFSTRGDIGAANIVCRQNTTVDKPEEATVIEMNEPVNLTFALRYMNSFTKATPLSNTVTLSLSSELPVVVEYKIAEMGYIRFYLAPKIEEDENE

SEQ ID NO: 10736 - protein, 263 aa, Unknown
  Sequence found in Organisms: Arabidopsis thaliana, Arabidopsis lyrata
MLELRLVQGSLLKKVLESIKDLVNDANFDCSSTGFSLQAMDSSHVALVSLLLRSEGFEHYRCDRNLSMGMNLGNMSKMLKCAGNDDIITIKADDGGDTVTFMFESPTQDKIADFEMKLMDIDSEHLGIPDAEYHSIVRMPSNEFSRICKDLSSIGDTVVISVTKEGVKFSTAGDIGTANIVLRQNTTVDKPEDAIVIEMKEPVSLSFALRYMNSFTKATPLSDTVTISLSSELPVVVEYKVAEMGYIRYYLAPKIEEEEDTNP

SEQ ID NO: 10737 - protein, 262 aa, Beta vulgaris
MLELRLVQGSLLKKVLDSIKDLVTDANFDCSATGFSLQAMDSSHVALVALLLRAEGFEHYRCDRNISMGMNLTNMAKMLKCAGNDDIITIKADDGSDTVTFMFESPNQDKIADFEMKLMDIDSEHLGIPEAEYHAIVRMPSAEFARICKDLSSIGDTVVISVSKEGVKFFTRGDIGAANIVCRQNTTVDKPEEATVIEMNEPVTLTFALRYMNSFTKATPLSNTVTLSLSSELPVVVEYKIAEMGYIRFYLAPKIEEDENES

SEQ ID NO: 10738 - protein, 262 aa, Cephalotaxus harringtonia
MLELRLVQGSLLKKVLEAIKDLVTDANFDCSATGFSLQAMDSSHVALVALLLRSEGFEHFRCDRNMSMGINLNNMSKMLKCAGNDDIITIKADDGGDTVTFMFESPNQDKISDFEMKLMDIDTEHLGIPESEYQAIVKMPSQEFARICKDLSSIGDTVVISVTKEGVKFSTKGDIGSANIVCRQNTSVDKPEEATVIEMQEPVSLTFALRYMNSFTKATALSNSVTISMSSDLPVVVEYKIADMGYIRFYLAPKIEEEEGES

SEQ ID NO: 10739 - protein, 262 aa, Distylium racemosum
MLELRLVQGSLLKKVLEAIKDLVTDANFDCSATGFSLQAMDSSHVALVALLLRSEGFEHFRCDRNISMGMNLNNMAKMLKCAGNDDIITLKADDEGDTVTFMFESPNQDKISDFEMKLMDIDTEHLGIPESEYQAIVRMPSQEFARICKDLSTIGDTVVISVTKEGVKFSTRGDIGSANIVCRQNTSVDKPEEATIIEMQESVSLTFALRYMNSFTKATPLSNTVTISMSSDLPVVVEYKIADMGYVRFYLAPKIEEEEGES

SEQ ID NO: 10740 - protein, 261 aa, Pseudotsuga menziesii
MLELRLVQGSLLKKVLESIKDLVTDANFDCSATGFSLQAMDSSHVALVSLLLRSEGFEHYRCDRNMSMGMNLNNMAKMLKCAGNDDIITIKADDGGDTVTFMFESPNQDKISDFEMKLMDIDSEHLGIPESEYHAIVRMPSQEFARICKDLSSIGDTVVISVSKEGVKFSTRGDIGSANVVCRQNPSVDKPDEATIIEMQEPVSLTFALRYMNSFTKATPLSNTVTISMSSELPVVVEYKIAEMGYVRFYLAPKIEEEGES

SEQ ID NO: 10741 - protein, 263 aa, Pteridium aquilinum
MLELRLLQGSLLKKVLEAIKDLVTDANFDCSATGFSLQAMDSSHVALVALLLRSEGFEHYRCDRNLSMGMNLNNMSKMLKCAGNDDIITIKADDGGDTVTFMFESPNQDKISDFEMKLMDIDSEHLGIPETEYEAIIRMPSQEFARICRDLSSIGDTVVISASKEGVKFSTKGDIGSANIVCRQNTSVDKPEDATVIQIQQPVSLTFALRYMNSFTKATPLSNTVTISMSSELPVVVEYKIAEMGYIRFYLAPKIEEDEEVNS

SEQ ID NO: 10742 - protein, 263 aa, Eutrema halophilum
MLELRLVQGSLLKKVLESVKDLVNDANFDCSSTGFSLQAMDSSHVALVSLLLRSEGFEHYRCDRNLSMGMNLGNMSKMLKCAGNDDIITIKADDGSDTVTFMFESPTQDKIADFEMKLMDIDSEHLGIPDAEYHSIVRMPSGEFSRICKDLSTIGDTVVISVTKEGVKFSTAGDIGTANIVLRQNTTVDKPEDAIVIEMNEPVSLSFALRYMNSFTKATPLSETVTISLSSELPVVVEYKVAEMGYIRYYLAPKIEEEEDANA

SEQ ID NO: 10743 - protein, 263 aa, Eutrema parvulum
MLELRLVQGSLLKKVLESIKDLVNDANFDCSSTGFSLQAMDSSHVALVSLLLRSEGFEHYRCDRNLSMGMNLGNMSKMLKCAGNDDIITIKADDGGDTVTFMFESPTQDKIADFEMKLMDIDSEHLGIPDAEYHSIVRMPSNEFSRICKDLSSIGDTVVISVTKEGVKFSTAGDIGTANIVLRQNTTVDKPEDAIMIEMNEPVSLSFALRYMNSFTKATPLSDTMTISLSSELPVVVEYKVAEMGYIRYYLAPKIEEEEDTKA

SEQ ID NO: 10744 - protein, 266 aa, Lotus japonicus
MLELRLVQGSLLKKVLESIKELVNDANFDCSTTGFSLQAMDSSHVALVALLLRSEGFEHYRCDRNISMGMNLSNMSKMLKCAGNDDIITIKADDGSDTVTFMFESPTQDKISDFEMKLMDIDSEHLGIPEAEYHAIVRMPSAEFARICKDLSSIGDTVVISVTKEGVKFSTKGDIGTANIVCRQNTSVDKPEEATVIEMNEPVSLTFALRYMNSFTKATPLSSTVTISLSSELPVVVEYKIAEMGYVRFYLAPKIEEEEEETKPQV

SEQ ID NO: 10745 - protein, 266 aa, Prunus mume
MLELRLVQGSLLKKVLESIKDLVNDANFDCSATGFSLQAMDSSHVALVALLLRSEGFEHYRCDRNISMGMNLTNMSKMLKCAGNDDIITIKADDGSDTVTFMFESPTQDKISDFEMKLMDIDSEHLGIPEAEYHAIVKMPSSEFARICKDLSGIGDTVVISVTKEGVKFSTRGDIGTANIVCRQNTTVDKPEEATVIDMNEPVSLTFALRYMNSFTKATTLSNTVTISLSSELPVVVEYKIAEMGYIRFYLAPKIEEDEDETKPEV

SEQ ID NO: 10746 - protein, 263 aa, Brassica rapa
MLELRLVQGSLLKKVLESVKDLVNDANFDCSSTGFSLQAMDSSHVALVSLLLRSEGFEHYRCDRNLSMGMNLGNMSKMLKCAGNDDIITIKADDGGDTVTFMFESPTQDKIADFEMKLMDIDSEHLGIPDAEYHSIVRMPSAEFSRICKDLSSIGDTVVISVTKEGVKFSTAGDIGTANIVLRQNTTVDKPEDAIVIEMNEPVSLSFALRYMNSFTKATPLSDTVTISLSSELPVVVEYKVAEMGYIRYYLAPKIEEEEDTNA

SEQ ID NO: 10747 - protein, 264 aa, Taraxacum officinale
MLELRLVQGSLLKKVMESIKDLVNDANFDCSATGFSLQAMDSSHVALVSLLLRSEGFEHYRCDRNISMGMNLGNMSKMLKCAGNDDIITLKADDGSDTVTFMFESPTQDKIADFEMKLMDIDSEHLGIPEAEYHAIVRMPSSEFARICKDLSSIGDTVVISVTKEGVKFSTRGDIGTANVVCRQNTTVDKPEEATVIEMNEPVSLTFALRYMNSFTKATPLSSTVTLSLSSELPVVVEYKVAEMGYLRFYLAPKIEEDDEEPHS

SEQ ID NO: 10748 - protein, 262 aa, Pinus pinaster
MLELRLVQGSLLKKVLEAIKDLVTDANFDCSATGFSLQAMDSSHVALVALLLRSEGFEHYRCDRNLSMGMNINNMSKMLKCAGNDDIITIKADDGGDTVTFMFESPNQDKISDFEMKLMDIDTEHLGIPESEYQAIVRMPSPEFARICKDLSTIGDTVVISVTKEGVKFSTRGDIGSANIVCRQNTSVDKPEEATLIEMQEPVSLTFALRYMNSFTKASPLSNIVTISMSSDLPVVVEYKIADMGYVRYYLAPKIEEDGGES

SEQ ID NO: 10749 - protein, 264 aa, Raphanus sativus
  misc_feature (20)..(20): Xaa can be any naturally occurring amino acid
  misc_feature (51)..(51): Xaa can be any naturally occurring amino acid
  misc_feature (140)..(140): Xaa can be any naturally occurring amino acid
  misc_feature (152)..(152): Xaa can be any naturally occurring amino acid
MLELRLVQGSLLKKVLESIXDLVNDANFDCSSTGFSLQAMDSSHVALVSLXLRSEGFEHYRCDRNLSMGMNLGNMSKMLKCAGNDDIITIKADDGGDTVTFMFESPKQDKIADFEMKLMDIDSEHLGIPDAEYESIVRMXSNEFSRICKDLXSIGDTVVISVTKEGVKFSTAGDIGTANIVLRQNTTVDKPEDAIVIEMKEPVSLSFALRYMNSFTKATPLSDTVTISLSSELPVVVEYKVAEMGYIRYYLAPKIEEDEEDTKA

SEQ ID NO: 10750 - protein, 262 aa, Taxus baccata
MLELRLVQGSLLKKVLESMKDLVTDANFDCSATGFSLQAMDSSHVALIALLLRSEGFEHYRCDRNMSMGMNLNNMAKMLKCAGNDDIITIKADDGGDTVTFMFESPNQDKISDFEMKLMDIDTEHLGIPESEYQAIVKMPSQEFARICKDLSTIGDTVVISVTKEGVKFSTKGDIGSANIVCRQNNSVDKPEEATVIEMQEPVSLTFALRYMNSFTKATSLSNSVTISMSSDLPVVVEYKIADMGYIRFYLAPKIEEEEGES

SEQ ID NO: 10751 - protein, 263 aa, Eutrema parvulum
MLELRLVQGSLLKKVLESVKDLVNDANFDCSSTGFSLQAMDSSHVALVSLLLRSEGFEHYRCDRNLSMGMNLGNMSKMLKCAGNDDIITIKADDGSDTVTFMFESPTQDKIADFEMKLMDIDSEHLGIPDAEYHSIVKMPSGEFSRICKDLSTIGDTVVISVTKEGVKFSTAGDIGTANIVLRQNTTVDKPEDAIVIEMNEPVSLSFALRYMNSFTKATPLSETVTISLSSELPVVVEYKVAEMGYIRYYLAPKIEEEEDTNP

SEQ ID NO: 10752 - protein, 266 aa, Malus domestica
MLELRLVQGSLLKKVLESIKDLVNDANFDCSSSGFSLQAMDSSHVALVALLLRSEGFEHYRCDRNMSMGMNLGNMSKMLRCAGNDDIITIKADDGSDTVTFMFESPTQDKISDFEMKLMDIDSEHLGIPEAEYQSIVTMPSSEFARICKDLSGIGDTVVISVTKEGVKFSTRGDIGTANIVCRQNTTVDKPEEATVINMSEPVSLTFALRYMNSFTKATTLSNTVTISLSSELPVVVEYKIAEMGYIRFYLAPKIEDDEDETKPEV

SEQ ID NO: 10753 - protein, 266 aa, Cucumis sativus
MLELRLVQGSLLKKVLESIKDLVNDANFDCSATGFSLQAMDSSHVALVALLLRAEGFEHYRCDRNISMGMNLNNMSKMLKCAGNDDIITIKADDGSDTVTFMFESPTQDKISDFEMKLMDIDSEHLGIPDAEYHAIVRMPSVEFARICKDLSSIGDTVVISVTKEGVKFSTRGDIGSANIVCRQNTTVDKPEEATVIEMNEPVSLTFALRYMNSFTKATPLSNTVTISLSSDLPVVVEYKIAEMGYVRFYLAPKIEEDEDDTKPQA

SEQ ID NO: 10754 - protein, 266 aa, Unknown
  Sequence found in Organisms: Pisum sativum, Nicotiana tabacum
MLELRLVQGSLLKKVLESIKELVNDANFDCSSTGFSLQAMDSSHVALVALLLRSEGFEHYRCDRNLSMGMNLNNMAKMLKCAGNDDIITIKADDGSDTVTFMFESPTQDKISDFEMKLMDIDSEHLGIPEAEYHAIVRMPSAEFARICKDLSSIGDTVVIAVSKEGVKFSTKGDIGSANIVCRQNTTVDKPEEATVIEMNEPVALQFALRYMNSFTKATPLSSSVTISLSNELPVVVEYKIAEMGYVRFYLAPKIEEDEEETKPQA

SEQ ID NO: 10755 - protein, 266 aa, Cajanus cajan
MLELRLVQGSLLKKVLDAIKELVNDANFDCSSTGFSLQAMDSSHVALVALLLRSEGFEHYRCDRNISMGMNLGNMAKMLKCAGNDDIITIKADDGGDTVTFMFESPTQDKISDFEMKLMSIDSEHLGIPEAEYHAIVKMPSSEFARICRDLSSIGDTVVISVTKEGVKFSTKGDIGTANIVCRQNTSVDKPEEATLIEMNEPVSLTFALRYMNSFTKATPLSNTVTISLSNELPVVVEYKIAEMGYVRFYLAPKIEEDDEETKPEV

SEQ ID NO: 10756 - protein, 266 aa, Prunus persica
MLELRLVQGSLLKKVLESIKDLVNDANFDCSATGFSLQAMDSSHVALVALLLRSEGFEHYRCDRNISMGMNLTNMSKMLKCAGNDDIITIKADDGSDTVTFMFESPTQDKISDFEMKLMDIDSEHLGIPEAEYHAIVKMPSAEFARICKDLSGIGDTVVISVTKEGVKFSTRGDIGTANIVCRQNTTVDKPEEATVIDMNEPVSLTFALRYMNSFTKATTLSNTVTISLSSELPVVVEYKIAEMGYIRFYLAPKIEEDEDETKPEV

SEQ ID NO: 10757 - protein, 266 aa, Triphysaria pusilla
MLELRLVQGSLLKKVLDSVKDLVNDANFDCSATGFSLQAMDSSHVALVSLLLRSEGFEHYRCDRNLSMGMNLGNMAKMLKCAGNDDIITIKADDGGDTVTFMFESPTQDKIADFEMKLMDIDSEHLGIPEAEYHAIVRMPSSEFARICKDLSSIGDTVVISVTKEGVKFSTRGDIGTANVVCRQNTTVDKPEDATVIEMNEPVSLTFALRYLNSFTKASPLSNTVTISLSSELPVVVEYKIAEMGFVRFYLAPKIEDDDDETKPMS

SEQ ID NO: 10758 - protein, 266 aa, Citrullus lanatus
MLEFRLVQGSLLKKVLESIKDLVNDANFDCSATGFSLQAMDSSHVALVALLLRAEGFEHYRCDRSISMGMNLNNMSKMLKCAGNDDIITIKADDGSDTVTFMFESPTQDKISDFEMKLMDIDSEHLGIPDAEYHAIVRMPSVEFARICKDLSSIGDTVVISVTKEGVKFSTRGDIGSANIVCRQNTTVDKPEEATVIEMNEPVSLTFALRYMNSFTKATPLSNTVTISLSSDLPVVVEYKIAEMGYVRFYLAPKIEEDEDETKPQA

SEQ ID NO: 10759 - protein, 263 aa, Brassica napus
MLELRLVQGSLLKKVLESVKDLVNDANFDCSSTGFSLQAMDSSHVALVSLLLRSEGFEHYRCDRNLSMGMNLGNMSKMLKCAGNDDIITIKADDGGDTVTFMFESPTQDKIADFEMKLMDIDSEHLGIPDAEYHSIVRMPSGEFSRICKDLSSIGDTVVISVTKEGVKFSTAGDIGTANIVLRQNTTVDKPEDAIVIEMNEPVALSFALRYMNSFTKATPLSDTVTISLSSELPVVVEYKVAEMGYIRYYLAPKIEEEEDTNA

SEQ ID NO: 10760 - protein, 263 aa, Pteridium aquilinum
MLELRLLQGSLLKKVLEAIKDLVTDANFDCSATGFSLQAMDSSHVALVALLLRAEGFEHYRCDRNLSMGMNLNNMSKMLKCAGNDDIITIKADDGGDTVTFMFESPNQDKISDFEMKLMDIDSEHLGIPETEYEAIIRMPSQEFARICRDLSSIGDTVVISASKEGVKFSTKGDIGSANIVCRQNTSVDKPEDATVIQIQQPVSLTFALRYMNSFTKATPLSNTVTISMSSELPVVVEYKIAEMGYIRFYLAPKIEEDEEVNP

SEQ ID NO: 10761 - protein, 254 aa, Centaurea maculosa
MLELRLVQGSLLKKVMESIKDLVNDANFDCSATGFSLQAMDSSHVALVSLLLRSEGFEHYRCDRNLSMGMNLGNMTKMLKCAGNDDIITIKADDGSDTVTFMFESPTQDKIADFEMKLMDIDSEHLGIPEAEYHAIVRMPSSEFARICKDLSSIGDTVVISVTKEGVKFSTRGDIGTANVVCRQNTTVDKPEEATIIEMNEPVSLTFALRYMNSFTKATPLSNTVTISLSSELPVVVEYKIAEMGYIRFYLAPR

SEQ ID NO: 10762 - protein, 345 aa, Lactuca sativa
MLELRLVQGSLLKKVMESIKDLVNDANFDCSATGFSLQAMDSSHVALVSLLLRSEGFEHYRCDRNLSMGMNLGNMAKMLKCAGNDDIVTVKADDGGDCVTFMFESPNQDKIADFEMKLMDIDSEHLGIPEAEYEAIVRMPSAEFARICKDLSTIGDTVVISVTKEGVKFSTRGDIGTANIVLRQNTSVDKPEEATIIEMETPVSLTFALRYMNSFTKATPLASQVTVSLSSELPVVVEYKIAEMGYLRFYLAPKIEEDEEMGGGHQAEPKKQPEKKPKTEPKSNGEGAPKRRVLKVDLDEEEEETKPQVVKKSGSENGDYVEVLDVKAGTGVIEPKTEVEVMDVE

SEQ ID NO: 10763 - protein, 158 aa, Vaccinium corymbosum
MFELRLVQGSLLKKVLESIKDLVNDANFDCSATGFSLQAMDSSHVALVALLLRSEGFEHYRCDRNISMGMNLGNMAKMLKCAGNDDIVTIKADDGSDCVTFMFESPTQDKISDFEMKLMDIDSEHLGIPESEYDAMLGCRHLSLQGFAKTLAPLVIRL

SEQ ID NO: 10764 - protein, 267 aa, Aquilegia formosa
MLELRLVQGSLLKKVLEAIKDLVNDANFDCSATGFSLQAMDSSHVALVALLLRNEGFEHYRCDRNISMGMNLGNMNKMLKCAGNDDIITLKADDGSDTVTFMFESPNQDKIADFEMKLMDIDSEHLGIPEAEYHAIVRMPSAEFARICKDLSSIGDTVVISVTKEGVKFSTKGDIGTANIVCRQNTTVDKPEEATVIEMKEPVSLTFALRYMNSFAKATPLSHTVTISLSSELPVVVEYKIEDMGYVRFYLAPKIEEDEEEDTKPKV

SEQ ID NO: 10765 - protein, 266 aa, Unknown
  Sequence found in Organisms: Euphorbia peplus, Euphorbia esula
MLELRLVQGSVLKKVLESIKDLVTDANFDCSSTGFSLQAMDSSHVALVALLLRSEGFEHYRCDRNISMGMNLNNVSKMLKCSGNDDIITIKADDGSDTVTFMFESPTQDKISDFEMKLMDIDSEHLGIPEAEYHAIVRMPSAEFSKICKDLASIGDTVVISVTKEGVKFSTRGDIGAANIVVRQNTTVDKPEQATIVEMNEPVSLTFALRYMNSFTKATPLSETVTISLSSELPVVVEYKIAEMGYVRFYLAPKIEEEEDETKPQV

SEQ ID NO: 10766 - protein, 266 aa, Papaver somniferum
MLELRLVQGSLLKKVMESLKDLVNDANFDCSATGFSLQAMDSSHVALVALLLRSEGFEHYRCDRNISMGMKLENLTKILKCAGNDDIITIKGDDGGDTVTFMFESPSQDKIADFEMKLMDIDSEHLGIPDAEYQAIVRMPSAEFARICKDLSTIGDTVVISVTKEGVKFSTKGDIGTANIVCRQNTTVDKPEEATVIEMQEPVSLTFALRYMNSFTKATPLSNTVTISLSSELPVVVEYKIAEMGYIRFYLAPKIEEDEEDTKPQV

SEQ ID NO: 10767 - protein, 263 aa, Brassica oleracea
  misc_feature (169)..(169): Xaa can be any naturally occurring amino acid
MLELRLVQGSLLKKVLESVKDLVNDANFDCSSTGFSLQAMDSSHVALVSLLLRSEGFEHYRCDRNLSMGMNLGNMSKMLKCAGNDDIITIKADDGGDTVTFMFESPTQDKIADFEMKLMDIDSEHLGIPDAEYHSIVRMPSGEFSRICKDLSSIGDTVVISVTKEGVKXSTAGDIGTANIVLRQNTTVDKPEDAIVIEMNEPVALSFALRYMNSFTKATPLSDTVTISLSSELPVVVEYKVAEMGYIRYYLAPKIEEEEDTNA

SEQ ID NO: 10768 - protein, 264 aa, Raphanus sativus
MLELRLVQGSLLKKVLESVKDLVNDANFDCSSTGFSLQAMDSSHVALVSLLLRSEGFEHYRCDRNLSMGMNLGNMSKMLKCAGNDDIITIKADDGGDTVTFMFESPTQDKIADFEMKLMDIDSEHLGIPDAEYHSIVRMPSGEFSRICKDLSTIGDTVVISVTKEGVKFSTAGDIGTANIVLRQNTTVDKPEDAIVIEMNEPVSLSFALRYMNSFTKATPLSDTVTISLSSELPVVVEYKVAEMGYIRYYLAPKIEEEEDDNKA

SEQ ID NO: 10769 - protein, 265 aa, Phaseolus vulgaris
MLELRLVQGSLLKKVLESIKELVNDANFDCSSTGFSLQAMDSSHVALVGLLLRSEGFEHYRCDRNISMGMNLNNMAKMLKCAGNDDIITIKADDGGDTVTFMFESPTQDKISDFEMKLMDIDSEHLGIPEAEYHAIVKMPSSEFARICRDLSSIGDTVVISVTKEGVKFSTKGDIGSANIVCRQNTSVDKPEEATMIDMNEPVSLTFALRYMNSFTKATPLSNTVSISLSNELPVVVEYKIAEMGYVRFYLAPKIEEEEEEKPQV

SEQ ID NO: 10770 - protein, 66 aa, Taraxacum officinale
MLELRLVQGSLLKKVMESIKDLVNDDNFECSAAGFSLQAMDSSHVALVSLLLRSEGFEHYRSDRNL

SEQ ID NO: 10771 - protein, 268 aa, Populus trichocarpa
MLELRLVQGSLLKKVLEAIKDLVNDANFDCSSSGFSLQAMDSSHVALVALLLRSEGFEHYRCDRNTSMGMNLGNMSKMLKCAGNDDIITIKGDDGSDTVTFMFESPTQDKIADFEMKLMDIDSEHLGIPEAEYHAIVTMPSAEFSRICKDLSSIGDTVVISVTKEGVKFSTRGDIGTANIVLRQNTTVDKPEDATVIEMNEPVSLTFALRYMNSFTKATPLSNTVKISLSSELPVVVEYKIAEMGYVRYYLAPKIEEDEDENETKPQV

SEQ ID NO: 10772 - protein, 267 aa, Malus domestica
MLELRLVQGSLLKKVLESIKDLVNDANFDCSSSGFSLQAMDSSHVALVALLLRSEGFEHYRCDRNMSMGMNLGNMSKMLRCAGNDDIITIKADDGSDTVTFMFESPTQDKISDFEMKLMDIDSEHLGIPEAEYQSIVTMPSAEFARICKDLSGIGDTVVISVTKEGVKFSTRGDIGTANIVCRQNTTVDKPEEATVINMSEPVSLTFALRYMNSFTKATTLSNTVTISLSSELPVVVEYKIAEMGYIRFYLAPKIEEDDEGETKPEV

SEQ ID NO: 10773 - protein, 265 aa, Vigna unguiculata
MLELRLVQGSLLKKVLESIKELVTDANFDCSSTGFSLQAMDSSHVALVALLLRSEGFEHYRCDRNMSMGMNLNNMAKMLKCAGNDDIITIKAEDGGDTVTFMFESPTQDKISDFEMKLMDIDSEHLGIPEAEYHAIVKMPSTEFARICRDLSSIGDTVVISVTKEGVKFSTKGDIGSANIVCRQNTSVDKPEESTVIEMNEPVSLTFALRYMNSFTKATPLSNTVSISLSNELPVVVEYKVAEMGYVRFYLAPKIEEEEEEKPEV

SEQ ID NO: 10774 - protein, 263 aa, Fagopyrum esculentum
MLELRLIQGSLLKKVLDSIKDLVNDANFDCSSTGFSLQAMDSSHVALVALLLRAEGFEHYRCDRNISMGMNLGNMAKMLKCAGNDDIITIKADDGSDTVTFMFESPTQDKISDFEMKLMDIDSEHLGIPEAEYHAIVKMPSAEFGRICRDLSSIGDTIVISVTKEGVKFSTRGDIGTANIVCRQNTTVDKPEEATVIEMNEPVSLTFALRYLNSFTKATPLSSTVTLSLSSELPVVVEYKIAEMGHIRFYLAPKVEEDEDEKP

SEQ ID NO: 10775 - protein, 263 aa, Fagopyrum esculentum
MLELRLIQGSLLKKVLDSIKDLVNDANFDCSSTGFSLQAMDSSHVALVALLLRAEGFEHYRCDRNISMGMNLGNMSKMLKCAGNDDIITIKADDGSDTVTFMFESPTQDKISDFEMKLMDIDSEHLGIPEAEYHAIVKMPSAEFARICRDLSSIGDTVVISVTKEGVKFSTRGDIGTANIVCRQNTTVDKPEEATVIEMNEPVSLTFALRYLNSFTRATPLSSTVTLSLSSELPVVVEYKIAEMGHIRFYLAPKIEEDEDEKP

SEQ ID NO: 10776 - protein, 261 aa, Phalaenopsis aphrodite
MLELRLVQGSLLKKVLEAIKDLVTDANFDCSATGFSLQAMDSSHVALVALLLRSEGFEHYRCDRNISMGMNLNNMSKMLKCAGNDDIITIKGDDGSDTVTFMFESPNQDKISDFEMKLMDIDSEHLGIPEAEYHAIVKMPSSEFARICKDLSSIGDTVVISAAKEGVKFSTRGDIGSANIVCRQNKTVDKPEEATIIEMNEPVSLTFALRYLNSFTKATSLSESVTISLSSELPVVVEYKIADMGYIRFTWPLRSKMKKMR

SEQ ID NO: 10777 - protein, 246 aa, Secale cereale
GGEVLEAIKDLVTDANFDCSGTGFSLQAMDSSHVALVALLLRSEGFEHYRCDRNLSMGMNLGNMAKMLRCAGNDDIITIKADDGSDTVTFMFESPNQDKIADFEMKLMDIDSEHLGIPDSEYQAIVRMPSSEFSRICKDLSSIGDTVIISVTKEGVKFSTAGDIGTANIVCRQNNTVDKPEQSTIIEMQEPVSLTFALRYMNSFTKASPLSDQVTISLSSELPVVVEYKIGEMGYIRVLSGAQDRR

SEQ ID NO: 10778 - protein, 266 aa, Arachis hypogaea
MLELRLVQGSLLKKVVDAIKELVNDANFDCSATGFSLQAMDSSHVALVALLLRSEGFEHYRCDRNISMGMSLNNMAKMLRCAGNDDIITLKGDDGSDTVTFMFESPTQDKISDFEMKLMDIDSEHLGIPEAEYQAIVRMPSTEFAKICKDLSSIGDTVVISVTKEGVKFSTRGDIGSANIVCRQNTSVDKPEEATTVEMNEPVSLTFALRYMNSFTKATPLSNRVAISLSNELPVVVEYKIAEMGYVRFYLAPKIEEEEEETKPEV

SEQ ID NO: 10779 - protein, 255 aa, Antirrhinum majus
MFELRLVQGSLLKKVLESIKDLVNDANFDCSATGFSLQAMDSSHVALVALLLRSEGFEHYRCDRNLSMGMNLNNMSKMLKCAGNDDIITLKADDGSDTVTFMFESPTQDKIADFEMKLMDIDSEHLGIPEAEYHAIVRMPSAEFARICKDLSSIGDSIVISVTKEGVKFSTRGDIGTANVVCRQNTTVDKPEEATVIEMNEPVSLTFALRYLNSFTKATPLSNTVTISLSSELPVMVEYKIAEMGYVRFYLAPKI

SEQ ID NO: 10780 - protein, 262 aa, Fagopyrum esculentum
LELRLIQGSLLKKVLDSIKDLVNDANFDCSSTGFSLQAMDSSHVALVALLLRAEGFEHYRCDRNISMGMNLGNMSKMLKCAGNDDIITIKADDGSDTVTFMFESPTQDKISDFEMKLMDIDSEHLGIPEAEYHAIVKMPSAEFARICRDLSSIGDTIVISVTKEGVKFSTRGDIGTANIVCRQNTTVDKPEEATVIEMNEPVSLTFALRYLNSFTKATPLSSIVTLSLSSELPVVVEYKIAEMGHIRFYLAPKIEEDEDEKP

SEQ ID NO: 10781 - protein, 256 aa, Sciadopitys verticillata
LVQGSLLKKVLEAVKDLVTDANFDCSTTGFSLQAMDSSHVALVALLLRSEGFEHFRCDRNMSMGMNLNNMAKMLKCAGNDDIITLKADDGGDTVTFMFESPNQDKISDFEMKLMDIDSEHLGIPESEYHAIVRMPSQEFARICKDLSSIGDTVVISVTKEGVKFSTRGDIGSANIVCRQNTSVDKPEEATIIEMQEPVSLTFALRYMNSFTKATPLSNTVTISMSADLPVVVEYKVADMGYIRFYLAPKIEEEGES

SEQ ID NO: 10782 - protein, 114 aa, Silene vulgaris
LELRLVQGSLLKKVIESIKDLVTDANFDCSASGFSLQAMDSSHVALVALLLRAEGFEHYRCDRNISMGMNLVNMAKMLSVLVMMILLLLRLMMVVILSLSCLKALTRIRYQILK

SEQ ID NO: 10783 - protein, 262 aa, Amborella trichopoda
MLELRLVQGSLLKKVLDAIKDLVTDANFDCSSTGFSLQAMDSSHVALVALLLRSDGFEHFRCDRSVSVGMNLNNMAKMLKCASNDDIITIKSDDGGDAVTFMFESPNQDKISDFEMKLMDIDSEHLGIPEAEYHAIVKMPSSEFATICKDLSTIGDTVMISVTKEGVRFSTKGDIGSANIVCRQNTSVDKPEEATIIEMQEPVSLTFALRYLNSFTKATPLSSSVTISLSSELPVVVEYKIADMGYLRFYLAPKIEDEGDES

SEQ ID NO: 10784 - protein, 256 aa, Brassica juncea
QGSLLKKVLESVKDLVNDANFDCSSTGFSLQAMDSSHVALVSLLLRSEGFEHYRCDRNLSMGMNLGNMSKMLKCAGNDDIITIKADDGGDTVTFMFESPKQDKIADFEMKLMDIDSEHLGIPDAEYHSIVRMPSNEFSRICKDLSTIGDTVVISVTKEGVKFSTAGDIGTANIVLRQNTTVDKPEDAIVIEMNEPVSLSFALRYMNSFTKATPLSDTVTISLSSELPVVVEYKVAEMGYIRYYLAPKIEEEEEDKA

SEQ ID NO: 10785 - protein, 252 aa, Pinus pinaster
MLELRLVQGSLLKKVLESIKDLVTDANFDCSATGFSLQAMDSSHVALVSLLLRSEGFEHYRCDRNMSMGMNLNNMAKMLKCAGNDDIITIKADDGGDTVTFMFESPNQDKISDFEMKLMDIDSEHLGIPESEYHAIVRMPSQEFARICKDLSSIGDTVVISVSKEGVKFSTRGDIGSANIVCRQNPSVDKPDEATIIEMQEPVSLTFALRYMNSFTKATPLSNTVTISMSSELPVVVEYKIAEMGYIRFTWP

SEQ ID NO: 10786 - protein, 342 aa, Panax ginseng
MLELRLVQGSLLKKVMESIKDLVNDANFDCSATGFSLQAMDSSHVALVALLLRSEGFEHYRCDRNLSMGINLGNMSKMLKCAGNDDIVTIKADDGGDTVTFMFESPTQDKIADFEMKLMDIDSEHLGIPESEYEAIVRMPSAEFARICKDLSTIGDTVVISVTKEGVKFSTRGDIGTANIVCRQNTSVDKPEEATIIEMQEPISLTFALRYMNSFTKATPLANQVTVSLSSELPVVIEYKIAEMGYIRYYLAPKIEEEEGGAYAEPGPTKSAAETNTKRAANPEPRVEAVSEMEADPVIKSEPEEESNTAAKTITKMETKPEKQTNGEDDVIEVMDTKPKTN

SEQ ID NO: 10787 - protein, 263 aa, Physcomitrella patens
MLELRLVQGSLLKKVLEAIKDLVTDANFDCSTTGFSLQAMDSSHVALVALLLRSEGFEHYRCDRNISMGMNLTSMAKMLKCAGNDDIITIKADDGGDSVTFMFESPNQERISDFEMKLMDIDSEHLGIPETEYEAIVRMPSSEFARICKDLSTIGDTVVISVTKEGVKFSTGGDIGSANIICRQNTSVDKEEEKTVVEMQEPVTLTFALRYLNSFTKATPLSSTVTLSMSKELPVAVEYKIADMGHIRFYLAPKIEEDEEMAS

SEQ ID NO: 10788 - protein, 100 aa, Artemisia annua
MLELRLVQGSLLKKVMESIKDLVNDANFDCSATGFSLQAMDSSHVALVSLLLRSEGFEHYRCDRNMSMGMNIGNMSKMLKCGGNDDIVTIKADDGGDSVT

SEQ ID NO: 10789 - protein, 113 aa, Guizotia abyssinica
MLELRLVQGSLLKKVMESIKDLVTDANFDCSATGFSLQAMDSSHVALVSLLLRSEGFEHYRCGRNRSMGMNLNNMSKMLKCAGNDDIITLKADDGSDTVTFMFESPTQDKMLI

SEQ ID NO: 10790 - protein, 263 aa, Physcomitrella patens
MLELRLVQGSLLKKVLEAIKDLVTDANFDCSTTGFSLQAMDSSHVALVALLLRSEGFEHYRCDRNISMGMNLTSMAKMLKCAGNDDIITIKADDGGDSVTFMFESPNQERISDFEMKLMDIDSEHLGIPETEYEAIVRMPSAEFARICKDLSTIGDTVVISVTKEGVKFSTGGDIGSANIICRQNTSVDKEEEKTVVEMQEPVTLTFALRYLNSFTKATPLSSTVTLSMSKELPVAVEYKIADMGHIRFYLAPKIEEDEEMAS

SEQ ID NO: 10791 - protein, 262 aa, Amborella trichopoda
MLEFRLVQGSLLKKVMEAIKDLVTDANFECSSTGFSLQAMDSSHVALVALLLRSEGFEHYRCDRNLSMGMNLNNMSKMLKCAGNDDIITIKADDGGDIVTFMFESPSQDKISDFEMKLMDISSEQLGIPESEYQSIVRMPAAEFQRICKDLSSIGDTVIISVTKEGVKFSTRGDIGSANIVCRQNTSVDKPEEATVIEMKEPVSLTFALRYMNSFTKATPLSNSVSLSMSSDLPLVVEYKIADMGYLRFYLAPKIEDEEEQS

SEQ ID NO: 10792 - protein, 253 aa, Euphorbia peplus
MLELRLVQGSVLKKVLESIKDLVTDANFDCSSTGFSLQAMDSSHVALVALLLRSEGFEHYRCDRNISMGMNLNNVSKMLKCSGNDDIITIKADDGSDTVTFMFESPTQDKISDFEMKLMDIDSEHLGIPEAEYHAIVRMPSAEFSKICKDLASIGDTVVISVTKEGVKFSTRGDIGAANIVVRQNTTVDKPEQATIVEMNEPVSLTFALRYMNSFTKATPLSETVTISLSSELPVVVVYKIAGMGYVRFYLAP

SEQ ID NO: 10793 - protein, 249 aa, Centaurea maculosa
MESIKDLVNDANFDCSATGFSLQAMDSSHVALVSLLLRSEGFEHYRCDRNISMGMNLNNMSKMLKCAGNDDIITLKADDGSDTVTFMFESPTQDKIADFEMKLMDIDSEHLGIPEAEYHAIVRMPSSEFARICKDLSSIGDTVVISVTKEGVKFSTRGDIGTANVVCRQNTTVDKPEEATIIEMNEPVSLTFALRYMNSFTKATPLSNTVTISLSSELPVVVEYKIAEMGYIRFYLAPKIEEDDEENKS

SEQ ID NO: 10794 - protein, 224 aa, Cirsium arvense
MDSSHVALVSLLLRSEGFEHYRCDRNLSMGMNLGNMTKMLKCAGNDDIITIKADDGSDTVTFMFESPTQDKIADFEMKLMDIDSEHLGIPEAEYHAIVRMPSSEFARICKDLSSIGDTVVISVTKEGVKFSTRGDIGTANVVCRQNTTVDKPEEATIIEMNEPVSLTFALRYMNSFTKATPLSNTVTISLSSELPVVVEYKIAEMGYIRFYLAPKIEEDEEDNK

SEQ ID NO: 10795 - protein, 69 aa, Cirsium arvense
MLELRLVQGSLLKKVMESIKDLVNDANFDCSATGFPFRPWTPATWRWFRYFSDRKGSNTTGVIGTCPWG

SEQ ID NO: 10796 - protein, 69 aa, Flaveria ramosissima
MLELRLVQGSLLKKTMEAIKDLVTDANFDCSATGFSLQAMDSSHVALVSLLSDRKGSNTTDVTVTYPWG

SEQ ID NO: 10797 - protein, 244 aa, Euonymus alatus
MLELRLVQGSLLKKVLESIKDLVNDANFDCSATGFSLQAMDSSHVALVALLLRSEGFEHYRCDRNLSMGMNLNNMSKMLRCAGNDDIITIKADDGSDTVTFMFESPTQDKISDFEMKLMDIDSEHLGIPEAEYHAIVRMPSAEFARICKDLSSIGDTVVISVTKEGVKFSTRGDIGAANIVLRQNTTVDKPEEATIIEMNEPVSLTFALRYMNSFTKATPLSSTVTISLSSELPVVVEYKIAEM

SEQ ID NO: 10798 - protein, 262 aa, Silene vulgaris
MLELRLVQGSLLKKLLESIKDLVTDANFDCSATGFSLQAMDSSHVALVALLLRAEGFEHYRCDRNISMGMNLGNMAKMLKCAGNDDIITLKADDGSDTITFMFESPNQDKISDFEMKLMDIDSEHLGIPEAEYHAIVRMPSAEFARICRDLSSIGDTVVISVAKDGVKFSTSGDIASANTFLKQNTTVDKPEEAITIEMNEPVSLTFALRYLNSFTKATPLSNTVTISLSSELPVAVEYKIAEMGYIRFYLAPKIEEDENES

SEQ ID NO: 10799 - protein, 311 aa, Actinidia deliciosa
  misc_feature (278)..(278): Xaa can be any naturally occurring amino acid
MFELRLVQGSLLKKVMEAIKDLVNDANFDCSTTGLSMQAMDSSHVALVAFLLRSEGFEHYRCDRNISMGINLANMAKMLKCAGNDDIVTVKADDGTDSVTFMFESPTQDKIADFEMKLMDIDSEHLGIPEAEYDAIVRMPSAEFARICKDLSSIGDTVVISVTKEGVKFSTRGDIGTANIVCRQNTSIDKPEEATIIEMKEMVSLTFALRYMNSFAKATPLASQVTISLSSDLPVVVEYKIAEMGYIRFYLAPKIEEEEAETHAETKSKSEAKPKRPXPEVKPEVQIHLEVEDSCMEPAVESKPPLDLDIK

SEQ ID NO: 10800 - protein, 266 aa, Cajanus cajan
MLELRLVQGSLFKKVLDGIKDLVNDANFDCSSTGFSLQAMDSSHVALVALLLRSEGFEHYRCDRNISMGMNLSNMAKMFKCAGNDDIITIKADDGGDTVTFMFESPTQDKISDFEMKLMSIDSEHLGIPEAEYHAIVKMPSSEFARICRDLSTIGDTVVISVSKEGVKFTTKGDIGIANIVCRQNTSVDKPEEATVIEMNEPVSLTFALRYMNSFTKATPLSNIVTISLSNELPVVVEYKIAEMGYVRFYLAPKIEEDEEETKPEV

SEQ ID NO: 10801 - protein, 263 aa, Ceratodon purpureus
MLELRLVQGSLLKKVLESIKDLVTDANFDCSSTGFSLQAMDSSHVALVALLLRSDGFEHYRCDRNISMGMNLTSMAKMLKCAGNDDIITIKADDGGDSVTFMFESPNQERISDFEMKLMDIDSEHLGIPETEYEAIVRMPSAEFARICKDLSTIGDTVIISVTKEGVKFSTGGDIGSANIVCRQNTSVDKEEEKTVVEMQEPVTLTFALRYLNSFTKATPLSSTVTLSMSKELPVAVEYKIADMGHIRFYLAPKIEEDEDMAT

SEQ ID NO: 10802 - protein, 264 aa, Populus trichocarpa
MLELRLVQGSLLKKVLESIKDLVNDANFDFSSSGFSLQSMDSSHVALVALLLKSEGFEHYRCDRNTSMGMNLGNMSKMLKCAGNDDIITIKGDDGSDTVTFMFESPTQDKIADFEMKLMDIDSEHLGIPEAEYHAIVKMPSAEFARICKDLASIGDTVVISVTKEGVKFSTRGDIGTANIVLRQKTTVDKPEDATVIEMNEPVSMTFALRYMNSFTKATPLSNTVTISMSPDLPVVVEYKIAEMGYVRFYLAPKMEEDEPEPGA

SEQ ID NO: 10803 - protein, 350 aa, Echinacea purpurea
MESIKDLVNDANFDCSATGFSLQAMDSSHVALVSLLLRSEGFEHYRCDRNLSMGMNLGNMAKMLRCAGNDDIVTIKADDGGDCVTFMFESPNQDKIADFEMKLMDIDSEHLGIPEAEYEAIVRMPSSEFARICKDLSSIGDTVVISVTKEGVKFSTKGDIGTANIVCRQNTSVDKPEEATIIEMQTPVSLTFALRYMNSFTKATPLASQVTVSLSSELPIVVEYKIAEMGYLRFYLAPKIEEDEEMGGQQPEPMETKKQPEKKPKPEPTSNGEPKRRVMKIDLDDEEEELKPKVEAKLKGDTDGYVEVIGSKPGNGIVKPKEEMTEDEVMDVKPTIEKETNGEAQVMDEE

SEQ ID NO: 10804 - protein, 275 aa, Zostera marina
MLELRLIQGSLLKKVLEAIKDLVTEANFDCSATGFSLQAMDSSHVALVALLLRSEGFDHYRCDRNLSMGINLNNMSKMLRCAGPEDIITIKGDDGTDTVTFMFESQKQDKISDFEMKLMDIDSEHLGIPDAEYQAIVRMPSAEFARICKDLGSIGDTVVISVTKEGVKFFTRGDVGSANIVCRQNTSVDKPEDSTVIEMNEPVSLTFALRYMNSFTKATTLSEVVTISLSSELPVVVEYKIAEMGYIRFYLAPKIEDEDEEMVPQNQADVKAEPA

SEQ ID NO: 10805 - protein, 344 aa, Citrullus lanatus
MLEFRLVQGSLLKKVLEAMKDLVNDANFDCSCTGFSLQAMDSSHVALVSLLLRSEGFEHYRCDRSISMGMNLNNMAKMLRCAGNDDIVTLKADDGGDCVTFMFENPSQDKIADFEMKLMDIDSEHLGIPDAEYQSIVRMPAAEFARICKDLSSIGDTVLISVSKEGVQFSTRGDIGTANIVCRRNTTVDKPEEAVIIEMEEPVSLTFALRYLNSFTKATPLANQVTISMSSDLPVVVEYRIEDMGYIRYYLAPKIEEEDEAAAAAEAFSRTETEPKHTAKAKPKTDLKPKVEPNPESEMKIKEDKVSITEIKDEDNKTVLEINDEEKNSPVESKEPKIETMELE

SEQ ID NO: 10806 - protein, 249 aa, Ambrosia trifida
MESIKDLVNDANFDCSATGFSLQAMDSSHVALVSLLLRAEGFEHYRCDRNISMGMNLNNMSKMLKCAGNDDIITLKADDGSDTVTFMFESPTQDKIADFEMKLMDIDSEHLGIPEAEYHAIVRMPSSEFARICKDLSSIGDTVVISVSKEGVKFSTRGDIGTANVVCRQNTTVDKPEEATVIEMNEPVSLTFALRYMNSFTKATPLSSTVTISLSSELPVVVEYKIAEMGYIRFYLAPKIEEDDEENKS

SEQ ID NO: 10807 - protein, 231 aa, Secale cereale
MLELRLVQGSLLKKVLEAIKELVTDANFDCSGTGFSLQAMDSSHVALVALLLRSEGFEHYRCDRNLSMGMNLGNMAKMLRCAGNDDIITIKADDGSDTVTFMFESPNQDKIADFEMKLMDIDSEHLGIPDSEYQAIVRMPSSEFSRICKDLSSIGDTVIISVTKEGVKFSTAGDIGTANIVCRQNKTVDKPEESTIIEMQEPVSLTFALRYMNSFTKASPRVRPSHHQPLI

SEQ ID NO: 10808 - protein, 249 aa, Cirsium arvense
MESIKDLVNDANFDCSATGFSLQAMDSSHVALVSLLLRSEGFEHYRCDRNISMGMNLSNMSKMLKCAGNDDIITLKADDGSDTVTFMFESPTQDKIADFEMKLMDIDSEHLGIPEAEYHAIVRMPSAEFARICKDLSSIGDTVVISVTKEGVKFSTRGDIGTANVVCRQNTTVDKPEEATIIEMNEPVSLTFALRYMNSFTKATPLSNTVTLSLSSELPVVVEYKIAEMGYIRFYLAPKIEEDDEENQS

SEQ ID NO: 10809 - protein, 274 aa, Cucumis sativus
MLELRLVQGSLLKKVLEALKDLVNDANFDCSSSGFSLQAMDSSHVALVSLLLRSESFEHYRCDRTMSMGMNLNNMAKMLRCAGNDDIVTLKADDGSDSVTFMFENPSQDKIADFEMKLMDIDSEHLGIPDAEYQSIVKMPAVEFARICKDLSSIGDTVLISVSKEGVQFSTRGDIGTANIVCRRNTTVDKPEEAVMIEMEEPVSLTFALRYLNSFTKATPLANQVTISMSSDLPVVVEYRIEGMGYIRYYLAPKIEEEDEAATISKPETEPKHT

SEQ ID NO: 10810 - protein, 224 aa, Festuca arundinacea
MDSSHVALVALLLRSEGFEHYRCDRNLSMGINLANMAKMLRCAGNDDIITIKADDGSDTVTFMFESPNQDKIADFEMKLMDIDSEHLGIPDSEYQAIVRMPSSEFSRICKDLSSIGDTVIISVTKEGVKFSTAGDIGTANIVCRQNKTVDKPEESTIIEMQEPVSLTFALRYMNSFTKASPLSDQVTISLSSELPVVVEYKIGEMGYIRFYLAPKIEEDEEMKA

SEQ ID NO: 10811 - protein, 269 aa, Ipomoea batatas
FPARKCWNFVLFRPSLLKKVMDAIKDLVNDANFDCSATGFSLQAMDSSHVALVALLLRSEGFEHYRCDRNISMGMNLNNMAKMLKCAGNDDIITIKADDGSDTVTFMFESPTQDKIADFEMKLMDIDSEHLGIPETDYHAIVRMPSAEFARICRDLSSIGDTIVISVTKEGVKFSTRGDIGNANVVCRQNTTVDKPEEATVIEMNEPVSLTFALRYLNSFTKATPLSNTVTLSLSSELPVVVEYKIAEMGHIRFYLAPKIEEDEEDTKP

SEQ ID NO: 10812 - protein, 246 aa, Vinca minor
IKDLVVDANFDCSASGFSLQAMDSSHVALVALLLRSEGFEHYRCDRNLSMGMNLNNMAKMLKCAGNDDIITLKADDGADTVTFMFESPTQDKISDFEMKLMNIDSEHLGIPEAEYHAIVRMPSAEFGRICKDLSSIGDTVVISVTKEGVKFSTRGDIGTANIVCRQNTTVDKPEEATVIEMNEPVSLTFALRYLNSFTKASPLSNTVTLSLSSELPVVVEYKIAEMGYIRFYLAPKIEEEEEEMKP

SEQ ID NO: 10813 - protein, 280 aa, Aristolochia fimbriata
MLELRLVQGSLLKKVLEAVKDLVTDANFDCSATGFSLQAMDSSHVALVALLLRSEGFEHYRCDRNISMGMNLNNMSKMLKCAGNDDIITIKGDDGSDTVTFMFESPNQDKIADFEMKLMDIDSEHLGIPEAEYHAIVKMPSTEFARICKDLSTIGDTVVISVTKEGVKFSTRGDIGTANIVCRQNTSVDKPEEATVIEMKEPVSLTFALRYMNSFTKATPLSTTVVISLSPELPVVVEYKVAEMGYVRFYLAPKIEDDEVDEVVEQPSKKSKAQPKDEDD

SEQ ID NO: 10814 - protein, 240 aa, Centaurea maculosa
MLELRLVQGSLLKKVMESIKDLVNDANFDCSATGFSLQAMDSSHVALVSLLLRSEGFEHYRCDRNLSMGMNLGNMTKMLKCAGNDDIITIKADDGSDTVTFMFESPTQDKIADFEMKLMDIDSEHLGIPEAEYHAIVRMPSSEFARICKDLSSIGDTVVISVTKEGVKFSTRGDIGTANVVCRQNTTVDKPEEATIIEMNEPVSLTFALRYMNSFTKATPLSNTVTISLSSELPVVVEYR

SEQ ID NO: 10815 - protein, 246 aa, Platanus occidentalis
MESIKDLVTDANFDCSATGFSLQAMDSSHVALVALLLRSEGFEHYRCDRNLSMGMNLNNMSKMLKCAGNDDIITIKADDGSDTVTFMFESPTQDKISDFEMKLMDIDSDHLGIPEAEYQSIVRMPSSEFARICKDLSSIGDTVVISVTKEGVKFSTRGDIGAANIVCRQNTTVDKPEEAIVIEMQEPVSLTFALRYMNSFTKATPLSSTVTISMSSDLPIVVEYKIAEMGYVRFYLAPKIEDEEED

SEQ ID NO: 10816 - protein, 262 aa, Musa acuminata
MLELRLLQGGLLKKVLEAMRELVTDANFDCSRSGCSLQAMDSSHVALVALLLRSDGFDHFRCDRNRSMGMNLNHVAKLLRCAGNDDIVTLKADDDGDTVTFMFESPKQDKIADFEMKLMDIQSEHLGIPEAEYQAIVKMPSQEFARICRDLSTIGDTVVISVTKEGVKFSTKGDIGSANIVCRQNTTVDKPEESTVIEMKDPVSLTFALRYLISFTKATPLSNTVTVSMSSDLPMVVEYKIADMGYIRYYLAPKIDEDEDQA

SEQ ID NO: 10817 - protein, 236 aa, Glycyrrhiza uralensis
MLELRLVQGSLLKKVLEAIKELVNDANFDCSSTGFSLQAMDSSHVALVALLLRSEGFEHYRCDRNISMGMNLNNMSKMLRCAGNDDIITIKGDDGSDTVTFMFESPTQDKISDFEMKLMDIDSEHLGIPEAEYHAIVRMPSAEFARICKDLSSIGDTVVISVTKEGVKFSTKGDIGAANIVCRQNTTVDKPEEATVIEMNEPVSLTFALRYMNSFTKATPLSNTVTISLSNELPVV

SEQ ID NO: 10818 - protein, 222 aa, Elaeis guineensis
MLELRLVQGSLLKKVLEAIRELVNDANFDCSATGFSLQAMDSSHVALVALLLRSEGFEHYRCDRNLSMGMNLNNMAKMLRCAGNDDIITIKADDGSDTVTFMFESPNQDKIADFEMKLMDIDSEHLGIPDAEYHAIVRMPSSEFARICKDLSSIGDTVVISVTKEGVKFSTAGDIGTANIVCRQNKTFDKPEEATIIEMQEPVSLTFALRYMNSFTKATPLI

SEQ ID NO: 10819 - protein, 255 aa, Glycine max
MAETNNNVAVEVLEKEDLAVSLAKYVADLSNKFTSERGAFTVCLSGGSLINYLRKLLEPPYVDTLEWSKWHVFWVDERVVPKTHEDSNYKLALDGLLSKVPIPPGNVYAINDALSAEGAANDYETCLRHLVKNSIIASSPANGFPKFDLMLLGMGPDGHIASLFPGHPLVEEKQRWVTFIKDSPKPPPERITFTLPVINTSAYAALVVTGKGKADAVHSVLGKSQNFAKLPVGLVSPEGELKWFLDKGAASKLAA

SEQ ID NO: 10820 - protein, 312 aa, Cajanus cajan
MAYTHSTLFSNTLRFPLASFPNTHLHPPSAHLSLRPLTFRRLIAIALHSNALLPPIKASMADTNKNVAVEVFDKDDLAVSLAKYVADLSDKFTKERGAFTVCLSGGSLIKYLGKLLEPPYVDSLEWSKWHVFWVDERVVPKTHEDSNYKLALDGLLSKVPIPPGNNYAINDALSAEGAADDYETCLRQLVKNNVIASSPASGFPKFDLMLLGMGPDGHVASLFPGHPLVEENKRWVAFIKDSPKPPPERITFTFPVINASAYAALVVTGKGKADAVNSVLGKSQNSAKLPAGLVAPEGELKWFLDKGAASKL

SEQ ID NO: 10821 - protein, 310 aa, Phaseolus vulgaris
MASVHSTLSTNTLRFPFSSFPNTNLHPPSTHIFFSRPLTFKGVSVNPKSFLTPLKVSMAETNNVVATEVFEKEDLAVSLAKYVADLSNKFTSERGAFTVCLSGGSLIKYLGKLLEPPYVDSLEWSKWNVFWLDERVVPKTHDDSNYKLALDGLLSKVPIPPGNVYAINDTLSAEGAADDYETRLRELVNKSVITSSATSGFPKFDLMLLGMGPDGHVASLFPGHPLVQESKRWVTFIKDSPKPPPERITFTFPVINASAYAALVVTGKGKADVVHSVLGKSENPVKLPAGLVSPEGELKWFLDKDAASKL

SEQ ID NO: 10822 - protein, 321 aa, Phaseolus vulgaris
MHRVCDKLIGVFMVDKPTPTDWRRLLAFSREWNNLRPHFFARCHERADAEEDPAMKEKLLRLARKLKQIDEDVQRHNELIEVVKRDPSQISEIVSKRRKDFTEEFFIHLHTVAESYYDNKEKQNELAKLGNSCLAAVQAYDAATENIEQVNAAELKFQDIINSPSLDAACRKIDNLAEKKELDSTLVLMITKAWSAAKESDMMKDEVKDILFHLYKTAVGNLQKLVPKEIRIVKYLIQIDDPEEQLSALKDAFTPGEELEGKDVDNLYTTPEKLHTWIKSVVDAYHLSREGTLIREARDLLSPEIIQKLEGLKMIVERNFM

SEQ ID NO: 10823 - protein, 321 aa, Cajanus cajan
MNGVCDKLIGVFMVDKPTPTDWRTLLAFSREWNNLRPHFFARCQDRALAEHDPAMKENLLRLARKLKQIDEDVQRHNDLLQVVRQDPSGITEIVSKRRKDFTEEFFVHLHTVAESYYDNKHEQNELAKLGNACLAAVQAYDAATESIEQLNAAELKFQDIINSPSLDAACRKIDNLAEKKELDSTLVLMITKAWSAAKESNMMKDEVKDILYHLYKTAVGNLQRLVPKEIRIVKYLIRIEDPEEQLTALKDAFTPGEELEGKDVDNLYTTPEKLHTWIKSVLDAYHLSREGTLIREARDLLNPEVIQKLEVLKKVVERNFM

SEQ ID NO: 10824 - protein, 390 aa, Phaseolus vulgaris
MELCTANAILPPRFSVPTLHAACVRNLKYSVPFPRFIIRTQRKFDRRRGSGPRATVSDGRSCEAVDESRMHRVCDKLIGVFMVDKPTPTDWRRLLAFSREWNNLRPHFFARCHERADAEEDPAMKEKLLRLARKLKQIDEDVQRHNELIEVVKRDPSQISEIVSKRRKDFTEEFFIHLHTVAESYYDNKEKQNELAKLGNSCLAAVQAYDAATENIEQVNAAELKFQDIINSPSLDAACRKIDNLAEKKELDSTLVLMITKAWSAAKESDMMKDEVKDILFHLYKTAVGNLQKLVPKEIRIVKYLIQIDDPEEQLSALKDAFTPGEELEGKDVDNLYTTPEKLHTWIKSVVDAYHLSREGTLIREARDLLSPEIIQKLEGLKMIVERNFM

SEQ ID NO: 10825 - protein, 487 aa, Zea mays
MAMQAAFLAGFSQLAAQPSRDCAVAVAPTRVAVAAVGSAKVGARVGLKAGIAAPAPAAGRGVRCRASLIEPDGGQLVDLVAPEEGGRRAALRREAAELPHRLRLGRVDKEWVHVLSEGWASPLQGFMREHEFLQTLHFNAIRGQDGRMVNMSVPIVLSVGDAQRRAIQADGATRVALVDERDRPIAVLSDIEIYKHNKEERIARTWGTTAPGLPYVEEAITNAGDWLIGGDLEVIEPIKYNDGLDQYRLSPAQLREEFARRNADAVFAFQLRNPVHNGHALLMTDTRKRLLEMGYKNPVLLLHPLGGFTKADDVPLSWRMKQHEKVLEEGVLNPESTVVAIFPSPMHYAGPTEVQWHAKARINAGANFYIVGRDPAGMSHPTEKRDLYDADHGKKVLSMAPGLERLNILPFKVAAYDTKQKKMDFFDPSRKDDFLFISGTKMRTLAKNRESPPDGFMCPGGWKVLVEYYDSLVPSEGSSKLREPIAA

SEQ ID NO: 10826 - protein, 488 aa, Sorghum bicolor
MATQAAFLAGLSQLAAQPGRDRAVAPARVAVAAVGVGSAKVGVRVGVKAGTAEAKAVAQRRGVRCRASLIEPDGGRLVDLVAPEEGGRRAALRREAAELPHRLRLSRVDKEWVHVLSEGWASPLQGFMREHEFLQALHFNAIRGADGRMVNMSVPIVLSLGDAQRRAIQADGATRVALVDQRDRPIAVLSDIEIYKHNKEERIARTWGTTAPGLPYVEEAITNAGDWLIGGDLEVIEPIKYNDGLDQYRLSPAQLREEFARRNADAVFAFQLRNPVHNGHALLMTDTRKRLLEMGYKNPVLLLHPLGGFTKADDVPLSWRMKQHEKVLEEGVLNPESTVVAIFPSPMHYAGPTEVQWHAKARINAGANFYIVGRDPAGMSHPTEKRDLYDADHGKKVLSMAPGLERLNILPFKVAAYDTKQKKMDFFDPSRKDDFLFISGTKMRTLAKNRENPPDGFMCPGGWKVLVEYYDSLVPSEGSSKLREPVAA

SEQ ID NO: 10827 - protein, 489 aa, Zea mays
MATQAAFLAGFSQLAAQPGRDRAVAVAVAPAPGPARVAVAAVGSAKLGVKAGTSRTAAVARLGVRCRASLIEPDGGRLVDLVAPEEGGRRAALRREAAELPHRLRLGRVDKEWVHVLSEGWASPLQGFMREHEFLQALHFNAIRGQDGRMVNMSVPIVLSVGDAQRRAIQADGATRVALVDERDRPIAVLSDIEIYKHNKEERVARTWGTTAPGLPYVEEAITNAGDWLVGGDLEVIEPIKYNDGLDQYRLSPAQLREEFARRNADAVFAFQLRNPVHNGHALLMTDTRKRLLEMGYKNPVLLLHPLGGFTKADDVPLSWRMKQHEKVLEEGVLNPESTVVAIFPSPMHYAGPTEVQWHAKARINAGANFYIVGRDPAGMSHPTEKRDLYDADHGKKVLSMAPGLERLNILPFKVAAYDTKQKKMDFFDPSRKDDFLFISGTKMRTLAKNRESPPDGFMCPGGWKVLVEYYDSLVPSEGSSKLREPVAA

SEQ ID NO: 10828 - protein, 479 aa, Setaria italica
MATQAAFLARFPQLAAQPGRDRAGMGGPARVSVAAIGSAAKVGVGMRAVARRGVRCRASLIEPDGGRLVDLVAPEEGGRRAALRREAASLPHRVRLGRVEKEWVHVLSEGWASPLQGFMREHEFLQALHFNAIRGEDGRMANMSVPIVLSLGDAQRRAILADGATRVALVDDRDRPIAVLSDIEIYKHNKEERIARTWGTTAPGLPYVEEAITNAGDWLIGGDLEVIEPIKYNDGLDQYRLSPAQLREEFARRNADAVFAFQLRNPVHNGHALLMTDTRKRLLDMGYKNPVLLLHPLGGFTKADDVPLSWRMKQHEKVLEEGVLNPESTVVAIFPSPMHYAGPTEVQWHAKARINAGANFYIVGRDPAGMSHPTAKRDLYDADHGKKVLSMAPGLERLNILPFRVAAYDTKQKKMDFFDPSRKDDFLFISGTKMRTLAKNRESPPDGFMCPGGWKVLVEYYDSLVPSEGSSKLREPVAA

SEQ ID NO: 10829 - protein, 453 aa, Pennisetum glaucum
RVSVAAIGSAAAKVGVGVGVRAVARRGVRCRASLIEPDGGRLVDLVAPEEGGRRAALRREAASLPHRVRLGRVEKEWVHVLSEGWASPLQGFMREHEFLQALHFNAIRGEDGRVANMSVPIVLSLGDAQRRAILADGATRVALVDDRDRPIAVLSDIEIYKHNKEERIARTWGTTAPGLPYVEEAITNAGDWLIGGDLEVIEPIKYNDGLDQYRLSPAQLREEFARRNADAVFAFQLRNPVHNGHALLMTDTRKRLLDMGYKNPVLLLHPLGGFTKADDVPLSWRMKQHEKVLEEGVLNPESTVVAIFPSPMHYAGPTEVQWHAKARINAGANFYIVGRDPAGMSHPTAKRDLYDADHGKKVLSMAPGLERLNILPFRVAAYDTKQKKMDFFDPSRKDDFLFISGTKMRTLAKNRESPPDGFMCPGGWKVLVEYYDSLVPSEGSSKLREPVAA

SEQ ID NO: 10830 - protein, 447 aa, Panicum virgatum
ARAGGVKAGAAGPGWAAAPRGVRCRASLIEPDGGRLVDLVAPEEGGRRAALRREAASLPHRLRLGRVDKEWLHVLSEGWASPLQGFMREHEFLQALHFNAIRGADGRMVNMSVPIVLSLGDAQRRAIQADGATRVALVDDRDRPLAVLSDIEIYKHNKEERIARTWGTTAPGLPYVEEAITNAGDWLIGGDLEVIEPIKYNDGLDQYRLSPAQLREEFTRRNADAVFAFQLRNPVHNGHALLMTDTRKRLLDMGYKNPVLLLHPLGGFTKADDVPLSWRMKQHEKVLEEGVLNPESTVVAIFPSPMHYAGPTEVQWHAKARINAGANFYIVGRDPAGMSHPTAKRDLYDADHGKKVLSMAPGLEKLNILPFRVAAYDTKQKKMDFFDPSRKDDFLFISGTKMRTLAKNRESPPDGFMCPGGWKVLVEYYDSLVPSEGSSKLREPVAA

SEQ ID NO: 10831 - protein, 477 aa, Oryza sativa
MAMQAAFAASMFPQLAQRRGSDRAVVVAPPAPAPVRVAMRSGGAAAAAARGVRCRASLIEPDGGRLVELVVPEEGGRREAARREAAALAHRVRLGRVETEWLHVLSEGWASPLRGFMREAEFLQALHFNAIRGGDGAMVNMSVPIVLPLGDAQRRAIEASGARRVALVDAADRPLAVLSDIEIYKHNKEERIARTWGTTAPGLPYVDEAITNAGDWLIGGDLEVIEPIKYNDGLDQYRLSPAQLREEFARRNADAVFAFQLRNPVHNGHALLMTDTRKRLLEMGYKNPVLLLHPLGGFTKADDVPLSWRMKQHEKVLEEGVLNPESTVVAIFPSPMHYAGPTEVQWHAKARINAGANFYIVGRDPAGMGHPTEKRDLYDADHGKKVLSMAPGLEKLNILPFKVAAYDTKQKKMDFFDPSRKDDFLFISGTKMRTLAKNCQSPPDGFMCPGGWKVLVEYYDSLTPSADSSKLREAVAA

SEQ ID NO: 10832 - protein, 471 aa, Triticum aestivum
MATQAAFAVRFPQLARPGRGHGQGQPATRVAVRGGRAAAAAARGVRCRAGGLIEPDGGRLVELVAPEEGGRRAALRREAAALPHRLRLGRVDTEWLHVLSEGWASPLRGFMRETEFLQALHFNAVRGADGSLVNMSVPIVLALDDAQRRAIQADGATTVALVDAHDRPVAVLSDIEIYKHNKEERIARTWGTTARGLPYVEEAITNAGDWLIGGDLEVIEPIKYNDGLDQYRLSPAQLREEFARRNADAVFAFQLRNPVHNGHALLMTDTRRRLLEMGYKNPVLLLHPLGGFTKADDVPLSVRMKQHEKVLEEGVLNPESTVVAIFPSPMHYAGPTEVQWHAKARINAGANFYIVGRDPAGMGHPTEKRDLYDADHGKKVLSMAPGLERLNILPFKVAAYDTKHNKMNFFDPSRKEDFLFISGTKMRSLAKNRESPPDGFMCPGGWKVLVEYYDSLAPPEGSSKLREAVAA

SEQ ID NO: 10833 - protein, 466 aa, Brachypodium distachyon
MATQAAFLVKFPQLALSAQPSRGQSWVAVAAGKVAAPRGVRCRAGGLIEPDGGRLVELVAPEEGGRRAALRREAAALPHRVRLGRVETEWVHVLSEGWASPLRGFMRESEFLQALHFNAVRGDDGKLVNMSVPIVLAVDDAQRRAIEASGATRVALVDDHDRPVAVLSDIEIYKHNKEERIARTWGTIARGLPYVEEAIANSGDWLIGGDLEVIEPIKYNDGLDQYRLSPAQLREEFTRRNADAVFAFQLRNPVHNGHALLMTDTRRRLLEMGYKNPVLLLHPLGGFTKADDVPLSVRMKQHEKVLEEGVLNPESTVVAIFPSPMHYAGPTEVQWHAKARINAGANFYIVGRDPAGMSHPIEKRDLYDADHGKKVLSMAPGLERLNILPFKVAAYDTKQNKMNFFDPSRKDDFLFISGTKMRSLAKNRESPPDGFMCPGGWKVLVEYYDSLTPPEGSSKLREAVAA

SEQ ID NO: 10834 - protein, 469 aa, Triticum aestivum
MATQAAFAVRFPQLARPSRGHGQGQPARVGVAVRGGRAAARGVRCRAGGLIEPDGGRLVELVAPEEGGRRAALRREAAALPHRVRLGRVDTEWLHVLSEGWASPLRGFMRETEFLQALHFNAVRGADGTLVNMSVPIVLALDDAQRRAIQADGATAVALVDAHDRPVAVLSDIEIYKHNKEERIARTWGTTARGLPYVEEAITNAGDWLIGGDLEVIEPIKYNDGLDQYRLSPSQLREEFARRNADAVFAFQLRNPVHNGHALLMTDTRRRLLEMGYKNPVLLLHPLGGFTKADDVPLSVRMKQHEKVLEEGVLNPESTVVAIFPSPMHYAGPTEVQWHAKARINAGANFYIVGRDPAGMGHPTEKRDLYDADHGKKVLSMAPGLERLNILPFKVAAYDTKHNKMNFFDPSRKEDFLFISGTKMRSLAKNRESPPDGFMCPGGWKVLVEYYDSLAPPEGSSKLREAVAA

SEQ ID NO: 10835 - protein, 466 aa, Brachypodium distachyon
MATQAAFLVKFPQLALSAQPSRGQSWVAVAAGKVAAPRGVRCRAGGLIEPDGGRLMELVAPEQGGRRAALRREAAALPHRVRLGRVETEWVHVLSEGWASPLRGFMRESEFLQALHFNAVRGDDGKLVNMSVPIVLAVDDAQRRAIEASGATRVALVDDHDRPVAVLSDIEIYKHNKEERIARTWGTIARGLPYVEEAIANSGDWLIGGDLEVIEPIKYNDGLDQYRLSPAQLREEFTRRNADAVFAFQLRNPVHNGHALLMTDTRRRLLEMGYKNPVLLLHPLGGFTKADDVPLSVRMKQHEKVLEEGVLNPESTVVAIFPSPMHYAGPTEVQWHAKARINAGANFYIVGRDPAGMSHPIEKRDLYDADHGKKVLSMAPGLERLNILPFKVAAYDTKQNKMNFFDPSRKDDFLFISGTKMRSLAKNRESPPDGFMCPGGWKVLVEYYDSLTPPEGSSKLREAVAA

SEQ ID NO: 10836 - protein, 481 aa, Avena sativa
MATQAAFVVKFPQQLARPSRVQGRPVPPARVGIAVSRGSPGNKAVSAAAPPPRGVRCRAGGLIEPDGGKLVELVAPEEGGRRAALRREAAALPHRVRLGRVDTEWVHVLSEGWASPLRGFMRENEFLQALHFNAVRGDDGTMVNMSVPIVLAVDDAQRRAILASGATSVALVDDHDRPVAVLSDIEIYKHNKEERIARTWGTTARGLPYVDEAITNAGDWLIGGDLEVIEPIKYNDGLDQYRLSPAQLREEFARRNADAVFAFQLRNPVHNGHALLMTDTRRRLLEMGYKNPVLLLHPLGGFTKADDVPLSVRMKQHEKVLEEGVLNPESTVVAIFPSPMHYAGPTEVQWHAKARINAGANFYIVGRDPAGMGHPIEKRDLYDADHGKKVLSMAPGLERLNILPFKVAAYDRKHNKMNFFDPSRKEDFLFISGTKMRGLAKNRESPPDGFMCPGGWKVLVEYYDSLTPPEDSPKLREAVAA

SEQ ID NO: 10837 - protein, 470 aa, Secale cereale
MATQAAFAVRFPQLARESRGQGQGQARPARVAVRGGRAVAARGVRCRAGGLIEPDGGRLVELVAPEEGGRRAALRREAAALPHRVRLGRVDTEWLHVLSEGWASPLRGFMRETEFLQALHFNAVRGGDGSLVNMSVPIVLALDDAQRRAIQASGATSVALVDAHDRPVAVLSDIEIYKHNKEERIARTWGTTARGLPYVEEAITNAGDWLIGGDLEVIEPIKYNDGLDQYRLSPAQLREEFARRNADAVFAFQLRNPVHNGHALLMTDTRRRLLEMGYKNPVLLLHPLGGFTKADDVPLSVRMKQHEKVLEEGVLNPESTVVAIFPSPMHYAGPTEVQWHAKARINAGANFYIVGRDPAGMGHPTEKRDLYDADHGKKVLSMAPGLERLNILPFKVAAYDTKHNKMNFFDPSRKEDFLFISGTKMRSLAKNRESPPDGFMCPGGWKVLVEYYDSLAPPEGSSKLREAVAA

SEQ ID NO: 10838 - protein, 434 aa, Secale cereale
RAVAARGVRCRAGGLIEPDGGRLVELVAPEEGGRRAALRREAAALPHRVRLGRVDTEWLHVLSEGWASPLRGFMRETEFLQALHFNAVRGGDGSLVNMSVPIVLALDDAQRRAIQASGATSVALVDAHDRPVAVLSDIEIYKHNKEERIARTWGTTARGLPYVEEAITNAGDWLIGGDLEVIEPIKYNDGLDQYRLSPAQLREEFARRNADAVFAFQLRNPVHNGHALLMTDTRRRLLEMGYKNPVLLLHPLGGFTKADDVPLSVRMKQHEKVLEEGVLNPESTVVAIFPSPMHYAGPTEVQWHAKARINAGANFYIVGRDPAGMGHPTEKRDLYDADHGKKVLSMAPGLERLNILPFKVAAYDTKHNKMNFFDPSRKEDFLFISGTKMRSLAKNRESPPDGFMCPGGWKVLVEYYDSLAPPEGSSKLREAVAA

SEQ ID NO: 10839 - protein, 238 aa, Triticum aestivum
MSRAATRIFPTPSLLPLPLPKWLRRRRPSICPARRAFAMAASGFGGGEAFRLSAAAGAGALKLHKGDITLWSVDGATDAIVNAANERMLGGGGVDGAIHQAAGPQLVQACREVPEVKPGVRCPTGEARITPAFELPVSCVIHTVGPIYDMDRKPEVSLKNAYENSLKVAKENGIQYVAFPAISCGIFRYPPKEASNIAISAAQQFSGDIKEVHFVLFSDELYNVWRGTAQEMLTQFEK

SEQ ID NO: 10840 - protein, 238 aa, Secale cereale
MSRAATRIFLTLSLLPLPLPKWLRRRQPSICPARRAFAMAASGFGGGEAFRLSAAAGGGALKLHKGDITLWSVDGATDAIVNAANERMLGGGGVDGAIHQAAGPQLVQACRKVPEVKPGVRCPTGEARITPAFELPVSRVIHTVGPIYDMDRKPEVSLKNAYENSLKVAKENGIQYVAFPAISCGIFRYPPKEASNIAVSAAQRFSGDIKEVHFVLFSDELYNVWRETAQEMLTQFEK

SEQ ID NO: 10841 - protein, 239 aa, Brachypodium distachyon
MSRAATRLFLTPSLLPIPLPKWLQRRRRASICTTRRSFAMAASGFGDGEAFRLSAAAGAGVLKLHKGDITLWSVDGATDAIVNAANERMLGGGGVDGAIHRAAGPQLVEACRKVPEVEPGVRCPTGEARITPAFKLPVSSVIHTVGPIYDMDRQPEVSLKNAYANSLKLAKENGIQYIAFPAISCGVFRYPLEEASKIAVSTAQQFSGDIKEVHFVLFSDELYNVWRQAAQEMLTQFEK

SEQ ID NO: 10842 - protein, 240 aa, Setaria italica
MSRAATRFFLTRSLLPLPLPKWQRRRGRLGSSILAARAFSMAASGFGGGDTFRLSAAPGAGALKLHKGDITLWTVDGATDAIVNAANERMLGGGGVDGAIHRAAGSELVEACRKVPEVKPGVRCPTGEARITPAFKLPVSRVIHTVGPIYDMDKHPEVSLKNAYENSLKLAKENGIQYIAFPAISCGIFRYPPEEASKIAVSTAQQFSDDIKEVHFVLFSDDLYEIWRKTAQEMLSQFEK

SEQ ID NO: 10843 - protein, 238 aa, Saccharum officinarum
MSRTATRFFLTRSLLPLPLLPPKWQRRRGSICATRAFAMAASVFGGGEAFRLSAAPGAGVLKLHKGDITLWSVDGATDAIVNAANERMLGGGGVDGAIHRAAGPELVQACRKVPEVKPGVRCPTGEARITPAFELPVSRVIHTVGPIYDMDKHPEVSLKKAYENSLKLAKDNGIQYIAFPAISCGVFRYPPKEASKIAVSTAQQFSEDIKEVHFVLFSDDLYNIWRETAQELLSQFEK

SEQ ID NO: 10844 - protein, 151 aa, Setaria italica
MSRAATRFFLTRSLLPLPLPKWQRRRGRLGSSILAARAFSMAASGFGGGDTFRLSAAPGAGALKLHKGDITLWTVDGATDAIVNAANERMLGGGGVDGAIHRAAGSELVEACRKVPEVKPGVRCPTGEARITPLSFQASCVPSDSHCWAHI

SEQ ID NO: 10845 - protein, 239 aa, Brachypodium distachyon
MSRAATRLFLTPSLLPIPLPKWLQRRRRASICTTRRSFAMAASGFGDGEAFRLSAAAGAGVLKLHEGDITLWSVDGATDAIVNAANERMLGGGGVDGAIHRAAGPQLVEACRKVPEVEPGVRCLTGEARITPAFKLPVSSVIHTVGPIYDMDRQPEVSLKNAYANSLKLAKENGIQYIAFPAISCGVFRYPLEEASKIAVSTAQQFSGDIKEVHFVLFSDELYNVWRQAAQEMLTQFEK

SEQ ID NO: 10846 - protein, 240 aa, Panicum virgatum
MSRAATRFFLTRSLLPLALPKSQRRRGRLGSSVCAARAFPMAASGFGGGEAFRLSAAPGAGALKLHKGDITLWSVNGATDAIVNAANERMLGGGGVDGAIHQAAGPELVQACRKVPEVRPGVRCPTGEARITPAFKLPVSRVIHTVGPIYDMDKHPEVSLKNSYENSLKLAKENGIQYIAFPAISCGVFRYPPKEASKIAVSTAQQFSEDFKEVHFVLFSDDLYEIWRETAQEMLSQFQK

SEQ ID NO: 10847 - protein, 238 aa, Pennisetum glaucum
MSRAATRFFLTRSLLPLPLPKWQRGRLGSSILAASASSMAASGFGGGDTFRLSAAPGAGALKLLKGDITLWSVDGATDAIVNAANERMLGGGGVDGAIHRAAGPELVEACRKVPEVKPGVRCPTGEARITPAFKLPVSRVIHTVGPIYDMDKHPEVSLKNAYENSLKLAKESGIQYIAFPAISCGVFRYPPKEASKIAVSTAQQFSEDIKEVHFVLFSDDLYDIWRETSQEMLSQFEK

SEQ ID NO: 10848 - protein, 238 aa, Sorghum bicolor
MSRASTRFFLTRSLLPLPLLPPKWQRRRGSIRATRAVAMAASGFGGGEAFRLSAAPGAGTLKLHKGDITLWSVDGATDAIVNAANERMLGGGGVDGAIHRAAGPELVQACRKVPEVKPGVRCPTGEARITPAFELPVSRVIHTVGPIYDMDKHPEVSLKKAYENSLKLAKDNGIQYIAFPAISCGVFRYPPKEASKVAVSTAQQFSEDIKEVHFVLFSDDLYNIWHETAQELLSQFQK

SEQ ID NO: 10849 - protein, 239 aa, Zea mays
MSRAATRFFLTRCLLPLPLLSPRWRQRRRGSICATRAFAMAASGFGGGEAFRLSAAPGAGLLKLHKGDITLWSVDCATDAIVNAANERMLGGGGVDGAIHQAAGPELVQACRKVPEVKPGVRCPTGEARITPAFELPASRVIHTVGPIYDLDKHPEVSLKKAYENSLKLAKDNGIQYIAFPAISCGVYRYPPKEASKIAVSTAQKFSEDIKEVHFVLFSDDLYNIWRETAQQLLSQFEK

SEQ ID NO: 10850 - protein, 238 aa, Sorghum bicolor
MSRASTRFFLTRSLLPLPLLPPKWQRRRGSIRATRAVAMAASGFGGSEAFRLSAAPGAGTLKLHKGDITLWSVDGATDAIVNAANERMLGGGGVDGAIHRAAGPELVQACRKVPEVKPGVRCPTGEARITPAFELPVSRVIHTVGPIYDMDKHPEVSLKKAYENSLKLAKDNGIQYIAFPAISCGVFRYPPKEASKVAVSTAQQFSEDIKEVHFVLFSDDLYNIWHETAQELLSQFQK

SEQ ID NO: 10851 - protein, 237 aa, Panicum virgatum
MSRAATRFFLTRSLLPLALPKSQGRPGSSICAARAFSMAASGFGGGEAFRLSAAPGAGALKLHKGDITLWSVNGATDAIVNAANERMLGGGGVDGAIHRAAGPELVQACRKVPEVRPEVRCPTGEARITPAFKLPVSRVIHTVGPIYDMDKHPEVSLKNAYENSLKLAKENGIQYIAFPAISCGVYRYPPKEASKIAVSTAQQFSEDIKEVHFVLFSDDLYEIWHETAQEMLSQFQK

SEQ ID NO: 10852 - protein, 245 aa, Oryza sativa
MSRAAARIFLTPSRLPLPLPLPLLPKRRRRRPPPSSGATRASFAMAAAPGRGGGEAFRLSADAGAGALKLQKGDITLWSVDGATDAIVNAANERMLGGGGVDGAIHRTAGPELVEACRKVPEVKSGVRCPTGEARITPAFKLPVSRVIHTVGPIYDMDKQPEVSLNNAYTNSLKLAKQNGIQYIALPAISCGVYRYPPKEASKIAVSTAQRFSNDIKEVHFVLFSDELYDIWRETAKEFLSQFEK

SEQ ID NO: 10853 - protein, 1951 aa, Cicer arietinum
MSSRAGPSESQGPPQRRITRTQTAGNLGEAIFDSEVVPSSLVEIAPILRVANEVEKTHPRVAYLCRFYAFEKAHRLDPTSSGRGVRQFKTALLQRLERENDPTLKGRVKKSDAREMQSFYQHYYKKYIQALQNAADKADRAQLTKAYQTANVLFEVLKAVNMTQSMEVDREILETQDKVAEKTEILVPYNILPLDPDSANQAIMRFPEIQAAVFALRSTRGLSWPKDYKKKKDEDILDWLGSMFGFQKHNVANQREHLILLLANVHIRQFPKPDQQPKLDERALTEVMKKLFKNYKKWCKYLGRKSSLWLPTIQQEVQQRKLLYMGLYLLIWGEAANLRFMPECLCYIYHHMAFELYGMLAGNVSPMTGENIKPAYGGEEEAFLRKVVTPIYNVIAKEAERSKRGRSKHSQWRNYDDINEYFWSVDCFRLGWPMRADADFFCLPVEQLYFDKLTDNKPANKDRWVGKANFVEIRSFWHIFRSFDRMWIFFILCLQAMIIVAWNGSGDPSAIFNGDVFKKALSVFITAAILKLGEAILDVILSWKAQRSMSMHVKLRYILKVVSAAAWVIVLSVTYAYTWDNPPGFAQTIQSWFGSNSHSPSMFIMAVVVYLSPNMLAAILFLFPLIRRFLERSNYRIVMLMMWWSQPRLYVGRGMHESTFSLFKYTVFWVLLLITKLAFSYYIEIKPLVEPTKAIMSVKITHFQWHEFFPRARNNIGVVIALWAPIILVYFMDTQIWYAIFSTLFGGIYGAFRRLGEIRTLGMLRSRFESLPGAFNACLIPEEKSEPRKKGLKATLSRRFDQIPSNKGKEAARFAQLWNQIITSFREEDLISNREMDLLLVPYWADPELDLIQWPPFLLASKIPIALDMAKDSNGKDRELRKRIEFDNYMYCAVRECYASFKSIIRYLVQGDREKQVIEYIFSEVDKHIEVGDLISEFKLSALPSLYGQFVELIKYLLDNKQEDRDQVVILFQDMLEVVTRDIMMEDHIFSLVDFVHGGSGHEGMLPLEQQHQLFASEGAIRFPIASVTEAWTEKIKRLYLLLTTKESAMDVPSNLEAKRRISFFSNSLFMDMPTAPKVRNMLSFSVLTPYYTEEVLFSLRELESPNEDGVSILFYLQKIFPDEWNNFLQRVNCYNEEELKEYDELEEELRRWASYRGQTLTRTVRGMMYYRKALELQAFLDMAKDEDLMEGYKAIENSDDNSKGERSLWTQCQAVADMKFSYVVSCQQYGIDKRSGAARAQDILRLMARYPSLRVAYIDEVEEPSKERPKKISKVYYSCLVKAMPKSSSSSEAEPEQCLDQVIYKIKLPGPAILGEGKPENQNHAIMFTRGEGLQTIDMNQDNYMEEALKMRNLLQEFLKKHDGVRYPSILGLREHIFTGSVSSLAWFMSNQETSFVTIGQRLLANPLKVRFHYGHPDVFDRIFHLTRGGVSKASKVINLSEDIFAGFNSTLREGNVTHHEYIQVGKGRDVGLNQISMFEAKIANGNGEQTLSRDVYRLGHRFDFFRMLSCYFTTIGFYFSTLITVVTVYVFLYGRLYLVLSGLEEGLSTQKAVRDNKPLQVALASQSFVQIGFLMALPMLMEIGLERGFRTALSEFILMQLQLAPVFFTFSLGTKTHYYGRTLLHGGAKYRPTGRGFVVFHAKFADNYRLYSRSHFVKGIELLTLLIVYQIFGHSYRSGVAYLLITIPMWFMVGTWLYAPFLFNPSGFEWQKIVDDWTDWNKWISIRGGIGVPPEKSWESWWEEEQEHLKYSGIRGTIAEILLSLRFFIYQYGLVYHLNFTKNTKSFLVYGISWLVIFLILFVMKTVSVGRRKFSANFQLVFRLMKGLIFVTFVSILVTMFALPHMTFQDIIVCILAFMPTGWGMLQIAQALKPLVRRAGFWESVKTLARGYEVIMGLLLFTPVAFLAWFPFVSEFQTRMLFNQAFSRGLQISRILGGQRKGRSSRNKE

SEQ ID NO: 10854 - protein, 1684 aa, Cajanus cajan
MAFELYGMLAGNVSPMTGENVKPAYGGEDEAFLRKVVTPIYNVIAKEAGRSKKGRSKHSQWRNYDDLNEYFWSGDCFRLGWPMRADADFFCLPTENQSFDKSNGRIRMSSTRSIMLRCAMADDPSISMQIVHSSIEIILTCILCSRVRKFMNKFPCMLFFCQEMIIYVIICWIEEFSPLPIKRDDKPPNRDRWVGKVNFVEIRSFWHIFRSFDRMWSFFILCLQAMIIVAWNGPGDPSVIFKGDVFKKVLSVFITAAILKLGQAVLDVILSWKAQRSMSLHVKLRYILKVVSAAAWVIVLSVTYAYTWDNPPGFAQTIKSWFGSGGSSAPSLFILAVVVYLSPNMLAAIFFLIPFIRRHLERSNYRIVMLMMWWSQPRLYVGRGMHESAFSLFKYTMFWVLLIITKLAFSYYIEIRPLVGPTKAIMSVKITTFQWHEFFPHARNNIGVVIALWAPIILVYFMDTQIWYAIFSTLFGGIYGAFRRLGEIRTLGMLRSRFQSLPGAFNASLIPEETKEPKKKGLKATLSRKFPEISSNKGKEAARFAQLWNQIITSFRDEDLISDREMDLLLVPYWADTQLDLIQWPPFLLASKIPIALDMAKDSNGKDRELKKRIVAENYMSCAVRECYASFKSIIIHLVQGERETPFIEYMFNLVDKHIQEDDVMSKFKMSALPGLYEKFVKLIEYLLANDPKDRDLVVILFQDMLEVVTRDMMEDQDTIFSWMDSSHGGTGLEGMLQLEPEPHHQLFASEGAIRFPIEPVTAAWTEKIKRLYLLLTTKESAMDVPSNLEARRRISFFSNSLFMDMPIAPKVRNMLSFSVLTPYYTEEVLFSLNDLDSPNEDGVSILFYLQKIFPDEWNNFRERVNYSEEDIKGCESDELVEELRLWASYRGQTLTKTVRGMMYYRKALELQAFLDMAKDEDLMEGYKAIENSDDNSSGERSLWTQCQAVADMKFTYVVSCQQYGIDKRSGSPRAQDILRLMTRYPSLRVAYIDEVEETVQDSKKKINKVYYSCLVKAMPKSSSSSEPEQNLDQIIYKIKLPGPAILGEGKPENQNHAIIFTRGEGLQTIDMNQDNYMEEALKMRNLLQEFLKKHDGVRFPSILGLREHIFTGSVSSLAWFMSNQETSFVTIGQRLLANPLKVRFHYGHPDVFDRLFHLTRGGVSKSSKVINLSEDIFAGFNSTLREGNVTHHEYIQVGKGRDVGLNQISMFEAKIANGNGEQTLSRDVYRLGHRFDFFRMLSCYFTTVGFYFSTLITVLTVYVFLYGRLYLVLSGLEEGLSTQKAIRDNKPLQVALASQSFVQIGVLMALPMLMEIGLERGFRTALSEFILMQLQLAPVFFTFSLGTKTHYFGRTLLHGGAKYRPTGRGFVVFHAKFADNYRLYSRSHFVKGIELMILLVVYQIFGHSYRSAVAYILITASMWFMVGTWLFAPFLFNPSGFEWQKIVDDWTDWNKWISNRGGIGVLPEKSWESWWEEEQEHLQYSGMRGIIVEILLSLRFFIYQYGLVYHLNITKKGEKSFLVYGVSWLVIFVILFVMKTVSVGRRKFSANFQLVFRLIKGMIFLTFVSILVILIALPHMTVQDIIVCILAFMPTGWGMLQIAQALKPVVRRAGFWGSVKTLARGYEIIMGLLLFTPVAFLAWFPFVSEFQTRMLFNQAFSRGLQISRILGGQRKERTSRNKE

SEQ ID NO: 10855 - protein, 1948 aa, Vitis vinifera
MASRSGSDQPQPQPQQRRITRTQTAGNLGESIFDSEVVPSSLVEIAPILRVANEVESSHPRVAYLCRFYAFEKAHRLDPTSSGRGVRQFKTALLQRLERENDPTLMGRVKKSDAREMQSFYQHYYKKYIQALQNAADKADRAQLTKAYQTANVLFEVLKAVNHTQAIEVDREILEAQNQVAEKTEIYVPYNILPLDPDSANQAIMRYPEIQAAVYALRNTRGLPWPRDYKKKNDEDILDWLQAMFGFQKDNVANQREHLILLLANVHIRQFPKPDQQPKLDERALTEVMKKLFKNYKKWCKYLDRKSSLWLPTIQQEVQQRKLLYMGLYLLIWGEAANLRFMPECLSYIYHHMAFELYGMLAGNVSPMTGEHVKPAYGGEEEAFLKKVVTPIYEVIAKEADRSKRGKSKHSQWRNYDDLNEYFWSVDCFRLGWPMRADADFFYLPIEETHNERNGDGKPTARDRWMGKVNFVEIRSFWHIFRSFDRMWSFFILCLQAMIIVAWNGSGEPSSIFSGDVFKKVLSVFITAAILKLGQAVLDVILSWKARESMSFYVKLRYILKVVLAAAWVIILPVTYAYTWENPPGFAQTIKSWFGNSSHSPSLFILAVVVYLSPNMLAAVLFLFPFIRRFLERSNYKIVMLMMWWSQPRLYVGRGMHESTFSLFKYTMFWVLLIITKLAFSYYIEIKPLVGPTKAIMSVKITNFQWHEFFPRAKNNIGVVVALWAPIILVYFMDTQIWYAIFSTLFGGIYGAFRRLGEIRTLGMLRSRFQSLPGAFNACLIPEEKSEPKKKGLKATFSRNFAQIPSNKEKEAARFAQLWNKIITSFRAEDLISDREMDLLLVPYWADRDLELIQWPPFLLASKIPIALDMAKDSNGKDKELKKRIENDNYMSCAVRECYASFRNIIKFLVRGDREKEVIECIFSEVDRHIEAGDLIREFKMSALPSLYDHFVKLIGYLLENKQEDRDQVVILFQDMLEVVTRDIMMEDNVSSLVDTGGPGYEGMTSLEQHSQLFASSGAIKFPILPSSEAWKEKIKRLYLLLTVKESAMDVPSNLEARRRISFFSNSLFMDMPIAPKVRNMLSFSVLTPYYTEEVLFSLHDLEVPNEDGVSILFYLQKIFPDEWNNFLERMGCNNEEELLEGDKLEELRLWASYRGQTLSKTVRGMMYYRKALELQAFLDMAKDEDLMEGYKAIELNTEDHSKGERTLWAQCQAVADMKFTYVVSCQKYGIHKRSGDHRAQDILKLMTTYPSLRVAYIDEVEEPSKDRKKINQKAYYSVLVKAAPPNINSSEPVQNLDQIIYKIKLPGPAILGEGKPENQNHAIIFTRGEGLQAIDMNQDNYMEEALKMRNLLQEFLTKHDGVRFPTILGLREHIFTGSVSSLAWFMSNQETSFVTIGQRLLANPLKVRFHYGHPDVFDRLFHLTRGGISKASKIINLSEDIFAGFNSTLREGNVTHHEYIQVGKGRDVGLNQISMFEAKIANGNGEQTLSRDIYRLGHRFDFFRMLSCYFTTIGFYFSTLITVLTVYIFLYGRLYLVLSGLEEGLSTQAAFRDNKPLQVALASQSFVQIGFLMALPMLMEIGLERGFRTALSEFILMQLQLAPVFFTFSLGTKTHYYGRTLLHGGAKYRPTGRGFVVFHAKFAENYRLYSRSHFVKGIELMILLLVYQIFGHTYRSAVAYVLITISMWFMVGTWLFAPFLFNPSGFEWQKIVDDWTDWNKWVSNRGGIGVTAEKSWESWWEEEQEHLRHSGKRGIIAEILLSLRFFIYQYGLVYHLNLTKNTKSFLVYGISWLVICIILFVMKTVSVGRRKFSANFQLMFRLIKGLIFLTFVSILVTLIALPHMTLQDIIVCILAFMPTGWGLLLIAQACKPVVERAGFWASVRTLARGYEIIMGLLLFTPVAFLAWFPFVSEFQTRMLFNQAFSRGLQISRILGGHRKDRSSRNKE

SEQ ID NO: 10856 - protein, 1952 aa, Populus trichocarpa
MDQAAGGPLATPPQTQRRLTRTQTAGNLGESIFDSEVVPSSLVEIAPILRVANEVESSNPRVAYLCRFYAFEKAHRLDPTSSGRGVRQFKTALLQRLERENDPTLMGRVKKSDAREMQSFYQHYYKKYIQALHNAADKADRAQLTKAYQTANVLFEVLKAVNTTQSIEVDREILEAQDKVAEKTQIYLPYNILPLDPDSANQAIMRYPEIQAAVVALRNTRGLPWPKDYKKKNDEDVLDWLQAMFGFQKDNVANQREHLILLLANVHIRQFPKPDQQPKLDERALTEVMKKLFKNYKKWCKYLDRKSSLWLPTIQQEVQQRKLLYMGLYLLIWGEAANLRFMPECICYIYHHMAFELYGMLAGNVSPMTGENVKPAYGGEEEAFLSKVVTPIYNMIAKEAERSKKGKSKHSQWRNYDDLNEYFWSVDCFRLGWPMRADADFFCLSDHHHFEKNGDNKPAYRDRWVGKVNFVEIRSFLHVFRSFDRMWSFFILCLQAMITVAWHGSGQPSVIFSGDVFKKVLSVFITAAILKLGQAILDVILNWKARQIMSFHVKLRFILKVVSAAAWVVVLPVTYAYTWDDKPPGFAQTIKGWFGNGFSSPSLFILAVVIYLAPNMLAAVLFLFPFIRRFLERSNYRIVMLMMWWSQPRLYVGRGMHESTISLFKYTMFWVLLIITKLTFSYYIEIRPLVVPTKAIMSVHITTFQWHEFFPRAKNNIGVVIALWAPIILVYFMDSQIWYAIFSTFFGGIYGAFRRLGEIRTLGMLRSRFQSLPGAFNACLIPGDKSEPKKKGFKATLSRKFAEIPSNKEKEAARFAQLWNKIISSFREEDLISNKEMDLLLVPYWADRDLDLIQWPPFLLASKIPIALDMAKDSNGKDKELKKRIEFDNYMSCAVRECYASFKNIILFLVQGKREKEVIDFIFSEVNIHIDGGDLISEYKMSALPFLYDHFVKLIKYLLANKPEDRDQVVILFQDMLEVVTRDIMMEDHISNLVDSIHGGSGHEGMTLHERQYQLFASSGAIKFPIEPVTEAWKEKIKRLFLLLTTKESAMDVPSNLEARRRISFFSNSLFMDMPTAPKVRNMLSFSVLTPYYTEDVLFSLLDLEVPNEDGVSILFYLQKIFPDEWNNFLERVDCSSEEELKGRDNLDEELRLWASYRGQTLTRTVRGMMYYRHALELQAFLDMAGDEDLMEGYKAIELSTDDQSKGGRSLLAQCQAVADMKFTYVVSCQKYGIHKRSGDPRAQDILRLMTTYPSLRVAYIDEVEETNPDRSKVIQKVYYSSLVKAALPKSIDSSEPVQNLDQVIYRIKLPGPAILGEGKPENQNHAIIFTRGEGLQTIDMNQDNYMEEALKMRNLLQEFLKKPDGVRNPSILGLREHIFTGSVSSLAWFMSNQETSFVTIGQRLLANPLKVRFHYGHPDVFDRLFHLTRGGVSKASKVINLSEDIFAGFNSTLREGNVTHHEYIQVGKGRDVGLNQISMFEAKIANGNGEQTLSRDIYRLGHRFDFFRMLSCYFTTVGFYFSTLITVLTVYVFLYGRLYLVLSGLEEGLSTQKAIRDNKPLQVALASQSFVQIGFLMALPMLMEIGLERGFRTALSEFILMQLQLAPVFFTFSLGTKTHYYGRTLLHGGAKYRPTGRGFVVFHAKFADNYRLYSRSHFVKGIEMMILLVVYQIFGQPYRSAVAYLLITISMWFMVGTWLFAPFLFNPSGFEWQKIVDDWTDWNKWISNRGGIGVPSEKSWESWWEEEQEHLRHSGKRGILAEILLSLRFFIYQYGLVYHLTITKKTKSFLVYGVSWLVIFLILFVMKTVSVGRRKFSANFQLAFRLIKGMIFLTFISILVTLIALPHMTVQDIFVCILAFMPTGWGMLLIAQACKPIVQRAGFWGSVQTLARGYEIVMGLLLFTPVAFLAWFPFVSEFQTRMLFNQAFSRGLQISRILGGPRKDRSSRNKE

SEQ ID NO: 10857 - protein, 1946 aa, Unknown
  Sequence found in Organisms: Citrus clementina, Citrus sinensis
MSSRGGGPDQPPPQRRIMRTQTAGNLGESMFDSEVVPSSLSEIAPILRVANEVESSNPRVAYLCRFYAFEKAHRLDPTSSGRGVRQFKTALLQRLERENAPTYMERGKKSDAREMQSFYQHYYKKYIQALQNAADKADRAQLTKAYQTANVLFEVLKAVNLTESMEVDREILEAQDKVAEKTQIYVPYNILPLDPDSANQAIMRYPEIQAAVLALRYTRGLPWPNEHNKKKDEDILDWLQEMFGFQKDNVANQREHLILLLANVHIRQFPKPDQQPKLDDRALTDVMKKLFKNYKRWCKYLDRKSSLWLPTIQQDVQQRKLLYMGLYLLIWGEAANLRFMPECLCYIYHHMAFELYGMLAGNVSPMTGENVKPAYGGEDEAFLRKVVTPIYEVIAREAERSKRGKSKHSQWRNYDDLNEYFWSVDCFRLGWPMRADADFFGLPIEQLRFEKSEDNKPANRDRWLGKVNFVEIRSFWHIFRSFDRMWSFFILCLQVMIIVAWNGSGNPSSIFEVDVFKKVLSVFITAAILKLGQAILDVILNWKARRSMSFHVKLRYILKVVSAAAWVIVLPVTYAYTWENPPGFAQTIKSWFGSTANSPSLFILAVVIYLSPNMLSAVLFLFPFIRRVLERSNYRIVMLIMWWSQPRLYVGRGMHESAFSLFKYTLFWVLLIITKLAFSYYIEIKPLVGPTKDIMRVRITDFQWHEFFPRAKNNIGVVIALWAPIILVYFMDAQIWYAIFSTIFGGIYGAFRRLGEIRTLGMLRSRFQSLPGAFNGCLIPEERSEPKKKGLRATLSRNFAEIPSNKEKEAARFAQLWNKVITSFREEDLISDREMNLLLVPYWADRDLGLIQWPPFLLASKIPIALDMAKDSNGKDRELKKRIEADDYMSCAVKECYASFRNIIKFLVQGNEKRVIDDIFSEVDRHIEAGNLISEYKMSSLPSLYDHFVKLIKYLLDNKQEDRDQVVILFQDMLEVVTRDIMMEDHISSLVESVHGGSGHEGLVPLEQRYQLFASSGAIRFPAPETEAWKEKIKRLYLLLTTKESAMDVPSNLEARRRISFFSNSLFMDMPEAPKVRNMLSFSVLTPYYTEEVLFSLRDLEIHNEDGVSILFYLQKIFPDEWTNFLERVKCNNEEELKGSDELEEELRLWASYRGQTLTRTVRGMMYYRKALELQAFLDMAKHEDLMEGYKAIELNSDDKGERSLLTQCQAVADMKFTYVVSCQLYGIHKRSGDARAQDILKLMTKYPSLRVAYIDEVEEPSKDRSKKINQKVYYSALVKAVPKSKDSSIPVQNLDQVIYRIKLPGPAILGEGKPENQNHAIIFTRGEGLQTIDMNQDNYMEEALKMRNLLQEFLKKHDGVRYPSILGLREHIFTGSVSSLAWFMSNQETSFVTIGQRLLANPLKVRFHYGHPDVFDRLFHLTRGGVSKASKIINLSEDIFAGFNSTLREGNVTHHEYIQVGKGRDVGLNQISMFEAKIANGNGEQTLSRDLYRLGHRFDFFRMLSCYFTTIGFYFSTLITVLTVYVFLYGRLYLVLSGLEEGLITQPAIRDNKPLQVALASQSFVQLGFMMSLPMLMEIGLERGFRTALSEFILMQLQLAPVFFTFSLGTKTHYYGRTLLHGGAKYRSTGRGFVVFHAKFADNYRLYSRSHFVKGIEMMILLIVYQIFGQSYRGAVAYILITISMWFMVGTWLFAPFLFNPSGFEWQKIVDDWTDWNKWISNRGGIGVPPEKSWESWWEEEQEHLQHSGKRGIIAEIVLALRFFIYQYGLVYHLKMTKHTKSFLVYGVSWLVIFLVLFVMKTVSVGRRKFSANFQLVFRLIKGLIFLTFISILVTLIALPHMTVRDIIVCILAFMPTGWGMLLIAQALKPVIHRAGFWGSVRTLARGYEIVMGLLLFTPVAFLAWFPFVSEFQTRMLFNQAFSRGLQISRILGGQRKDRSSRNKE

SEQ ID NO: 10858 - protein, 1954 aa, Fragaria vesca
MSSSRAGADQPPQPQRRIQRTQTAGNLGETAFDSEVVPSSLVEIAPILRVANEVESHNPRVAYLCRFYAFEKAHRLDPTSSGRGVRQFKTALLQRLERENDPTLMGRVKKSDAREMQSFYQHYYKKYIQALQNAADKADRAQLTKAYQTANVLFEVLKAVNMTQSMEVDREILEAHGKVAEKTELLVPYNILPLDPDSVNQAIMKYPEIQAAVLALRNTRGLPWPKEYKKRKDEDVLDWLQSMFGFQKDNVANQREHLILLLANVHIRQFPKPDQQPKLDDRALTEVMKKLFKNYKKWCKYLGRKSSLWLPTIQQEVQQRKLLYMGLYLLIWGEAANLRFMPECLCYIYHHMAFELYGMLAGNVSPMTGENVKPAYGGEEEAFLKKVVTPIYKVIAEEAERSKRGKSKHSQWRNYDDINEYFWSVDCFRLGWPMRADADFFCMPSEQHYFDKSSEDHKPAGGDRWVGKVNFVEIRSFWHIFRSFDRMWSFFILCLQVMIIVAWNGSGQPTSIFSADVFKKALSVFITAAILKLGQAVLDVILSWKSRRSMSFHVKLRYIAKVISAAAWVIILPVTYAYTWENPPGFAQTIKGWFGNNSNSPSLFILAVVIYLSPNMLAGVLFLFPFIRRFLERSNYRIVMLMMWWSQPRLYVGRGMHEGTFSLFKYTMFWVLLIVTKLAFSYYIEIKPLVGPTKAIMKVRITNFQWHEFFPRAKNNIGVVIALWAPIILVYFMDTQIWYAIYSTIFGGIYGAFRRLGEIRTLGMLRSRFESLPGAFNARLIPVDKSEPKKKGLKATLSRTFGQVEGSKEKQAARFAQLWNKIISSFREEDLINNREMNLLLVPYWADRDLDLIQWPPFLLASKIPIALDMAKDSNGKDKELTKRILADEYMHCAVRECYASFRNIIKFLVQGNREKEVIEYIFSEVDKHIAEGTLIREFKMSALPSLYDHFVRLIDFLSKNNQDDRDQVVILFQDMLEVVTRDIMMEDHISSLVDSVHGGSGHEGMIPLDQHQQHQLFASAGAIKFPLTQVTEAWKEKINRLYLLLTTKESAMDVPSNLEARRRISFFSNSLFMDMPPAPKVRNMLSFSVLTPYYTEEVLFSIEGLERPNEDGVSILFYLQKIFPDEWTNFLLRVNCSSEDELKGSDELEEELRLWASYRGQTLTRTVRGMMYYRKALELQAFLDMAKDEDLMEGYKAIELNSEDQSKEGRSLWAQCQAVADMKFTYVVSCQLYGIQKRSGDYRAQDILRLMTTYPSLRVAYIDEVEEPSKDRSQKINQKAYYSTLVKAAMPKSIDSSEPVQNLDQVIYRIKLPGPAILGEGKPENQNHAIIFTRGEGLQTIDMNQDNYMEEALKMRNLLQEFLKHDGVRHPTILGLREHIFTGSVSSLAWFMSNQENSFVTIGQRLLANPLKVRFHYGHPDVFDRLFHLSRGGVSKASKVINLSEDIFAGFNSTLREGNVTHHEYIQVGKGRDVGLNQISMFEAKIANGNGEQTLSRDIYRLGHRFDFFRMLSCYFTTIGFYYSTLITVLTVYVFLYGRLYLVLSGLEEGLNTQEAIRDNKPLQVALASQSFVQIGFLMALPMLMEIGLEKGFRTALSEFILMQLQLAPVFFTFSLGTKTHYYGRTLLHGGAKYRSTGRGFVVFHAKFADNYRLYSRSHFVKGIELLILLVVYQIFGHTYRSAVAYILITVSMWFMVVTWLFAPFLFNPSGFEWQKIVDDWTDWNKWISNRGGIGVPPEKSWESWWEEEQEHLRYSGKRGIVAEILLSLRFFIYQYGLVYHLNIAKKTKSVLVYGISWLVIVLILFVMKTVSVGRRKFSAEYQLVFRLIKGLIFVTFVAILVTLIVLPHMTLQDIIVCILAFMPTGWGMLMIAQACKPLVQKAGLWPSVRTLARGFEIVMGLLLFTPVAFLAWFPFVSEFQTRMLFNQAFSRGLQISRILGGQRKDRSTRNKE

SEQ ID NO: 10859 - protein, 1954 aa, Eutrema halophilum
MSASRGGPDQGPSQPQQRRIIRTQTAGNLGESFDSEVVPSSLVEIAPILRVANEVESSNPRVAYLCRFYAFEKAHRLDPTSSGRGVRQFKTALLQRLEREHDPTLMGRVKKSDAREMQSFYQHYYKKYIQALQNAADKADRAQLTKAYQTANVLFEVLKAVNLTQSIEVDREILEAQDKVAEKTQLYVPYNILPLDPDSANQAIMRYPEIQAAVLALRNTRGLPWPEGHKKKKDEDMLDWLQEMFGFQKDNVANQREHLILLLANVHIRQFPKPDQQPKLDDQALTEVMKKLFKNYKKWCKYLGRKSSLWLPTIQQEMQQRKLLYMALYLLIWGEAANLRFMPECLCYIYHHMAFELYGMLAGNVSPMTGENVKPAYGGEEDAFLRKVVTPIYEVIGMEAQRSKKGKSKHSQWRNYDDLNEYFWSVDCFRLGWPMRADADFFYPPVAELNTEKEGDNSKPAVARDRWVGKVNFVEIRSFWHVFRSFDRMWSFYILCLQAMIIMAWDGGEPSSVFGADVFKKVLSVFITAAIMKLGQASLDVILNFKAHRSMSLHVKLRYILKVLSAAAWVIILPVTYAYSWKDPPAFARTIKSWFGSAMHSPSLFIIAVVFYLSPNMLAGVLFLFPLLRRFLERSNYRIVMLMMWWSQPRLYVGRGMHESAFSLLKYTMFWVSLIATKLAFSYYIEIKPLVAPTQAIMKARVTNFQWHEFFPRAKNNIGVVIALWAPIILVYFMDSQIWYAIFSTLFGGIYGAFRRLGEIRTLGMLRSRFESLPGAFNDRLIPDGKNQERKKGLRATLSHNFTEDKVPVNKEKEAARFAQLWNTIISSFREEDLISDREMDLLLVPYWADRDLDLIQWPPFLLASKIPIALDMAKDSNGKDRELKKRIESDSYMKCAVRECYASFKNIIKFLVQGNREKEVIEIIFSEVDKHIEAGHLIQECKMSALPSLYDHFVKLIKYLLDNKVEDRDHVVILFQDMLEVVTRDIMMEDYNISSLVDSSHGGTWHGGMIPLEQQYQLFASSGAIRFPIEPVTEAWKEKIKRLYLLLTTKESAMDVPSNLEARRRISFFSNSLFMDMPTAPKVRNMLSFSVLTPYYTEEVLFSLRDLETPNEDGVSILFYLQKIFPDEWNNFLERVKCVSEEELKDFDELEEELRLWASYRGQTLTRTVRGMMYYRKALELQAFLDMAMHEDLMEGYKAVELNSENNSRGERSLWAQCQAVADMKFTYVVSCQQYGIHKRSGDPRAQDILRLMTRYPSLRVAYIDEVEEPVKDKSKKGNQKVYYSVLVKVPKSTESSLAQNLDQVIYRIKLPGPAILGEGKPENQNHAIIFSRGEGLQTIDMNQDNYMEEALKMRNLLQEFLTKHDGVRHPSILGLREHIFTGSVSSLAWFMSNQETSFVTIGQRLLANPLRVRFHYGHPDVFDRLFHLTRGGVSKASKVINLSEDIFAGFNSTLREGNVTHHEYIQVGKGRDVGLNQISMFEAKIANGNGEQTLSRDIYRLGHRFDFFRMMSCYFTTVGFYFSTLITVLTVYIFLYGRLYLVLSGLEQGLSTQKGIRDNTPLQIALASQSFVQIGFLMALPMLMEIGLERGFRTALSEFVLMQLQLAPVFFTFSLGTKTHYYGRTLLHGGAKYRSTGRGFVVFHAKFADNYRLYSRSHFVKGLEMMLLLVVYQIFGSAYRGVLAYLLITISMWFMVGTWLFAPFLFNPSGFEWQKIVDDWTDWNKWINNIGGIGVPAEKSWESWWEEEQEHLRYSGKRGIIVEILLSLRFFIYQYGLVYHLTITENTKNFLVYGVSWLVIFLILFVMKTVSVGRRKFSASFQLMFRLIKGLIFMTFIAIIVILITLAHMTIQDIIVCILAFMPTGWGMLLIAQACKPLVHRLGFWGSVRTLARGYEIVMGLLLFTPVAFLAWFPFVSEFQTRMLFNQAFSRGLQISRILGGHRKDRSSRNKE

SEQ ID NO: 10860 - protein, 1955 aa, Arabidopsis lyrata
MSATRGGPEQGPSQPQQRRIVRTQTAGNLGESFDSEVVPSSLVEIAPILRVANEVESSNPRVAYLCRFYAFEKAHRLDPTSSGRGVRQFKTALLQRLEREHDPTLMGRVKKSDAREMQSFYQHYYKKYIQALHNAADKADRAQLTKAYQTANVLFEVLKAVNLTQSIEVDREILEAQDKVAEKTQLYVPYNILPLDPDSANQAIMRYPEIQAAVLALRNTRGLPWPEGHKKKKDEDMLDWLQEMFGFQKDNVANQREHLILLLANVHIRQFPKPDQQPKLDDQALTEVMKKLFKNYKKWCKYLGRKSSLWLPTIQQEMQQRKLLYMALYLLIWGEAANLRFMPECLCYIYHHMAFELYGMLAGNVSPMTGENVKPAYGGEEDAFLRKVVTPIYEVIQMEAQRSKKGKSKHSQWRNYDDLNEYFWSVDCFRLGWPMRADADFFCLPVAVPNTEKDGDNSKPTVARDRWVGKVNFVEIRSFWHVFRSFDRMWSFYILCLQAMIIMAWDGGQPSSVFGADVFKKVLSVFITAAIMKLGQAVLDVILNFKAHQSMTLHVKLRYILKVLSAAAWVIILPVTYAYSWKDPPAFARTIKSWFGNAMHSPSLFIIAVVFYLSPNMLAGVMFLFPLLRRFLERSNYRIVMLMMWWSQPRLYVGRGMHESAFSLFKYTMFWVLLIATKLAFSYYIEIKPLVAPTQAIMKARVTNFQWHEFFPRAKNNIGVVIALWAPIILVYFMDSQIWYAIFSTLFGGIYGAFRRLGEIRTLGMLRSRFESLPGAFNDRLIPDGKNQQKKKGIRATLSHNFTEDKVPVNKEKEAARFAQLWNTIISSFREEDLISDREMDLLLVPYWADRDLDLIQWPPFLLASKIPIALDMAKDSNGKDRELKKRIESDTYMKCAVRECYASFKNIIKFVVQGNREKEVIEIIFAEVDKHIDTGDLIQEYKMSALPSLYDHFVKLIKYLLDNKEEDRDHVVILFQDMLEVVTRDIMMEDYNISSLVDSSHGGTWHGGMIPLEQQYQLFASSGAIRFPIEPVTEAWKEKIKRIYLLLTTKESAMDVPSNLEARRRISFFSNSLFMDMPMAPKVRNMLSFSVLTPYYTEEVLFSLRDLETPNEDGVSILFYLQKIFPDEWNNFLERVKCLSEEELKESDELEEELRLWASYRGQTLTRTVRGMMYYRKALELQAFLDMAMHEDLMEGYKAVELNSENNSRGERSLWAQCQAVADMKFTYVVSCQQYGIHKRSGDPRAQDILRLMTRYPSLRVAYIDEVEEPVKDKSKKGNQKVYYSVLVKVPKSTDHSSLAQNLDQVIYRIRLPGPAILGEGKPENQNHAIIFSRGEGLQTIDMNQDNYMEEALKMRNLLQEFLTKHDGVRHPSILGLREHIFTGSVSSLAWFMSNQETSFVTIGQRLLANPLRVRFHYGHPDVFDRLFHLTRGGVSKASKVINLSEDIFAGFNSTLREGNVTHHEYIQVGKGRDVGLNQISMFEAKIANGNGEQTLSRDIYRLGHRFDFFRMMSCYFTTVGFYFSTLITVLTVYIFLYGRLYLVLSGLEQGLSTQKGIRDNTPLQIALASQSFVQIGFLMALPMLMEIGLERGFRTALSEFVLMQLQLAPVFFTFSLGTKTHYYGRTLLHGGAKYRSTGRGFVVFHAKFADNYRLYSRSHFVKGLEMMLLLVVYQIFGSAYRGVLAYLLITISMWFMVGTWLFAPFLFNPSGFEWQKIVDDWTDWNKWINNIGGIGVPAEKSWESWWEEEQEHLRYSGKRGIVVEILLALRFFIYQYGLVYHLTITERTKNFLVYGVSWLVIFLILFVMKTVSVGRRRFSASFQLMFRLIKGLIFMTFIAIIVILITLAHMTIQDIIVCILAFMPTGWGMLLIAQACKPVVHRAGFWGSVRTLARGYEIVMGLLLFTPVAFLAWFPFVSEFQTRMLFNQAFSRGLQISRILGGHRKDRSSRNKE

SEQ ID NO: 10861 - protein, 1955 aa, Arabidopsis thaliana
MSATRGGPDQGPSQPQQRRIIRTQTAGNLGESFDSEVVPSSLVEIAPILRVANEVESSNPRVAYLCRFYAFEKAHRLDPTSSGRGVRQFKTALLQRLEREHDPTLMGRVKKSDAREMQSFYQHYYKKYIQALHNAADKADRAQLTKAYQTANVLFEVLKAVNLTQSIEVDREILEAQDKVAEKTQLYVPYNILPLDPDSANQAIMRYPEIQAAVLALRNTRGLPWPEGHKKKKDEDMLDWLQEMFGFQKDNVANQREHLILLLANVHIRQFPKPDQQPKLDDQALTEVMKKLFKNYKKWCKYLGRKSSLWLPTIQQEMQQRKLLYMALYLLIWGEAANLRFMPECLCYIYHHMAFELYGMLAGNVSPMTGENVKPAYGGEEDAFLRKVVTPIYEVIQMEAQRSKKGKSKHSQWRNYDDLNEYFWSVDCFRLGWPMRADADFFCLPVAVPNTEKDGDNSKPIVARDRWVGKVNFVEIRSFWHVFRSFDRMWSFYILCLQAMIIMAWDGGQPSSVFGADVFKKVLSVFITAAIMKLGQAVLDVILNFKAHQSMTLHVKLRYILKVFSAAAWVIILPVTYAYSWKDPPAFARTIKSWFGSAMHSPSLFIIAVVSYLSPNMLAGVMFLFPLLRRFLERSNYRIVMLMMWWSQPRLYVGRGMHESAFSLFKYTMFWVLLIATKLAFSYYIEIRPLVAPTQAIMKARVTNFQWHEFFPRAKNNIGVVIALWAPIILVYFMDSQIWYAIFSTLFGGIYGAFRRLGEIRTLGMLRSRFESLPGAFNDRLIPDGKNQQKKKGIRATLSHNFTEDKVPVNKEKEAARFAQLWNTIISSFREEDLISDREMDLLLVPYWADRDLDLIQWPPFLLASKIPIALDMAKDSNGKDRELKKRIESDTYMKCAVRECYASFKNIIKFVVQGNREKEVIEIIFAEVDKHIDTGDLIQEYKMSALPSLYDHFVKLIKYLLDNKEEDRDHVVILFQDMLEVVTRDIMMEDYNISSLVDSSHGGTWHGGMIPLEQQYQLFASSGAIRFPIEPVTEAWKEKIKRIYLLLTTKESAMDVPSNLEARRRISFFSNSLFMDMPMAPKVRNMLSFSVLTPYYTEEVLFSLRDLETPNEDGVSILFYLQKIFPDEWNNFLERVKCLSEEELKESDELEEELRLWASYRGQTLTRTVRGMMYYRKALELQAFLDMAMHEDLMEGYKAVELNSENNSRGERSLWAQCQAVADMKFTYVVSCQQYGIHKRSGDPRAQDILRLMTRYPSLRVAYIDEVEEPVKDKSKKGNQKVYYSVLVKVPKSTDHSTLAQNLDQVIYRIRLPGPAILGEGKPENQNHAIIFSRGEGLQTIDMNQDNYMEEALKMRNLLQEFLTKHDGVRHPSILGLREHIFTGSVSSLAWFMSNQETSFVTIGQRLLANPLRVRFHYGHPDVFDRLFHLTRGGVSKASKVINLSEDIFAGFNSTLREGNVTHHEYIQVGKGRDVGLNQISMFEAKIANGNGEQTLSRDIYRLGHRFDFFRMMSCYFTTVGFYFSTLITVLTVYIFLYGRLYLVLSGLEQGLSTQKGIRDNTPLQIALASQSFVQIGFLMALPMLMEIGLERGFRTALSEFVLMQLQLAPVFFTFSLGTKTHYYGRTLLHGGAKYRSTGRGFVVFHAKFADNYRLYSRSHFVKGLEMMLLLVVYQIFGSAYRGVLAYLLITISMWFMVGTWLFAPFLFNPSGFEWQKIVDDWTDWNKWINNIGGIGVPAEKSWESWWEEEQEHLRYSGKRGIVVEILLALRFFIYQYGLVYHLTITEKTKNFLVYGVSWLVIFLILFVMKTVSVGRRRFSASFQLMFRLIKGLIFMTFIAIIVILITLAHMTIQDIIVCILAFMPTGWGMLLIAQACKPVVHRAGFWGSVRTLARGYEIVMGLLLFTPVAFLAWFPFVSEFQTRMLFNQAFSRGLQISRILGGHRKDRSSRNKE

SEQ ID NO: 10862 - protein, 1974 aa, Populus trichocarpa
MASTSRGGGGGGGMGMDQAAAGVGTGATPPPTQRRITRTQTAGNLGESVFDSEIVPSSLFEIAPILRVANEVETSNPRVAYLCRFYAFEKAHRLDPTSSGRGVRQFKTALLQRLERENDPTLMGRVKKSDAREMQGFYQHYYKKYIQALHNAADKADRAQLTKAYQTANVLFEVLKAVNMTQSIEVDREILEAQDEVAEKTQIYLPYNILPLDPDSADQAIMRYPEIQAAVLALRNTRGLPWPKDYKKKTDEDVLDWLQAMFGFQKDNVANQREHLILLLANVHMRQFVKPDQQPKLDERALTEVMKKLFKNYKKWCKYLDRKSSLWLPTIQQEVQQRKLLYMGLYLLIWGEAANLRFMPECLCYIYHHMAFELYGMLAGNVSPMTGENVKPAYGGEEEAFLRKVVTPIYNVIAKEAERSKKGKSKHSQWRNYDDINEYFWSVDCFRLGWPMRADADFFCLSSEQLRFVQNGDDKPAYRDRWVGKVNFVEIRTFWHVFRSFDRMWSFFILCLQAMIIVAWNGSGKLSAIFSGDVFKKVLSVFITAAILKLGQAILDVILSWKARQIMSFHVKLRYILKVVSAAAWVVVLPVTYAYTWKENPPGFAQTIKGWFGNSSSSSSLFVLAVVIYLAPNMLAALLFLFPFIRRFLERSDYRIVMFMMWWSQPRLYVGRGMHESTISLFKYTMFWVLLIVTKLAFSYYIEIKPLVDPTKAIMDVHITAFQWHEFFPQAKNNIGVVIALWAPIILVYFMDAQIWYAIFSTLFGGIYGAFRRLGEIRTLGMLRSRFQSLPGAFNACLIPDEKSERKKKSLKARFSRNFNENPPNKDTEAPRFAQLWNKIISSFREEDLISNREMDLLLVPYWADRDLGVLGLTQWPPFLLASKIPIALDMAKDSNGKDKELKKRIEADNYMSCAVCECYASFKNIIKFLVQGRPETEVIDSIFVDVENHIKQGDLIKDYKMSALPLLYDHLVKLIKCLVDNRPEDRDQVVILFQDMLEVVTRDIMEDQISSLVDSIPDGSGYEGMKPLEQQYQLFASAGAIKFPIEPETEAWKEKIKRLYLLLTTKESAMDVPSNLEARRRISFFSNSLFMDMPAAPKVRNMLSFSVLTPYYTEEVLFSLHDLEEPNEDGVSILFYLQKIFPDEWNHFLERVNCTGEEELKERDDLEELRLWASYRGQTLTRTVRGMMYYRHALELQAFLDIAKHEDLMEGYKAIELNTEDQSKGGSSLLAECQAVADMKFTYVVSCQQYGIHKRSGDLRAQDILRLMTTYPSLRVAYIDEVEETNPDKSKKVIQKVYYSSLVKAALPKSIDSSEPVQNLDQVIYRIKLPGPAILGEGKPENQNHAIIFTRGEGLQTIDMNQDNYMEEALKMRNLLQEFLKKPDGVRHPSILGLREHIFTGSVSSLAWFMSNQETSFVTIGQRLLANPLKVRFHYGHPDVFDRLFHLTRGGVSKASKVINLSEDIFAGFNSTLREGNVTHHEYIQVGKGRDVGLNQISMFEAKIANGNGEQTLSRDIYRLGHRFDFFRMLSCYFTTVGFYFSTLITVLTVYVFLYGRLYLVLSGLEEGLSTQKAIRDNKPLQVALASQSFVQIGFLMALPMLMEIGLERGFRTALSEFLLMQLQLAPVFFTFSLGTKTHYYGRTLLHGGAKYRSTGRGFVVFHAKFADNYRLYSRSHFVKGIEMMILLVVYQIFGQPYRSAVAYVLITISMWFMVGTWLFAPFLFNPSGFEWQKIVDDWSDWNKWISNRGGIGVPPEKSWESWWEEEQEHLHHSGKRGIVAEILLSLRFFIYQYGLVYHLTITKKMKDRSFLIYGISWLVILLILFVMKTVSVGRRKFSANFQLVFRLIKGMIFLTFVSILVTLIALPHMTVQDVIVCILAFMPTGWGMLLIAQACKPVVQRAGFWGSVRTLARGYEIVMGLLLFTPVAFLAWFPFVSEFQTRMLFNQAFSRGLQISRILGGHRKDRSSRNKE

SEQ ID NO: 10863 - protein, 1953 aa, Brassica rapa
MSASRGGPDQGPSQPQQRRIVRTQTAGNLGESFDSEVVPSSLVEIAPILRVANEVESSNPRVAYLCRFYAFEKAHRLDPTSSGRGVRQFKTALLQRLEREHDPTLMGRVKKSDAREMQSFYQHYYKKYIQALQNAADKADRAQLTKAYQTANVLFEVLKAVNLTQSIEVDREILEAQDKVAEKTQLYVHYNILPLDPDSANQAIMRYPEIQAAVLGLRNTRGLPWPEGHKKKKDEDMLDWLQEMFGFQKDNVANQREHLILLLANVHIRQFPKPDQQPKLDDQALTDVMKKLFKNYKKWCKYLGRKSSLWLPTIQQEMQQRKLLYMALYLLIWGEAANLRFMPECLCYIYHHMAFELYGMLAGNVSPMTGENVKPAYGGEEDAFLRKVVTPIYEVIAMESQRSKKGKSKHSQWRNYDDLNEYFWSVDCFRLGWPMRADADFFYPHVDQPNTEKDGDNSKPAVARDRWVGKVNFVEIRSFWHVFRSFDRMWSFYILCLQAMIIMAWDGGQPSSVFGADVIKKVLSVFITAAIMKLGQASLDVILSFKAHRSMSLHVKLRYILKVLSAAAWVIILPVTYAYSWEDPPGFARTIKSWFGSAMHSPSLFIIAVVFYLAPNMLAGVFFLFPMLRRFLERSNYRIVMLMMWWSQPRLYVGRGMHESAFSLFKYTMFWVLLIATKLTFSYYIEIKPLVAPTQAIMRARVTDFQWHEFFPRAKNNIGVVIALWAPIILVYFMDSQIWYAIFSTIFGGIYGAFRRLGEIRTLGMLRSRFESLPGAFNDRLIPDGKNQQRKKGLRATLSHNFTEDKVPVNKEKEAARFAQLWNTIISSFREEDLISDREMDLLLVPYWADRDLDLIQWPPFLLASKIPIALDMAKDSNGKDRELKKRIESDSYMKCAVRECYASFKNVIKFLVQGNREKEVIEFIFAEVDEHIEKGDLIQVYKMSCLPSLYDHFVKLIKYLLDNNVDDRDHVVILFQDMLEVVTRDIMMEDSISSLVDSSHGGTWHGGMVPLEQQYQLFASSGAIRFPIEPVTEAWKEKIKRLYLLLTTKESAMDVPSNLEARRRISFFSNSLFMDMPAAPKVRNMLSFSVLTPYYTEEVLFSMHDLDTPNEDGVSILFYLQKIFPDEWNNFLERVKSNEEEIKESVELEEELRLWASYRGQTLTRTVRGMMYYRKALELQAFLDMAMHEDLMEGYKAVELNSENNSRGERSLWAQCQAVADMKFTYVVSCQQYGIHKRSGDPRAQDILRLMTRYPSLRVAYIDEVEEPVKDKSKKGNEKVYYSVLVKVPKSTDHSSLAQNLDQVIYRIKLPGPAILGEGKPENQNHAIIFSRGEGLQTIDMNQDNYMEEALKMRNLLQEFLTKHDGVRHPSILGLREHIFTGSVSSLAWFMSNQETSFVTIGQRLLANPLRVRFHYGHPDVFDRLFHLTRGGVSKASKVINLSEDIFAGFNSTLREGNVTHHEYIQVGKGRDVGLNQISMFEAKIANGNGEQTLSRDIYRLGHRFDFFRMMSCYFTTVGFYFSTLITVLTVYIFLYGRLYLVLSGLEQGLSTQKGIRDNTPLQIALASQSFVQIGFLMALPMLMEIGLERGFRTALSEFVLMQLQLAPVFFTFSLGTKTHYYGRTLLHGGAKYRSTGRGFVVFHAKFADNYRLYSRSHFVKGLEMMLLLVVYQIFGSAYRGVVAYLLITISMWFMVGTWLFAPFLFNPSGFEWQKIVDDWTDWNKWINNIGGIGVPAEKSWESWWEEEQEHLRHSGKRGIVVEILLSLRFFIYQYGLVYHLTITEKTKNFLVYGVSWLVIFLILFVMKTVSVGRRKFSASFQLMFRLIKGLIFLTFIAIIVILITLAHMTIQDIIVCILAFMPTGWGMLLIAQACKPVVHRAGFWGSVRTLARGYEIVMGLLLFTPVAFLAWFPFVSEFQTRMLFNQAFSRGLQISRILGGHRKDRSSRNKE

SEQ ID NO: 10864 - protein, 1948 aa, Mimulus guttatus
MSSRGVPSQQNPQLQRRITRTQTVGNLGESIFDSEVVPSSLVEIAPILRVANEVEPSNPRVAYLCRFYAFEKAHRLDPTSSGRGVRQFKTALLQRLERENDPTLMGRVKKSDAREMQSFYQHYYKKYIQALQNAADKADRAQLTKAYQTANVLFEVLKAVNQTQSVEVDREVLETHDKVAEKTEIYVPYNILPLDPDSANQAIMKYPEVQAAVHALRITRGLPWPKDYKKKKDEDILDWLQAMFGFQKDSVANQREHLILLLANVHIRQFPKPDQQPKLDERALDEVMKKLFKNYKKWCKYLDRKSSLWLPTIQQEVQQRKLLYMGLYLLIWGEAANLRFMPECLCYIYHHMAFELYGMLAGNVSPMTGENVKPAYGGEEEAFLKKVVKPIYEVIAQEAARSKTAKSKHSQWRNYDDLNEYFWSVDCFRLGWPMRADADFFCRPADPLPGERNGDNRPRRDRWVGKVDFVEIRSYWHIFRSFDRMWSFFILCLQAMIIIAWNGGQPSSAFNSNVFKKVLSIFITAAILKLGQAVLDVILSWKARQSMSFHVKLRYVLKVVAAAGWVVVLPVTYAYTWENPPGFAQTIKSWFGNSSSSPSLFILAIVLYLSPNMLGVLLFLFPFIRRFLESSNYKIVMLAMWWSQPRLYVGRGMHESTFSLFKYTLFWMLLIITKLAFSFYVEIKPLVGPTKAIMQVRISTYQWHEFFPQAKNNIGVVIALWAPVILVYFMDSQIWYAIFSTLFGGIYGAFRRLGEIRTLGMLRSRFQSLPGAFNGCLIPEERTEPVKKKGLKATFSRKFEVIPSSKEKEAARFAQLWNKIITSFREEDIISNREMDLLLVPYWADRELELMQWPPFLLASKIPIAVDMAKDSSNGKDGELKKRIKSDDYMYSAVCECYASFRNIIKLLVRGKQEKEVIEYIFSEVDKHIEEDDLLSEYKLNALPSLYDLFVKLVKYLLENKPEDRDQVVILFQDMLEVVTRDIMMEDHVSNLLDSIHGGSGHEGMVPLDQQYQLFASAGAIKFPAPESEAWKEKIKRLYLLLTVKESAMDVPSNLEARRRMSFFSNSLFMDMPLAPKVRNMLSFSVLTPYYTEEVLFSLPVLEVPNEDGVSILFYLQKIYPDEWNNFLERVNCLSEEELRGSDELEEQLRLWASYRGQTLTKTVRGMMYYRKALELQAFLDMAKDDDLMEGYKAIELNEDQMKGERSLWTQCQAVADMKFTYVVSCQLYGIQKRSGDQRAQDILRLMTTYPSLRVAYIDEVEEPSKDRTKKVNDKVYYSTLVKAALPKSNSSDPGQNLDQIIYRIKLPGPAILGEGKPENQNHAIIFTRGEGLQTIDMNQDNYMEEAFKMRNLLQEFLKKHDLRHPSILGLREHIFTGSVSSLAWFMSNQETSFVTIGQRLLANPLKVRFHYGHPDVFDRLFHLTRGGVSKASKIINLSEDIFAGFNSTLREGNVTHHEYIQVGKGRDVGLNQISLFEAKIANGNGEQTLSRDLYRLGHRFDFFRMLSCYFTTIGFYFSTLITVLTVYIFLYGRLYLVLSGLEHGLSTQPGIRDNKALEIALASQSFVQIGFLMALPMMMEIGLEKGFRTALSEFILMQLQLAPVFFTFSLGTKTHYYGRTLLHGGAKYRPTGRGFVVFHAKFAENYRLYSRSHFVKGLELMILLLVYQIFGQSYRGAVAYIIITVSMWFMVGTWLFAPFLFNPSGFEWQKIVDDWTDWNKWISNRGGIGVPPEKSWESWWEEEQDHLRHSGKRGIIAEIVLALRFFIYQYGLVYHLHITRNTKSILVYGVSWLVIVLILFVMKTISVGRRKFSANFQLVFRLIKGLIFVTFISIIAILIALPHMTPRDIIVCILAFMPTGWGLLLIAQACKPVVQKFGFWGSVRTLARGYEILMGLLLFTPVAFLAWFPFVSEFQTRMLFNQAFSRGLQISRILGGHRKDRSSRNKE

SEQ ID NO: 10865 - protein, 1948 aa, Solanum lycopersicum
MASRGGPEPSLQRRITRTQTMGNIGESMIDSEVVPSSLAEIAPILRVANEVEPSNPRVAYLCRFYAFEKAHRLDPTSSGRGVRQFKTSLLQRLERENDPTLIGRVKKSDAREMQSFYQHYYKKYIQALQNAAEKADRAQLTKAYQTANVLFEVLKAVNQTQAVEVDREILEAHDKVAEKTQILVPYNILPLDPDSVNQAIMRFPEVQAAVYALRNTRGLPWPKDYKKKKDEDILDWLQAMFGFQKDSVANQREHLILLLANVHIRQYPKPDQQPKLDERALNEVMKKLFKNYKKWCKYLDRKSSLWLPTIQQEVQQRKLLYMGLYLLIWGEAANLRFMPECLCYIYHHMAFELYGMLAGNVSPMTGENVKPAYGGEEEAFLRKVVTPIYEVIAREAARSRRGKAKHSQWRNYDDLNEYFWSVDCFRLGWPMRADADFFCLPVDEEQAERNGDNKALSDRWLGKVNFVEIRSYLHIFRSFDRMWSFFILCLQAMIIIAWNGSGDLSMVFTSNVFKKVLSVFITAAVLKLGQATLDVMLNWKARRSMSFYVKLRYILKVISAAAWVIILPVTYAYTWENPPPFAQAIRNWFGSNSDSPSLFILAVVIYLSPNMLAALLFLFPFVRRFLERSHYKIVMLMMWWSQPRLYVGRGMHESTFSLFKYTMFWVLLIATKLAFSFYVEIKPLVEPTKKVMNVHITTYQWHEFFPHASSNIGVVIALWAPVILVYFMDAQIWYAIFSTIFGGIYGAFRRLGEIRTLGMLRSRFQSLPGAFNACLIPEEKSEQPKKKGLKATFSRNFARVPSNKEKEAARFAQLWNKIITSFREEDLISNREMDLLLVPYWADRELDLVQWPPFLLASKIPIAVDMAKDSNGKDRELKKRIEADPYMSSAVCECYASFRNVIKVLVSGRREKEVIEYIFSEVDKHIEAGNLISEYKMSSLPSLYDLFVKLIKYLLENRQEDRDQVVLLFQDMLEVVTRDIMMEDQLSSLVDSIHGAPGYEGMIPLDQQYQLFASAGAIKFPPPESEAWKEKIKRLYLLLTVKESAMDVPSNLEARRRISFFSNSLFMDMPTAPKVRNMLSFSVLTPYYTEEVLFSSDDLDKQNEDGVSILFYLQKIYPDEWNNFLERADCISEDDLRFKWSPELEENLRHWASYRGQTLTRTVRGMMYYRRALELQSFLDMAQDDDLMEGYKAIELNDDQMKGERSLWAQCQAVADMKFTYVVSCQLYGIHKRSGDQRAQDILRLMTTYPSMRVAYIDEIEEPSKDRSKKVNPKAYYSTLVKAALPNSHSTEPGQNLDQVIYRIKLPGPAILGEGKPENQNHAIIFTRGEGLQTIDMNQDNYMEEALKVRNLLQEFLKKHDGVRFPTILGLREHIFTGSVSSLAWFMSNQETSFVTIGQRLLANPLKVRFHYGHPDIFDRLFHLTRGGISKASKIINLSEDIFAGFNSTLREGNVTHHEYIQVGKGRDVGLNQISLFEAKIANGNGEQTLSRDLYRLGHRFDYFRMLSCYFTTIGFYFSTLITVLTVYVFLYGRLYLVLSGLEEGLSKEPAIKNNKPLQVALASQSFVQIGFLMALPMMMEIGLEKGFRTALSEFILMQLQLAPVFFTFSLGTKTHYYGRTLLHGGAKYRPTGRGFVVFHAKFADNYRFYSRSHFVKGLELMILLLVYQIFGQENRGAVAYILITVSMWFMVGTWLFAPFLFNPSGFEWQKIVDDWTDWNKWISNRGGIGVPPEKSWESWWEEEQEHLRHSGIRGIVAEILLSLRFFIYQYGLVYHLKITVKNQSFLVYGASWLVIILVLFVMKTISVGRRKFSANLQLVFRLIKGLIFLTFVATLVILMTLLKMTPKDMVICVLAFLPTGWGMLLIAQALKPVVRRAGFWGSVRTLARGYEIVMGLLLFTPVAFLAWFPFVSEFQTRMLFNQAFSRGLQISRILGGQRKDRSSRNKD

SEQ ID NO: 10866 - protein, 1957 aa, Theobroma cacao
MSSSRVSDQSQPLRRITRTQTAGNLGETAFDSEVVPSSLSEIAPILRVANEVESSNPRVAYLCRFYAFEKAHRLDPTSSGRGVRQFKTALLQRLERENDPTLQGRVKKSDAREMQSFYQHYYKKYIQALTSAADKADRAQLTKAYQTANVLFEVLKAVNLTQSIEVDREILEAQDKVAEQTQILVPYNILPLDPESANQAIMQYSEIRAAVYALRNTRGLPWPKDHRRKKDEDILDWLQEMFGFQKDNVANQREHLILLLANVHIRQFPKPDQQPKLDDHALTEVMKKLFKNYKKWCKYLDRKSSLWLPTIQQEVQQRKLLYMGLYLLIWGEAANLRFMPECLCYIYHHMAFELYGMLAGNVSPMTGENVKPAYGGEEEAFLKKVVTPIYDVIWREAERSKRGQSKHSQWRNYDDLNEYFWSVDCFRLGWPMRADADFFSRPIDQLREKNGDNKPSTNDRWMGKVNFVEIRSFWHVFRSFDRMWSFFILSLQAMIIIAWHGSGQPSSIFRGDLFKKVLSVFITAAILKLGQAVLDVILSWKAQQSMSFHVKLRYILKVLSAAAWVIVLPVTYAYTWDDPSGFARTIQSWFGNTSNSPSLFILAVVIYLSPNMLAAMLFLFPFIRRFLESSHYKIVMLMMWWSQPRLYVGRAMHESTFSLFKYTMFWVLLIITKLTFSYYIEIKPLVGPTKAVMSVRISKFQWHEFFPRAKNNIGVVIALWAPIILVYFMDTQIWYAIFSTLFGGIYGAFRRLGEIRTLGMLRSRFESLPGAFNARLIPEDLSKKKRKGVWGFFSRSFGQPPSNKEKGAAKFAQLWNKIISSFRQEDLISNKEMNLLLVPYWADRDLEQIQWPPFLLASKIPIALDMAKDSDSRDKELQKRIEADPYMFCAIGECYASFRSIIKFLVEGPREKEVINDIFSKVDKRIEDGSLIMAYKMSALPSLYDHIVKLIKFLLENKQEERGQVVLCFQDMLETVTKDIMTEDEISSLVDSIHGGSGHEGMILLDQHYQLFDQKKLDQLFASAGAIKFPISPVTEAWKEKINRLYLLLTTKESAMDVPSNLEARRRISFFSNSLFMDMPAAPKVRNMLSFSVLTPYYTEEVLFSLQELENPNEDGVSILFYLQKIFPDEWNNFLERVKCSSEEELKESPELEEHLRLWASYRGQTLTRTVRGMMYYREALELQAFLDMAKHEDLMEGYKAIELSTEDNKEDRSLKVQCEAVADMKFTYVVSCQLYGIQKRSGDQRAQDILRLMTKYPSLRVAYIDEVEQRNEDRLKKLNGKVNYFSVLVRAVPKSSDSSEPVQNLDQEIYRIKLPGPAILGEGKPENQNHAIIFSRGEGLQTIDMNQDNYMEEALKMRNLLQEFLTKHDGVRYPTILGLREHIFTGSVSSLAWFMSNQETSFVTIGQRLLANPLKVRFHYGHPDVFDRLFHLTRGGVSKASKVINLSEDIFAGFNSTLREGNVTHHEYIQVGKGRDVGLNQISMFEAKIANGNGEQTLSRDIYRLGHRFDFFRMLSCYFTTVGFYFNTLITVLTVYVFLYGRLYLVLSGLEQGLSEQPAIRDNKPLQVALASQSFVQIGFLMALPMLMEIGLERGFRTALSEFILMQLQLAPVFFTFSLGTKTHYYGRTLLHGGAKYRPTGRGFVVFHAKFADNYRLYSRSHFVKGIEMMILLLVYQIFGHTYRSAVAYVLITVSLWFMVGTWLFAPFLFNPSGFEWQKIVDDWTDWNKWINNRGGIGVPPEKSWESWWEEEQEHLQYSGKRGIIAEILLALRFFIYQYGLVYHLNVIKENRSFLIYGASWLVIVLILFVMKTVSVGRRKFSASYQLVFRLIKGLIFLTFVAILVTLIALPHMTLQDIIVCILAFMPTGWGILLIAQALRPFVKKAGFWGSVRTLARGYEIVMGLLLFTPVAFLAWFPFVSEFQTRMLFNQAFSRGLQISRILGGQRKDRTSRNKE

SEQ ID NO: 10867 - protein, 1950 aa, Gossypium raimondii
MSSSRGSDQSQLMRRITRTQTAGNLGETAFDSEVVPSSLSEIAPILRVANEVESSNPRVAYLCRFYAFEKAHRLDPTSSGRGVRQFKTALLQRLERENDPTLQGRVKKSDAREMQSFYQHYYKKYIQALTNAADKADRAQLTKAYQTANVLFEVLKAVNLTQSIEVDREILEAQDKVAEQTQILVPYNILPLDPDSANQAIMQYPEIQAAVYALRNTRGLPWPNDHKRKKDEDILDWLQEMFGFQKDNVANQREHLILLLANVHIRRFPKPDQQPKLDDHALTEVMKKLFKNYKKWCKYLDRKSSLWLPTIQQEVQQRKLLYMGLYLLIWGEAANLRFMPECLCYIYHHMAFELYGMLAGNVSPLTGENIQPAYGGEEEAFLQKVVTPIYEVIRREAERSKRGKSKHSQWRNYDDLNEYFWSVDCFRLGWPMRADADFFCLPIEQLEKNGDNKPQATRDRWVGKVNFVEIRSFWHVFRSFDRMWSFFILCLQVMIIVAWNGNGQPSSIFTGDVFKKVLSVFITAAILKLGQAVLDVILSWKAQQSMSFHVKLRYILKVVSAAAWVIVLPVTYAYTSDNPSGIARTIQSWFGSTSSSPSLFILAVVIYLSPNMLAAILFLFPFVRRFLESSHYKIVMLMMWWSQPRLYVGRGMHESTFSLFKYTMFWVLLIITKLAFSYYIEIKPLVRPTKAIMSVRVRHFQWHEFFPQARNNIGVVIALWAPIILVYFMDTQIWYAIFSTLFGGIYGAFRRLGEIRTLGMLRSRFGSLPGAFNDCLIPGDKSEKKNKGFWLFFSRSFGQPLSNKEKEAAKFAQLWNKIISSFREEDLISNKEMNLLLVPYWADRDLDQIQWPPFLLASKIPIALDMAKDSDSRDRELQKRIEADPYMFCAIRECYASFRSIIRFLVEGQREKRVIDDIFFKVDKRIADGSLIKTYKMSAVPSLCDHIVKLIKLLLENKQDERGQVVLCFQDMLEIVTKDIMAEEEFSSLEHGGSGHDGMNPDPLHQLFDTKKLDQLFASTGAIKFPTPVSEAWREKINRLYLLLTTKESAMDVPSNIDARRRISFFSNSLFMDMPAAPKVRNMLSFTVLTPYYTEEVLFSLQELEEPNEDGVSILFYLQKIFPDEWNNFLERVERNNEEELKESPELEEKLRLWASYRGQTLTRTVRGMMYYREALELQAFLDMAKHEDLMEGYKAIELNTEDSEENRSLKAQCEAVADMKFMYVVSCQQYGIQKRSGSERAQDILRLMTKYPSLRVAYIDEIEQRSEDRSKKLNGKVNYFSVLVRAVPKSFDSSEQNLDQEIYRIKLPGPAILGEGKPENQNHAIIFTRGEGLQTIDMNQDNYMEEALKMRNLLQEFLKKHDGVRYPTILGLREHIFTGSVSSLAWFMSNQETSFVTIGQRLLANPLKVRFHYGHPDVFDRLFHLTRGGVSKASRVINLSEDIFAGFSSTLREGNVTHHEYIQVGKGRDVGLNQISMFEAKIANGNGEQTLSRDIYRLGHRFDFFRMLSCYFTTVGFYFSTLVTVLTVYVFLYGRLYLVLSGLEQGLREEPAIRDNKPLQVALASQSFVQIGFLMALPMLMEIGLERGFQTALSEFILMQLQLAPVFFTFSLGTKTHYYGRTLLHGGAKYRPTGRGFVVFHAKFAENYRLYSRSHFVKGIEMMILLIVYQICGHTYRSTVAYVLITVSLWFMVGTWLFAPFLFNPSGFEWQKIVDDWTDWNKWINNRGGIGVPSEKSWESWWEEEQEHLQYSGKRGIIAEILLALRFFIYQYGLVYHLHVTRETKSFLVYGASWLVIVLILFVMKTVSVGRRKFSASYQLVFRLIKGLIFLTFVSILVILVTLAHMTIQDIIVCIFIFMPTGWGMLLIAQALRPVVKKAGFWGSVRTLARGYEIVMGLLLFTPVAFLAWFPFVSEFQTRMLFNQAFSRGLQISRILGGHRKDHASRHKE

SEQ ID NO: 10868 - protein, 1999 aa, Arabidopsis thaliana
MSATRGGPDQGPSQPQQRRIIRTQTAGNLGESFDSEVVPSSLVEIAPILRVANEVESSNPRVAYLCRFYAFEKAHRLDPTSSGRGVRQFKTALLQRLEREHDPTLMGRVKKSDAREMQSFYQHYYKKYIQALHNAADKADRAQLTKAYQTANVLFEVLKAVNLTQSIEVDREILEAQDKVAEKTQLYVPYNILPLDPDSANQAIMRYPEIQAAVLALRNTRGLPWPEGHKKKKDEDMLDWLQEMFGFQKDNVANQREHLILLLANVHIRQFPKPDQQPKFILSFVLIVPSQLDDQALTEVMKKLFKNYKKWCKYLGRKSSLWLPTIQQEMQQRKLLYMALYLLIWGEAANLRFMPECLCYIYHHMAFELYGMLAGNVSPMTGENVKPAYGGEEDAFLRKVVTPIYEVIQMEAQRSKKGKSKHSQWRNYDDLNEYFWSVDCFRLGWPMRADADFFCLPVAVPNTEKDGDNSKPIVARDRWVGKVNFVEIRSFWHVFRSFDRMWSFYILCLQAMIIMAWDGGQPSSVFGADVFKKVLSVFITAAIMKLGQAVLDVILNFKAHQSMTLHVKLRYILKVFSAAAWVIILPVTYAYSWKDPPAFARTIKSWFGSAMHSPSLFIIAVVSYLSPNMLAETNENLLLCCLTDVTIINTLQPRLYVGRGMHESAFSLFKYTMFWVLLIATKLAFSYYIEIRPLVAPTQAIMKARVTNFQWHEFFPRAKNNIGVVIALWAPIILVYFMDSQIWYAIFSTLFGGIYGAFRRLGEIRTLGMLRSRFESLPGAFNDRLIPDGKNQQKKKGIRATLSHNFTEDKVPVNKEKEAARFAQLWNTIISSFREEDLISDREMDLLLVPYWADRDLDLIQWPPFLLASKIPIALDMAKDSNGKDRELKKRIESDTYMKCAVRECYASFKNIIKFVVQGNREKEVIEIIFAEVDKHIDTGDLIQEYKMSALPSLYDHFVKLIKYLVNVLPVLDNKEEDRDHVVILFQDMLEVVTRDIMMEDYNISRLATFYRTAMACHSSHGGTWHGGMIPLEQQYQLFASSGAIRFPIEPVTEAWKEKIKRIYLLLTTKESAMDVPSNLEARRRISFFSNSLFMDMPMAPKVRNMLSFSVLTPYYTEEVLFSLRDLETPNEDGVSILFYLQKIFPGDFCSYAVNVAYILESRLEPDLLSPDEWNNFLERVKCLSEEELKESDELEEELRLWASYRGQTLTRTVRGMMYYRKALELQAFLDMAMHEDLMEGYKAVELNSENNSRGERSLWAQCQAVADMKFTYVVSCQQYGIHKRSGDPRAQDILRLMTRYPSLRVAYIDEVEEPVKDKSKKGNQKVYYSVLVKVPKSTDHSTLAQNLDQVIYRIRLPGPAILGEGKPENQNHAIIFSRGEGLQTIDMNQDNYMEEALKMRNLLQEFLTKHDGVRHPSILGLREHIFTGSVSSLAWFMSNQETSFVTIGQRLLANPLRVRFHYGHPDVFDRLFHLTRGGVSKASKVINLSEDIFAGFNSTLREGNVTHHEYIQVGKGRDVGLNQISMFEAKIANGNGEQTLSRDIYRLGHRFDFFRMMSCYFTTVGFYFSTLITVLTVYIFLYGRLYLVLSGLEQGLSTQKGIRDNTPLQIALASQSFVQIGFLMALPMLMEIGLERGFRTALSEFVLMQLQLAPVFFTFSLGTKTHYYGRTLLHGGAKYRSTGRGFVVFHAKFADNYRLYSRSHFVKGLEMMLLLVVYQIFGSAYRGVLAYLLITISMWFMVGTWLFAPFLFNPSGFEWQKIVDDWTDWNKWINNIGGIGVPAEKSWESWWEEEQEHLRYSGKRGIVVEILLALRFFIYQYGLVYHLTITEKTKNFLVYGVSWLVIFLILFVMKTVSVGRRRFSASFQLMFRLIKGLIFMTFIAIIVILITLAHMTIQDIIVCILAFMPTGWGMLLIAQACKPVVHRAGFWGSVRTLARGYEIVMGLLLFTPVAFLAWFPFVSEFQTRMLFNQAFSRGLQISRILGGHRKDRSSRNKE

SEQ ID NO: 10869 - protein, 2003 aa, Gossypium raimondii
MSSSRGSDQSQPMRRITRTQTAGNLGEAAFDSEVVPSSLSEIAPILRVANEVESSNPRVAYLCRFYAFEKAHRLDPTSSGRGVRQFKTALLQRLERENDPTLQGRVKKSDAREMQSFYQHYYKKYIQALTNAADKADRAQLTKAYQTANVLFEVLKAVNLTQSIEVDREILEAQDRVAEQTQILVPYNILPLDPDSANQAIMQYPEIQAAVYALRNTRGLPWPNDHKRKKDEDILDWLQEMFGFQKDNVANQREHLILLLANVHIRQFPKPDQQPKLDDHALTEVMKKLFKNYKKWCKYLDRKSSLWLPTIQQEVQQRKLLYMGLYLLIWGEAANLRFMPECLCYIYHHMAFELYGMLAGNVSPLTGENIQPAYGGEEEAFLKKVVTPIYEVIRREAERSKRGKSKHSQWRNYDDLNEYFWYGIFIYNFYLSTLLYSAIYLPLFNFRSVDCFRLGWPMRADADFFCLPIEQLVEKNGDNKPQATRDRWVGKVNFVEIRSFWHVFRSFDRMWSFFILCLQVMIIVAWNGNGQPSSIFTGDVFKKVLSVFITAAILKLGQAVLDVILSWKAQQSMSFHVKLRYILKVVSAAAWVIVLPVTYAYTSDNPSGIARTIQSWFGSASSSPSLFILAVVIYLSPNMLAAILFLFPFVRRFLESSHYKIVMLMMWWSQPRLYVGRGMHESTFSLFKYTMFWVLLIITKLAFSYYIEIKPLVGPTKAVMSVRITRFQWHEFFPQARNNIGVVIALWAPIILVYFMDTQIWYAIFSTLFGGIYGAFRRLGEIRTLGMLRSRFGSLPGAFNARLIPGDKSEKKKKGFWLFFSRSFGQPRSNKEKEAAKFAQLWNKIISSFREEDLISNKYLHSVLHVIYVLHSSYCFYVLSCFIFREMNLLLVPYWADRDLDQIQWPPFLLASKIPIALDMAKDSDSRDRELQKRIEADPYMFCAIRECYASFRSIIRFLVEGQREKRVIDDIFSKVDKRIADGSLIKTYKMSALPSLYDHIVKLIKLLLENKQDERGQVVLCFQDMLEIVTKDIMAEEEFSSLEHGGSGHDGMIDPLHQLFDTKKLDQLFASTGAIKFPTPVSEAWREKINRLYLLLTTKESAMDVPSNIDARRRISFFSNSLFMDMPAAPKVRNMLSFSVLTPYYTEEVLFSLQELEEPNEDGVSILFYLQKIFPDEWNNFLERVERNNEEELKESPELQEKLRLWASYRGQTLTRTVRGMMYYREALELQAFLDMAKHEDLMEGYKAIELNTEDSKENRSLKAQCEAVADMKFTYVVSCQQYGIQKRSGSERAQDILRLMTKYPSLRVAYIDEIEQRSEDRSKKLNGKVNYFSVLVRAVPKSIDSSEQNLDQEIYRIKLPGPAILGEGKPENQNHAIIFTRGEGLQTIDMNQDNYMEEALKMRNLLQEFLKKHDGVRYPTILGLREHIFTGSVSSLAWFMSNQETSFVTIGQRLLANPLKVRFHYGHPDVFDRLFHLTRGGVSKASKVINLSEDIFAGFNSTLREGNVTHHEYIQVGKGRDVGLNQISMFEAKIANGNGEQTLSRDIYRLGHRFDFFRMLSCYFTTVGFYFSTLVTVLTVYVFLYGRLYLVLSGLEQGLSREPAIRDNKPLQVALASQSFVQIGFLMALPMLMEIGLERGFRTALSEFILMQLQLAPVFFTFSLGTKTHYYGRTLLHGGAKYRPTGRGFVVFHAKFAENYRLYSRSHFVKGIEMMILLIVYQIFGHTYRSTVAYVLITASLWFMVGTWLFAPFLFNPSGFEWQKIVDDWTDWNKWINNRGGIGVPSEKSWESWWEEEQEHLQYSGKRGIIAEILLALRFFIYQYGLVYHLHVTRKTKSFLVYGASWLVIVLILFVMKTVSVGRRKFSASYQLVFRLIKGLIFLTFLSILVILVTLAHMTIQDIIVCIFIFMPTGWGMLLIAQALRPVVKKAGFWGSVRTLARGYEIVMGLLLFTPVAFLAWFPFVSEFQTRMLFNQAFSRGLQISRILGGHRKDRTSRHKE

SEQ ID NO: 10870 - protein, 1590 aa, Phaseolus vulgaris
MTGENVKPAYGGEEEAFLRKVVTPIYNVIAKEAARSKKGRSKHSQWRNYDDLNEYFWSGDCFRLGWPMRADADFFCLPSENSFFDKSNDDKPPSRDRWVGKVNFVEIRSFWHIFRSFDRMWIFFILCLQAMIIVAWNGSGDPSVIFNGAVFKKVLSVFITAAILKFGQAVLDVILSWKAQWSMSLYVKLRYILKVVSAAAWVIVLSVTYAYTWDNPPGFAQTIKSWFGNGGSSAPSLFILAVVVYLSPNMLAAIFFLIPFIRRHLERSNYRVVMLMLWWSQPRLYVGRGMHESTFSLFKYTMFWVLLIITKLAFSYYIEIKPLVGPTKAIMSVKITTFQWHEFFPHARNNIGVVIALWSPIILVYFMDTQIWYAIFSTLFGGIYGAFRRLGEIRTLGMLRSRFESLPGAFNASLIPEEASEPKKKGLKATLSRRFPNISSNKGKEAARFAQLWNQIITSFRDEDLISDREMDLLLVPYWADTQLDLIQWPPFLLASKIPIALDMAKDSNGKDRELKKRIGLDTYMSCAVRECYASFKSIIKHLVQGERETKVIEYMFDEVDKHIESDKLIVEFRMSALPNLCKQFVQLIEYLLANDPKDRDLVVILFQDMLEVVTRDIMMEDQDQIFSLVDSTHGGTGHEGMLHLEPEPHHQLFASEGAIKFPIEPFTAAWTEKIKRLFLLLTTKESAMDVPSNLEARRRISFFSNSLFMDMPLAPKVRNMLSFSVLTPYYTEEVLFSLQDLDSPNEDGVSILFYLQKIFPDEWNNFIQRVKSTEEDIKGCESDELVEELRLWASYRGQTLTRTVRGMMYYRKALELQAFLDMAKDEDLMEGYKAVENSDDNSRGERSLWTQCQAVADMKFTYVVSCQQYGIDKRSGSRLAQDILRLMTRYPSLRVAYIDEVEEPVKDSKKKINKVYYSCLVKAMPKSNSASEPEQNLDQIIYKIKLPGPAILGEGKPENQNHAIIFTRGEGLQTIDMNQDNYMEEALKMRNLLQEFLKKHDGVRFPSILGLREHIFTGSVSSLAWFMSNQETSFVTIGQRLLANPLKVRFHYGHPDVFDRLFHLTRGGVSKASKVINLSEDIFAGFNSTLREGNVTHHEYIQVGKGRDVGLNQISMFEAKIANGNGEQTLSRDVYRLGHRFDFFRMLSCYFTTVGFYFSTLITVLTVYIFLYGRLYLVLSGLEEGLSTQKAIRDNKPLQVALASQSFVQIGVLMALPMLMEIGLERGFRTALSEFILMQLQLAPVFFTFSLGTKTHYFGRTLLHGGAKYRPTGRGFVVFHAKFADNYRLYSRSHFVKGIELMILLIVYQIFGHSYRSAVAYILITASMWFMVGTWLFAPFLFNPSGFEWQKIVDDWTDWNKWISNRGGIGVLPEKSWESWWEEEQEHLQYSGLRGIIVEILLSLRFFIYQYGLVYHLNITKKGQKSFLVYGISWLVIFVVLFVMKTVSVGRRKFSANFQLVFRLIKGMIFLTFVSILVILIALPHMTVQDIVVCILAFMPTGWGMLQIAQALKPLVRRAGFWGSVKTLARGYEIVMGLLLFTPVAFLAWFPFVSEFQTRMLFNQAFSRGLQISRILGGQRKERSSRNKE

SEQ ID NO: 10871 - protein, 2018 aa, Theobroma cacao
MSSSRGSDQSQPLRRITRTQTAGNLGETAFDSEVVPSSLSEIAPILRVANEVESSNPRVAYLCRFYAFEKAHRLDPTSSGRGVRQFKTALLQRLERENDPTLQGRVKKSDAREMQSFYQHYYKKYIQALTNAADKADRAQLTKAYQTANVLFEVLKAVNLTQSIEVDREILEAQDKVAEQTQILVPYNILPLDPESANQAIMQYPEIQAAAYALRNTRGLPWPKDHKRKKDEDILDWLQEMFGFQKDNVANQREHLILLLANVHIRQFPKPDQQPKCRKEVKQDEVEQHRGFGMVARVWSAVVGGMIERLERIDSQAAVKECDDVLNRRHGLPTIQQEVQQRKLLYMGLYLLIWGEAANLRFMPECLCYIYHHMAFELYGMLAGNVSPMTGENVKPAYGGEEEAFLKKVVTPIYDVIRREAEISKRGKSKHSQWRNYDDLNEYFWSVDCFRLGWPMRADADFFSRPIDQLREKNGDNKPSTNDRWMGKVNFVEIRSFWHVFRSFDRMWSFFILSLQAMIIIAWHGSGQPSSIFRGDLFKKVLSVFITAAILKLGQAVLDVILSWKAQQSMSFHVKLRYILKVLSAAAWVIVLPVTYAYTWDDPSGFARTIQSWFGNTSNSPSLFILAVVIYLSPNMLAAMLFLFPFIRRFLESSHYKIVMLMMWWSQPRLYVGRAMHESTFSLFKYTMFWVLLIITKLTFSYYIEIKPLVGPTKAVMSVRISKFQWHEFFPRAKNNIGVVIALWAPIILVYFMDTQIWYAIFSTLFGGIYGAFRRLGEIRTLGMLRSRFESLPGAFNARLIPEDLSKKKRKGVWGFFSRSFGQPPSNKEKGAAKFAQLWNKIISSFRQEDLISNKEMNLLLVPYWADRDLEQIQWPPFLLASKIPIALDMAKDSDSRDKELQKRIEADPYMFCAIGECYASFRSIIKFLVEGPREKEVINDIFSKVDKRIEDGSLIMAYKMSALPSLYDHIVKLIKFLLENKQEERGQVVLCFQDMLETVTKDIMTEDEISSLVDSIHGGSGHEGMILLDQHYQLFDQKKLDQLFASAGAIKFPISPVTEAWKEKINRLYLLLTTKESAMDVPSNLEARRRISFFSNSLFMDMPAAPKVRNMLSFSVLTPYYTEEVLFSLQELENPNEDGVSILFYLQKIFPDEWNNFLERVKCSSEEELKESPELEEHLRLWASYRGQTLTRTVRGMMYYREALELQAFLDMAKHEDLMEGYKAIELSTEDNKEDRSLKVQCEAVADMKFTYVVSCQLYGIQKRSGDQRAQDILRLMTKYPSLRVAYIDEVEQRNEDRLKKLNGKVNYFSVLVRAVPKSSDSSEPVQNLDQAGPTAKWFWVGCLFIVSELRYTFLFCWDYRLLFDVHVEIYRIKLPGPAILGEGKPENQNHAIIFSRGEGLQTIDMNQDNYMEEALKMRNLLQEFLTKHDGVRYPTILGLREHIFTGSVSSLAWFMSNQETSFVTIGQRLLANPLKVRFHYGHPDVFDRLFHLTRGGVSKASKVINLSEDIFAGFNSTLREGNVTHHEYIQVGKGRDVGLNQISMFEAKIANGNGEQTLSRDIYRLGHRFDFFRMLSCYFTTVGFYFNTLITVLTVYVFLYGRLYLVLSGLEQGLSEQPAIRDNKPLQVALASQSFVQIGFLMALPMLMEIGLERGFRTALSEFILMQLQLAPVFFTFSLGTKTHYYGRTLLHGGAKYRPTGRGFVVFHAKFADNYRLYSRSHFVKGIEMMILLLVYQIFGHTYRSAVAYVLITVSLWFMVGTWLFAPFLFNPSGFEWQKIVDDWTDWNKWINNRGGIGVPPEKSWESWWEEEQEHLQYSGKRGIIAEILLALRFFIYQYGLVYHLNVIKENRSFLIYGASWLVIVLILFVMKTVSVGRRKFSASYQLVFRLIKGLIFLTFVAILVTLIALPHMTLQDIIVCILAFMPTGWGILLIAQALRPFVKKAGFWGSVRTLARGYEIVMGLLLFTPVAFLAWFPFVSEFQTRMLFNQAFSRGLQISRILGGQRKDRTSRNKE

SEQ ID NO: 10872 - protein, 757 aa, Phaseolus vulgaris
MWRLKIGDGGKNPYIFSTNNFVGRQIWEFDSEAGTDEERAQVEAARQHFYQNRFKLKACGDRLWRFQILREKNFKQKIRKVKIEDDEEITWEKATLTLKRTSHYLSALQTSDGHWPAHLSGSHFFLPIMVISIYSTGHLDSVLPKEYRKEILRYLYNHQNEDGGWGLHIEGPSTMYGTTLNYVSMRILGEGANDNACAKARKWIHDHGSVTHVPSWGKFWLSVLGIVDWSGCNPLPPEFWILPTFLPMHPAKMWYYCRHVYMPMSYIYGKRFGCPITPLIRDLREELFIQPYDESMWKKSRHKCAKEDLYYPHHWIQDLIWDSAYLVTESLLTRWPFNKLIREKALQLTMKLIHYEDENTRYIDGGCVNKALSMLACWVEDPNGDAFKKHIARVPDYLWLSEDGMCLQALSTQSWDAGFIVQALLATNLIDDLGPTLAKAHDFIKKSQVVENRSGDFKSMFHHISKGSWTLADRDHALQLSDGTAECMKCCLLLSMLPEEIVGEKLEPERLYDSVNFILSLQSKNGGVTVWEPAIAQKWLEHLNPAEFLADIVIEHEYLECSGATIQALVLFKKLYPNHRREEIDNFIVKAAQFIEDEQLPNGNWHGNWGVCFTYGAWFAVGGLVAAGKSYSNCVAIRKAVKFLLSIQNEDGGWGESYLSCPMKTYVPLEGNRSNIGQTACALIALILGGQAERDPTPLHRAAKLLINSQLEDGDWPQQEALGVYKRSCLLHYPFYRTVFPLQALSEYRNNVLVSFT

SEQ ID NO: 10873 - protein, 318 aa, Sorghum bicolor
MARLLLFPSQACVDPGRHHLLLLHPPVSRSRAVRSGPPPAEPRRARVVSPPPLCSTHHPFLPCRSSKRVGVVFAAENAQEISSHPPGKDERRSGNLLLRFGALPCCTMAWLSTAQLAQSSVGGKLNVVYEVGELFELGIQLSYLLILLGLLGAGTFFVIRQVLVRRELDLSAKELQEQVRSGDASATEYFELGAVMLRRKFYPAAIKYLQQAIDKWDRDEQDLAQVYNALGVSYKRDNKLDKAIQQFQKAVELQPGYVTAWNNLGDAYEQKKDLKLALKAFEEVLLFDPNNKVARPRVDDLRPRVSMYKGVPVKSEKR

SEQ ID NO: 10874 - protein, 921 aa, Sorghum bicolor
MEGALVQSAIVPTVYRSSSGRFRARARARTNATMVRNMPARTLTLGGFQGLRQTNFLDTRSVIKRDFVSIVASQIARPRGSASRGVVRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLESLGADPNNIRTQVIRMVGESTEAVGAGVGGGSSGQKMPTLEEYGTNLTKLAEEGKLDPVVGRRDQIERVTQILGRRTKNNPCLIGEPGVGKTAIAEGLAQRIANGDVPETIEGKKVITLDMGLLVAGTKYRGEFEERLKKLMEEIKQNEDIILFIDEVHTLIGAGAAEGAIDAANILKPALARGELQCIGATTLDEYRKHIEKDPALERRFQPVKVPEPTVDETIQILRGLRERYELHHKLRYTDDALIAAAQLSYQYISDRFLPDKAIDLIDEAGSRVRLRHAQLPDEAKELDKELRQITKQKNEAVRSQDFEKAGELRDREMELKAQITAIIDKSKEMIKAETESGEVGPLVTEADIQHIVSSWTGIPVEKVSSDESDRLLKMEETLHTRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDYDEKDTSYNRIKSLVTEELKQYFRPEFLNRLDEMIVFRQLTKLEVKEIADIMLKEVFDRLKAKDINLQVTEKFRDRVVDEGYNPSYGARPLRRAIMRLLEDSLAEKMLAGEVKEGDSAIVDVDSDGKVIVLNGGSGVAEPLEPALST

SEQ ID NO: 10875 - protein, 921 aa, Setaria italica
MEGALVQSAIVPTIYRSNSGRFRVRARARTNATMVRNMPTRTLTLGGFQGLRQTNFLDTRSVVKRDFGSIVASQIARPRGSASRGVVRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLESLGADPNNIRTQVIRMVGESTEAVGAGVGGGSSGQKMPTLEEYGTNLTKLAEEGKLDPVVGRQDQIERVTQILGRRTKNNPCLIGEPGVGKTAIAEGLAQRISNGDVPETIEGKKVITLDMGLLVAGTKYRGEFEERLKKLMEEIKQNEDIILFIDEVHTLIGAGAAEGAIDAANILKPALARGELQCIGATTLDEYRKHIEKDPALERRFQPVKVPEPTVDETIQILRGLRERYELHHKLRYTDEALIAAAQLSYQYISDRFLPDKAIDLIDEAGSRVRLRHAQLPDEAKELDKELRQITKQKNEAVRGQDFEKAGELRDREMELKAQITAIIDKSKEMIKAETESGEVGPLVTEADIQHIVSSWTGIPVEKVSSDESDRLLKMEETLHTRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDYDEKDTSYNRIKSLVTEELKQYFRPEFLNRLDEMIVFRQLTKLEVKEIADIMLKEVFNRLKAKDIDLQVTEKFRDRVVDEGYNPSYGARPLRRAIMRLLEDSLAEKMLAGEVKEGDSCIVDVDSEGKVIVLNGSSGVAEPLEPALSA

SEQ ID NO: 10876 - protein, 921 aa, Setaria italica
MEGALVQSAIVPTIYRSNSGRFRVRARARTNATMVRNMPTRTLTLGGFQGLRQTNFLDTRSVVKRDFGSIVASQIARPWGSASRGVVRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLESLGADPNNIRTQVIRMVGESTEAVGAGVGGGSSGQKMPTLEEYGTNLTKLAEEGKLDPVVGRQDQIERVTQILGRRTKNNPCLIGEPGVGKTAIAEGLAQRISNGDVPETIEGKKVITLDMGLLVAGTKYRGEFEERLKKLMEEIKQNEDIILFIDEVHTLIGAGAAEGAIDAANILKPALARGELQCIGATTLDEYRKHIEKDPALERRFQPVKVPEPTVDETIQILRGLRERYELHHKLRYTDEALIAAAQLSYQYISDRFLPDKAIDLIDEAGSRVRLRHAQLPDEAKELDKELRQITKQKNEAVRGQDFEKAGELRDREMELKAQITAIIDKSKEMIKAETESGEVGPLVTEADIQHIVSSWTGIPVEKVSSDESDRLLKMEETLHTRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDYDEKDTSYNRIKSLVTEELKQYFRPEFLNRLDEMIVFRQLTKLEVKEIADIMLKEVFNRLKAKDIDLQVTEKFRDRVVDEGYNPSYGARPLRRAIMRLLEDSLAEKMLAGEVKEGDSCIVDVDSEGKVIVLNGSSGVAEPLEPALSA

SEQ ID NO: 10877 - protein, 922 aa, Panicum virgatum
MEGSLVQSAIVPTVYKSNSGRFRVRARARTNATMVRNMPTRTLTLGSFQGLRQTNFLDTRSVVKRDFGAIVASQIARPRGSATRGVVRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLESLGADPNNIRTQVIRMVGESTEAVGAGVGGGSSGQKMPTLEEYGTNLTKLAEEGKLDPVVGRQDQIERVTQILGRRTKNNPCLIGEPGVGKTAIAEGLAQRISNGDVPETIEGKKVITLDMGLLVAGTKYRGEFEERLKKLMEEIKQNEDIILFIDEVHTLIGAGAAEGAIDAANILKPALARGELQCIGATTLDEYRKHIEKDPALERRFQPVKVPEPTVDETIQILRGLRERYELHHKLRYTDEALIAAAQLSYQYISDRFLPDKAIDLIDEAGSRVRLRHAQLPDEAKELDKELRQITKQKNEAVRGQDFEKAGELRDREMELKAQITAILDKSKEMIKAETESGEVGPLVTEADIQHIVSSWTGIPVEKVSSDESDRLLKMEETLHTRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDYDEKDTSYNRIKSLVTEELKQYFRPEFLNRLDEMIVFRQLTKLEVKEIADIMLKEVFDRLKAKDIDLQVTEKFRDRVVDEGYNPSYGARPLRRAIMRLLEDSLAEKMLAGEVKEGDSAIVDVDSDGKVIVLSGGSGVAEPLEPALSTY

SEQ ID NO: 10878 - protein, 921 aa, Panicum virgatum
MEGSLVQSAIVPTVYRSNSGRFRVRARARINATIVRNMPTRTLTLGGFQGLRQTNFLDTRSVVKRDFGAIVASQIARPRGSATRGVVRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLESLGADPNNIRTQVIRMVGESTEAVGAGVGGGSSGQKMPTLEEYGTNLTKLAEEGKLDPVVGRQGQIERVTQILGRRTKNNPCLIGEPGVGKTAIAEGLAQRIANGDVPETIEGKKVITLDMGLLVAGTKYRGEFEERLKKLMEEIKQNEDIILFIDEVHTLIGAGAAEGAIDAANILKPALARGELQCIGATTLDEYRKHIEKDPALERRFQPVKVPEPTVDETIQILRGLRERYELHHKLRYTDEALIAAAQLSYQYISDRFLPDKAIDLIDEAGSRVRLRHAQLPDEAKELDKELRQITKEKNEAVRGQDFEKAGELRDREMELKAQITAILDKSKEMIKAETESDEVGPLVTEADIQHIVSSWTGIPVEKVSSDESDRLLKMEETLHTRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDYDEKDTSYNRIKSLVTEELKQYFRPEFLNRLDEMIVFRQLTKLEVKEIADIMLKEVFDRLKAKDINLQVTEKFRDRVVDEGYNPSYGARPLRRAIMRLLEDSLAEKMLAGEVKEGDSAIVDVDSDGKVIVLNGGSGVAEPLEPALST

SEQ ID NO: 10879 - protein, 918 aa, Oryza sativa
MEGSLVQSAIAPTIYRRSGTARFRVRARATMMRTMPTRTLTLGGFQGLRQTNFLDSRSVIKRDFGSIVASQISRPRGLGSRGVVRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLESLGADPNNIRTQVIRMVGESTEAVGAGVGGGSSGQKMPTLEEYGTNLTKLAEEGKLDPVVGRQDQIERVTQILGRRTKNNPCLIGEPGVGKTAIAEGLAQRISNGDVPETIEGKKVITLDMGLLVAGTKYRGEFEERLKKLMEEIKQNDDIILFIDEVHTLIGAGAAEGAIDAANILKPALARGELQCIGATTLDEYRKHIEKDPALERRFQPVKVPEPTVDETIQILRGLRERYELHHKLRYTDDSLIAAAQLSYQYISDRFLPDKAIDLIDEAGSRVRLRHAQLPDEAKELDKELRQVTKDKNEAVRGQDFEKAGELRDREMELKAQITAIIDKSKEMVKAETESGEVGPLVTEADIQHIVSSWTGIPVEKVSSDESDRLLKMEETLHTRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDYDEKDTSYNRIKSLVTEELKQYFRPEFLNRLDEMIVFRQLTKLEVKEIADIMLKEVFDRLKAKDIDLQVTEKFRDRVVDEGYNPSYGARPLRRAIMRLLEDSLAEKMLAGEVKEGDSAIVDVDSEGKVIVLNGGSGVPEPLAPALSV

SEQ ID NO: 10880 - protein, 918 aa, Panicum virgatum
MEGTLVQSAIVPTVLHRSSSGRSRVRARATMLRSTPTRMLTLGGFQGLRQTNFLDTRSVIKRDFGSIVASQISRPRGSASRGVVRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLESLGADPNNIRTQVIRMVGESTEAVGAGVGGGASGQKMPTLEEYGTNLTKLAEEGKLDPVVGRQNQIERVTQILGRRTKNNPCLIGEPGVGKTAIAEGLAQRIANGDVPETIEGKKVITLDMGLLVAGTKYRGEFEERLKKLMEEIKQNEDIILFIDEVHTLIGAGAAEGAIDAANILKPALARGELQCIGATTLDEYRKHIEKDPALERRFQPVKVPEPTVDETTQILRGLRERYELHHKLRYTDEALVAAAQLSYQYISDRFLPDKAIDLIDEAGSRVRLRHAQLPDEAKELDKELRQITKQKNEAVRGQDFEKAGELRDREMELKAQITAIIDKSKEMIKAETESGEVGPLVTEADIQHIVSSWTGIPVEKVSSDESDRLLKMEDTLHTRIIGQDEAVKAISRAIRRARVGLKNPNRPIASFIFSGPTGVGKSELAKSLAAYYFGSEEAMIRLDMSEFMERHTVAKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDYEEKDSSYNRIKSLVTEELKQYFRPEFLNRLDEMIVFRQLTKLEVKEIADIMLKEVFDRLKAKDINLQVTERFRNRVVDEGYNPSYGARPLRRAIMRLLEDSLAEKMLAGEVKEGDSAIVDVDSDGKVVVLNGGRGVAEPLEPALSI

SEQ ID NO: 10881 - protein, 918 aa, Setaria italica
MEGTLVQSAIVPTVLHRSSSGRSRVRARATMLRSTPTRTLTLGGFQGLRQTNFLDTRSVVKRDFGYIVASQISRPRGSASRGVVRAMFERFTEKAIKVVMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLESLGADPNNIRTQVIRMVGESTEAVGAGVGGGTSGQKMPTLEEYGTNLTKLAEEGKLDPVVGRQNQIERVTQILGRRTKNNPCLIGEPGVGKTAIAEGLAQRIANGDVPETIEGKKVITLDMGLLVAGTKYRGEFEERLKKLMEEIKQNEDIILFIDEVHTLIGAGAAEGAIDAANILKPALARGELQCIGATTLDEYRKHIEKDPALERRFQPVKVPEPTVDETTQILRGLRERYELHHKLRYTDEALVAAAQLSYQYISDRFLPDKAIDLIDEAGSRVRLRHAQLPDEAKELDKELRQITKQKNEAVRGQDFEKAGELRDREMELKAQITAIIDKSKEMIKAETESGEVGPLVTEADIQHIVSSWTGIPVEKVSADESDRLLKMEETLHTRIIGQDEAVKAISRAIRRARVGLKNPNRPIASFIFSGPTGVGKSELAKSLAAYYFGSEEAMIRLDMSEFMERHTVAKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDYDEKDSSYTRIKSLVTEELKQYFRPEFLNRLDEMIVFRQLTKLEVKEIADIMLKEVFNRLKAKDIDLQVTERFRDRVVDEGYNPSYGARPLRRAIMRLLEDSLAEKMLAGEVKEGDSAIVDVDSEGKVIVLNGGSGVPEPLEPALSV

SEQ ID NO: 10882 - protein, 917 aa, Secale cereale
MEGTLVQSAVAPTAYRSSSTRFRVRTRATMLRSTPTRTLTLGGFQGLRQTNFLDTRSVIKRDFGSIVASQISRPRGSGSRMVVRAMFERFTEKAIKVIMLAQEEARRLGHNFVGTEQILLGLIGEGTGIAAKVLKSMGISLKDARVEVEKIIGRGSGFVAVEIPFTPRAKRVLELSLEEARQLGHNYIGSEHLLLGLLREGEGVAARVLESLGADPNNIRTQVIRMVGESTEAVGAGVGGGSSGQKMPTLEEYGTNLTKLAEEGKLDPVVGRQDQIERVTQILGRRTKNNPCLIGEPGVGKTAIAEGLAQRICNGDVPETIEGKKVITLDMGLLVAGTKYRGEFEERLKKLMEEIKQNDDIILFIDEVHTLIGAGAAEGAIDAANILKPALARGELQCIGATTLDEYRKHIEKDPALERRFQPVKVPEPTVEESIQILRGLRERYELHHKLRYTDDALVAAAQLSYQYISDRFLPDKAIDLIDEAGSRVRLRHAQLPDEAKELDKKLRQITKDKNEAVRGQDFEKAGELRDEEMELKAQITAIIDKSKEMVKAETESGEVGPLVTEADIQHIVSSWTGIPVEKVSSDESDRLLKMEETLHTRIIGQDEAVKAISRAIRRARVGLKNPNRPIASFIFSGPTGVGKSELAKALASYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDSDEKDTSYNRIKSLVTEELKQYFRPEFLNRLDEMIVFRQLTKLEVKEIADIMLKEVFDRLKAKEIDLQVTEKFRDRVVDEGYNPSYGARPLRRAIMRLLEDSLAEKMLAGEVKEGDSAIVDVDSDGKVVVLNSGGGIAEPLEPALSA

SEQ ID NO: 10883 - protein, 917 aa, Triticum aestivum
MEGTLVQSAIAPTAYRSSSTRSRVRTRATMLRSTPTRTLTLGGFQGLRQTNFLDTRSVIKRDFGSIVASQISRPRGSGSRMVVRAMFERFTEKAIKVIMLAQEEARRLGHNFVGTEQILLGLIGEGTGIAAKVLKSMGISLKDARVEVEKIIGRGSGFVAVEIPFTPRAKRVLELSLEEARQLGHNYIGSEHLLLGLLREGEGVAARVLESLGADPNNIRTQVIRMVGESTEAVGAGVGGGSSGQKMPTLEEYGTNLTKLAEEGKLDPVVGRQDQIERVTQILGRRTKNNPCLIGEPGVGKTAIAEGLAQRICNGDVPETIEGKKVITLDMGLLVAGTKYRGEFEERLKKLMEEIKQNDDIILFIDEVHTLIGAGAAEGAIDAANILKPALARGELQCIGATTLDEYRKHIEKDPALERRFQPVKVPEPTVEESIQILRGLRERYELHHKLRYTDDALVAAAQLSYQYISDRFLPDKAIDLIDEAGSRVRLRHAQLPDEAKELDKKLRQITKDKNEAVRGQDFEKAGELRDEEMELKAQITAIIDKSKEMVKAETESGEVGPLVTEADIQHIVSSWTGIPVEKVSSDESDRLLKMEETLHTRIIGQDEAVKAISRAIRRARVGLKNPNRPIASFIFSGPTGVGKSELAKALASYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDSDEKDTSYNRIKSLVTEELKQYFRPEFLNRLDEMIVFRQLTKLEVKEIADIMLKEVFDRLKAKEIDLQVTEKFRDRVVDEGYNPSYGARPLRRAIMRLLEDSLAEKMLAGEVKEGDSAIVDVDSDGKVVVLNSGGGIAEPLEPALSA

SEQ ID NO: 10884 - protein, 917 aa, Triticum aestivum
MEGTLVQSAIAPTAYRTSSTRSRVRTRATMLRSTPTRTLTLGGFQGLRQTNFLDTRSVIKRDFGSIVASQISRPRGSGSRMVVRAMFERFTEKAIKVIMLAQEEARRLGHNFVGTEQILLGLIGEGTGIAAKVLKSMGISLKDARVEVEKIIGRGSGFVAVEIPFTPRAKRVLELSLEEARQLGHNYIGSEHLLLGLLREGEGVAARVLESLGADPNNIRTQVIRMVGESTEAVGAGVGGGSSGQKMPTLEEYGTNLTKLAEEGKLDPVVGRQDQIERVTQILGRRTKNNPCLIGEPGVGKTAIAEGLAQRICNGDVPETIEGKKVITLDMGLLVAGTKYRGEFEERLKKLMEEIKQNDDIILFIDEVHTLIGAGAAEGAIDAANILKPALARGELQCIGATTLDEYRKHIEKDPALERRFQPVKVPEPTVEESIQILRGLRERYELHHKLRYTDDALVAAAQLSYQYISDRFLPDKAIDLIDEAGSRVRLRHAQLPDEAKELDKKLRQITKDKNEAVRGQDFEKAGELRDEEMELKAQITAIIDKSKEMVKAETESGEVGPLVTEADIQHIVSSWTGIPVEKVSSDESDRLLKMEETLHTRIIGQDEAVKAISRAIRRARVGLKNPNRPIASFIFSGPTGVGKSELAKALASYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDSDEKDTSYNRIKSLVTEELKQYFRPEFLNRLDEMIVFRQLTKLEVKEIADIMLKEVFDRLKAKEIDLQVTEKFRDRVVDEGYNPSYGARPLRRAIMRLLEDSLAEKMLAGEVKEGDSAIVDVDSDGKVVVLNSGGGIAEPLEPALSA

SEQ ID NO: 10885 - protein, 917 aa, Avena sativa
MEGTLVQSVIAPTAYRSSPTRFRVRTRATMLRSMPTRTLTLGGFQGLRQTNFLDTRSVIKRDFGSIVASQISRPRGSGSRMVVRAMFERFTEKAIKVIMLAQEEARRLGHNFVGTEQILLGLIGEGTGIAAKVLKSMGISLKDARVEVEKIIGRGSGFVAVEIPFTPRAKRVLELSLEEARQLGHNYIGSEHLLLGLLREGEGVAARVLESLGADPNNIRTQVIRMVGESTEAVGAGVGGGSSGQKMPTLEEYGTNLTKLAEEGKLDPVVGRQDQIERVTQILGRRTKNNPCLIGEPGVGKTAIAEGLAQRICNGDVPETIEGKKVITLDMGLLVAGTKYRGEFEERLKKLMEEIKQNDDIILFIDEVHTLIGAGAAEGAIDAANILKPALARGELQCIGATTLDEYRKHIEKDPALERRFQPVKVPEPTVDESIQILRGLRERYELHHKLRYTDEALVAAAQLSYQYISDRFLPDKAIDLIDEAGSRVRLRHAQLPDEAKDLDKKLRQITKDKNEAVRGQDFEKAGELRDEEMELKAQITAIIDKSKEMIKAETESGEVGPVVTEADIQHIVSSWTGIPVEKVSSDESERLLKMEETLHTRIIGQDEAVKAISRAIRRARVGLKNPNRPIASFIFSGPTGVGKSELAKALASYYFGSEEAMTRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDSDEKDTSYNRIKSLVTEELKQYFRPEFLNRLDEMIVFRQLTKLEVKDIADIMLKEVFDRLKAKEINLQVTEKFRDRVVDEGYNPSYGARPLRRAIMRLLEDSLAEKMLAGEVKEGDSAIVDVDADGKVVVLNSGSGIAEPLAPALSV

SEQ ID NO: 10886 - protein, 921 aa, Brachypodium distachyon
MEGALVQSAIVPTIYNSGAQVRARARATLVRAASVCSMRTQTMTLGGFQGLRRANFLDTRSVVRRDFGSIVASQLARPRGKGSRMVVRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLESLGADPNNIRTQVIRMVGESTEAVGAGVGGGSSGQKMPTLEEYGTNLTKLAEEGKLDPVVGRQDQIERVTQILGRRTKNNPCLIGEPGVGKTAIAEGLAQRITNGDVPETIEGKKVITLDMGLLVAGTKYRGEFEERLKKLMEEIKQSDDIILFIDEVHTLIGAGAAEGAIDAANILKPALARGELQCIGATTLDEYRKHIEKDPALERRFQPVKVPEPTVDETIQILRGLRERYELHHKLRYTDDALIAAAKLSYQYISDRFLPDKAIDLIDEAGSRVRLRHAQLPDEAKELDKELRQVTKDKNEAVRGQDFEKAGELRDKEMELKAQITAIIDKSKEMVKAETESGEVGPLVTEADIQHIVSSWTGIPVEKVSSDESDRLLKMEETLHQRIIGQDEAVKAISRAIRRARVGLKNPNRPIASFIFSGPTGVGKSELAKALASYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDYDEKDTSYNRIKSLVTEELKQYFRPEFLNRLDEMIVFRQLTKLEVKEIADIMLKEVFDRLKVKEIDLQVTERFRDRVVDEGYNPSYGARPLRRAIMRLLEDSLAEKMLAGEVKEGDSAIVDVDSEGKVIVLNSGSGVPEPMAPVLST

SEQ ID NO: 10887 - protein, 921 aa, Brachypodium distachyon
MEGALVQSAIVPTIYNSGAQVRARARATSVRAASVCSMRTQTMTLGGFQGLRRANFLDTRSVVRRDFGSIVAHQLARPRGKGSRMVVRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLESLGADPNNIRTQVIRMVGESTEAVGAGVGGGSSGQKMPTLEEYGTNLTKLAEEGKLDPVVGRQDQIERVTQILGRRTKNNPCLIGEPGVGKTAIAEGLAQRITNGDVPETIEGKKVITLDMGLLVAGTKYRGEFEERLKKLMEEIKQSDDIILFIDEVHTLIGAGAAEGAIDAANILKPALARGELQCIGATTLDEYRKHIEKDPALERRFQPVKVPEPTVDETIQILRGLRERYELHHKLRYTDDALTAAAKLSYQYISDRFLPDKAIDLIDEAGSRVRLRHAQLPDEAKELDKELRKVTKDKNEAVRGQDFEKAGELRDKEMELKAQITAIIDKSKEMVKAETESGEVGPLVTEADIQHIVSSWTGIPVEKVSSDESDRLLKMEETLHQRIIGQDEAVKAISRAIRRARVGLKNPNRPIASFIFSGPTGVGKSELAKALASYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDYDEKDTSYNRIKSLVTEELKQYFRPEFLNRLDEMIVFRQLTKLEVKEIADIMLKEVFDRLKAKEIDLQVTERFRDRVVDEGYNPSYGARPLRRAIMRLLEDSLAEKMLAGEVKEGDSAIVDVDSEGKVIVLNSGSGVPEPLTPALST

SEQ ID NO: 10888 - protein, 692 aa, Hordeum vulgare
MVGESTEAVGAGVGGGSSGQKMPTLEEYGTNLTKLAEEGKLDPVVGRQDQIERVTQILGRRTKNNPCLIGEPGVGKTAIAEGLAQRICNGDVPETIEGKKVITLDMGLLVAGTKYRGEFEERLKKLMEEIKQNDDIILFIDEVHTLIGAGAAEGAIDAANILKPALARGELQCIGATTLDEYRKHIEKDPALERRFQPVKVPEPTVEESIQILRGLRERYELHHKLRYTDDALVAAAQLSYQYISDRFLPDKAIDLIDEAGSRVRLRHAQLPDEAKELDKKLRQITKDKNEAVRGQDFEKAGELRDEEMELKAQITAIIDKSKEMVKAETESGEVGPLVTEADIQHIVSSWTGIPVEKVSSDESDRLLKMEETLHTRIIGQDEAVKAISRAIRRARVGLKNPNRPIASFIFSGPTGVGKSELAKALASYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDSDEKDTSYNRIKSLVTEELKQYFRPEFLNRLDEMIVFRQLTKLEVKEIADIMLKEVFDRLKAKEIDLQVTEKFRDRVVDEGYNPSYGARPLRRAIMRLLEDSLAEKMLAGEVKEGDSAIVDVDSDGKVVVLNSGSGIAEPLAPALSA

SEQ ID NO: 10889 - protein, 916 aa, Triticum aestivum
MEGALVQSAIVPTVYNSCAQVRGHARATSFRSMETQTITLGGFQGLRRANFLDTKSVVRHDFGSIVASQLARPRGKGSRMVVRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLESLGADPNNIRTQVIRMVGESTEAVGAGVGGGSSGQKMPTLEEYGTNLTKLAEEGKLDPVVGRQDQIERVTQILGRRTKNNPCLIGEPGVGKTAIAEGLAQRITNGDVPETIEGKKVITLDMGLLVAGTKYRGEFEERLKKLMEEIKQSDDIILFIDEVHTLIGAGAAEGAIDAANILKPALARGELQCIGATTLDEYRKHIEKDPALERRFQPVKVPEPTVDETIQILRGLRERYELHHKLQYTDDALVAAAKLSYQYISDRFLPDKAIDLIDEAGSRVRLRHAQLPDEAKELDKELRQVTKDKNEAVRGQDFEKAGELRDREMELKAQITAIIDKSKEMVKAESESGEVGPLVTEADIQHIVSSWTGIPVEKVSADESDRLLKMEETLHQRIIGQDEAVKAISRAIRRARVGLKNPNRPIASFIFSGPTGVGKSELAKALASYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDYDEKDTSYNRIKSLVTEELKQYFRPEFLNRLDEMIVFRQLTKLEVKEIADIMLKEVFDRLKVKEIDLQVTERFRDRVVDDGYNPSYGARPLRRAIMRLLEDSLAEKMLAGEVKEGDSAIVDVDSEGKVIVLNGGSGVLEPLTPILST

SEQ ID NO: 10890 - protein, 832 aa, Sorghum bicolor
MFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLESLGADPNNIRTQVIRMVGESTEAVGAGVGGGSSGQKMPTLEEYGTNLTKLAEEGKLDPVVGRRDQIERVTQILGRRTKNNPCLIGEPGVGKTAIAEGLAQRIANGDVPETIEGKKVITLDMGLLVAGTKYRGEFEERLKKLMEEIKQNEDIILFIDEVHTLIGAGAAEGAIDAANILKPALARGELQCIGATTLDEYRKHIEKDPALERRFQPVKVPEPTVDETIQILRGLRERYELHHKLRYTDDALIAAAQLSYQYISDRFLPDKAIDLIDEAGSRVRLRHAQLPDEAKELDKELRQITKQKNEAVRSQDFEKAGELRDREMELKAQITAIIDKSKEMIKAETESGEVGPLVTEADIQHIVSSWTGIPVEKVSSDESDRLLKMEETLHTRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDYDEKDTSYNRIKSLVTEELKQYFRPEFLNRLDEMIVFRQLTKLEVKEIADIMLKEVFDRLKAKDINLQVTEKFRDRVVDEGYNPSYGARPLRRAIMRLLEDSLAEKMLAGEVKEGDSAIVDVDSDGKVIVLNGGSGVAEPLEPALST

SEQ ID NO: 10891 - protein, 922 aa, Musa acuminata
MAGSLVQSAILPTVAVNRIQSHLRGSGKVKRGSKMMCQPRKHSLRLQGFAGLRRSDNVEFSSRNQRDFHSVVSGYISYSRGKASRGVAKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLESLGADPSNIRTQVIRMVGETTEAVGAGVGGGSSGNKMPTLEEYGTNLTKLAEEGKLDPVVGRQDQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVRVPEPTVDETILILRGLRERYEIHHKLRYTDEALIAAAQLSYQYISDRFLPDKAIDLIDEAGSRVRLRHAQLPEEARELDKELRQITKEKNEAVRSQDFEKAGELRDREMELKAQISALIDKGKEMSQAESEAGDSGPTVTEADIQHIVSSWTGIPVEKVSSDESDRLLKMEETLHKRVIGQDEAVKAISRAIRRARVGLKNPNRPIASFIFSGPTGVGKSELAKALASYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFDRLKVKDIELQVTERFKDRVVDEGYNPSYGARPLRRAIMRLLEDSLAEKMLAGEIKEGDSAIVDVDSDGNVTVLNGGSGVPEPIPPAVSV

SEQ ID NO: 10892 - protein, 832 aa, Pennisetum glaucum
MFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLESLGADPNNIRTQVIRMVGESTEAVGAGVGGGSSGQKMPTLEEYGTNLTKLAEEGKLDPVVGRQDQIERVTQILGRRTKNNPCLIGEPGVGKTAIAEGLAQRISNGDVPETIEGKKVITLDMGLLVAGTKYRGEFEERLKKLMEEIKQNEDIILFIDEVHTLIGAGAAEGAIDAANILKPALARGELQCIGATTLDEYRKHIEKDPALERRFQPVKVPEPTVDETIQILRGLRERYELHHKLRYTDEALIAAAQLSYQYISDRFLPDKAIDLIDEAGSRVRLRHAQLPDEAKELDKELRQITKQKNEAVRGQDFEKAGELRDREMELKAQITAIIDKSKEMIKAETESGEVGPLVTEADIQHIVSSWTGIPVEKVSSDESDRLLKMEETLHTRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDSDEKDTSYNRIKSLVTEELKQYFRPEFLNRLDEMIVFRQLTKLEVKEIADIMLKEVFDRLKAKEIDLQVTEKFRDRVVDEGYNPSYGARPLRRAIMRLLEDSLAEKMLAGEVKEGDSCIVDVDSEGKVIVLNGGSGVAEPLEPALSA

SEQ ID NO: 10893 - protein, 923 aa, Amorphophallus konjac
MAGALVQSAILPGAVANGRRSQVRGSSKSRRAARMLCTMGSHRPRMQGFTGLRSSNVLDFVPRSERSFHSVVATAISAPRGKACRGVAVAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPGNIRTQVIRMVGESAEAVGAGVGGGSSGNNKMPTLEEYGTNLTKLAEEGKLDPVVGRQDQIERVTQILGRRTKNNPCLIGEPGVGKTAIAEGLAQRISNGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVEETIQILKGLRERYEIHHKLRYTDEALVAAAQLSYQYISDRFLPDKAIDLVDEAGSRVRLRHAQLPEEARELDKELRQITKEKNEAVRGQDFEKAGELRDREMELKAQISALIDKGKERTKAESEAGESGPIVTEADIQHIVSSWTGIPVEKVSSDESDRLLKMEETLHKRVIGQDEAVKAISRAIRRARVGLKNPNRPIASFIFSGPTGVGKSELAKALAAYYFGSQEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFDRLKAKNIELQVTERFKDRVVDEGYNPSYGARPLRRAIMRLLEDSLAEKMLAGEIKEGDSAIVDVDSDGNVTVLGGESGIPEPAAPAMPI

SEQ ID NO: 10894 - protein, 917 aa, Aristolochia fimbriata
MTGALIQSVILPGAVTGSGNRFRSSGKSRRMSKMIISSQTSSPALRGFTGLRGSNYLDMILKPKQDFSSLVASYISAPRGKASRGVTVAMFERFTEKAIKVIMLAQEEARRLGHNFVGTEQILLGLIGEGTGIAAKVLKSMGINLKDARIEVEKIIGRGSGFVAVEIPFTPRAKRVLELSLEEARQLGHNYIGSEHLLLGLLREGEGVAARVLENLGADPSNIRTQVIRMVGESTEAVGAGVGGGTSGNKMPTLEEYGTNLTKLAEEGKLDPVVGRQQQIERVTQILGRRTKNNPCLIGEPGVGKTAIAEGLAQRISNGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPSVDETIQILKGLRERYELHHKLRYTDDALVAAAQLSYQYISDRFLPDKAIDLIDEAGSRVRLRHAQLPEDAKELDKELRQITKEKNEAVRSQDFEKAGELRDKEMELKAQITALIDKGKEMSKAESVAGEGGPIVTEVDIQHIVSSWTGIPVEKVSSDESDRLLKMEETLHKRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKDIADIMLNEVFERLKAKDIELQVTERFRERVVEEGYSPSYGARPLRRAIMRLLEDSLAEKMLAGEIKEGDSAIVDVDSDGNVTVLNGSSGIPEPLPL

SEQ ID NO: 10895 - protein, 920 aa, Elaeis guineensis
MAGALVQSAILPVQVVSRTCEQLKGSGKTRKAAKMMCNLRSHALRLQAFAGLRGANNLDLLSRSRQDFHSLVSAYISAPQGKACRGVPVAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLESLGADPSNIRTQVIRMVGESTEAVGAGVGGGSSGNKMPTLEEYGTNLTKLAEEGKLDPVVGRQEQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALVSAAQLSHQYISDRFLPDKAIDLIDEAGSRVRLRHAQLPEEARELDKELRQITKEKNEAVRSQDFEKAGELRDREMELKAQISALIDKGKERSKAESEAGDAGPIVTEADIQHIVSSWTGIPVEKVSSDESDRLLKMEETLHKRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFERLKAKNIELQVTERFRDRVVEEGYSPSYGARPLRRAIMRLLEDSLAEKMLAGEIKEGDSAIVDVDSDGNVTVLNGATGVPESPAIPV

SEQ ID NO: 10896 - protein, 832 aa, Pennisetum glaucum
MFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLESLGADPNNIRTQVIRMVGESTEAVGAGVGGGTSGQKMPTLEEYGTNLTKLAEEGKLDPVVGRQNQIERVTQILGRRTKNNPCLIGEPGVGKTAIAEGLAQRIANGDVPETIEGKKVITLDMGLLVAGTKYRGEFEERLKKLMEEIKQNEDIILFIDEVHTLIGAGAAEGAIDAANILKPALARGELQCIGATTLDEYRKHIEKDPALERRFQPVKVPEPTVDETTQILRGLRERYELHHKLRYTDEALIAAAQLSYQYISDRFLPDKAIDLIDEAGSRVRLRHAQLPDEAKELDKELRQITKQKNEAVRGQDFEKAGELRDREMELKAQITAIIDKSKEMIKAETESGEVGPLVTEADIQHIVSSWTGIPVEKVSSDESDRLLKMEETLHTRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDSDEKDTSYNRIKSLVTEELKQYFRPEFLNRLDEMIVFRQLTKLEVKEIADIMLKEVFDRLKAKEIDLQVTEKFRDRVVDEGYNPSYGARPLRRAIMRLLEDSLAEKMLAGEVKEGDSCIVDVDSEGKVIVLNGGGGVPEPLEPVLSV

SEQ ID NO: 10897 - protein, 929 aa, Musa acuminata
MADSLVHSAILPSAVMTRSQSQLRGSGKAKRGAKMVRSMRMHPLRLQSFAGLRAADNLDFSSRCQQDFHSVVSRYISNPRGKATRGVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLESLGADPSNIRTQANIFIDFVIRMVGESTEAVGAGVGGGSSGNKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVRVPEPTVDETIQILRGLRERYEIHHKLRYTDEALVAAAQLSYQYISDRFLPDKAIDLIDEAGSRVRLRHAQLPEEARELDKELRQITKEKNEAVRGQDFEKAGELRDREMELKAQISALIDKGKERSKAESEAGDAGPVVNEADIQHIVSSWTGIPVEKVSSDESDRLLKMEETLHKRVIGQDEAVKAISRAIRRARVGLKNPNRPIASFIFSGPTGVGKSELAKALASYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFDRLKVKDIELQVTERFKDRVVDEGYNPSYGARPLRRAIMRLLEDSLAEKMLAGEIKEGDSAIVDVDTEGNVTVLNGGSGVPESIPPAIPV

SEQ ID NO: 10898 - protein, 922 aa, Musa acuminata
MAGSLVQLTILPSALANRRQSQLRGSGKAKRGAKMMCQLQMHPLRLPGFAGLRRADNLEFFSRNRHDFHSLVSVYVSYAWGKASRGVAKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLESLGADPSNIRTQVIRMVGESTEAVGAGVGGGSSGNKMPTLEEYGTNLTKLAEEGKLDPVVGRQDQIERVTQILGRRTKNNPCLIGEPGVGKTAIAEGLAQRIVNGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILRGLRERYEIHHKLRYTDEALIAAAQLSYQYISDRFLPDKAIDLIDEAGSRVRLRHAQLPEEARELDKELRQITKEKNEAVRSQDFEKAGELRDREMELKAQISALIDKGKERSQAESEAGDSGPVVTEADIQHIVSSWTGIPVEKVSSDESDRLLKMEETLHKRVIGQDEAVKAISRAIRRARVGLKNPNRPIASFIFSGPTGVGKSELAKALASYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFDRLKAKDIELQVTERFKDRVVEEGYNPSYGARPLRRAIMRLLEDSLAEKMLAGEIKEGDSAIVDADSEGNVTVLNGGSSVPESMPPVVPV

SEQ ID NO: 10899 - protein, 616 aa, Eucalyptus grandis
MAGVLAQSANVPAILPGQRYGSSGGSAKSRRSVKMMSALTAPGIRMRGFSGLRGSNSLDTLLNSSSDLHSRVASSISFRRGKASRGVARAMFERFTDKAIKVIMLAQEEARRLGHNFVGTENKILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGESTEAVGAGVGGGSSGNKMPTLEEYGTNLTKLAEEGKLDPVVGRQQQIERVVQILGRRTKNNPCLIGEPGVGKTAIAEGLVQRIASGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLHYTDEALVAAAQLSYQYISDRFLPDKAIDLIDEAGSRVRLRHAQLPEEARELEKELRQITKEKNEAVRSQDFEKAGELRDREMDLKAQITALIDKGKEMSKAETEAGDVGPIVTEVDIQHIVSSWTGIPVEKVSSDESDRLLKMEETLHKTSHWTGRSS

SEQ ID NO: 10900 - protein, 920 aa, Phalaenopsis aphrodite
MAGACVQSVTLPAGLASIGRSRGSRGSRRAARMLCSPRLYPLRFQGYSGLRYSNVLDHNSKSGYGFHSMVGAYISAPKGKAIRGVAVAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLESLGADPSNIRTQVIRMVGESTEAVGAGVGGGSSGNKMPTLEEYGTNLTKLAEEGKLDPVVGRQQQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALIAAAQLSYQYISDRFLPDKAIDLIDEAGSRVRLRHAQLPEDARELDKELRQITKDKNEAVRSQDFEKAGELRDREMELKAQISALIDKGKEISKAESEAGDAGPIVTEVDIQHIVSSWTGIPVEKVSSDESDRLLKMEETLHQRVIGQDEAVKAISRAIRRARVGLKNPNRPIASFIFSGPTGVGKSELAKALAAYYFGSEDAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFERLKTKDIELQVTERFRDRVVEEGYSPSYGARPLRRAIMRLLEDSLAERMLSGEIKEGDSAIVDVDSDGNVTVLNGSSAPPETISPAMSI

SEQ ID NO: 10901 - protein, 712 aa, Phalaenopsis aphrodite
MAGACVQSVTLPAGLASIGRSRGSRGSRRAARMLCSPRLCPLRFQGYSGLRYSNVLDHNSKSGYGFHSMVGAYISAPKGKAIRGVAVAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLESLGADPSNIRTQVIRMVGESTEAVGAGVGGGSSGNKMPTLEEYGTNLTKLAEEGKLDPVVGRQQQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALIAAAQLSYQYISDRFLPDKAIDLIDEAGSRVRLRHAQLPEDARELDKELRQITKDKNEAVRSQDFEKAGELRDREMELKAQISALIDKGKEISKAESEAGDAGPIVTEVDIQHIVSSWTGIPVEKVSSDESDRLLKMEETLHQRVIGQDEAVKAISRAIRRARVGLKTLTAHCQLHFLWPYWRWQVGACQGPCRLLLRLRRCHDSPRHERVHGTPHRLEAHRLTTRLCWLHRRWPIDRSRSPTSIHRCSLR

SEQ ID NO: 10902 - protein, 832 aa, Brachypodium distachyon
MFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLESLGADPNNIRTQVIRMVGESTEAVGAGVGGGSSGQKMPTLEEYGTNLTKLAEEGKLDPVVGRQDQIERVTQILGRRTKNNPCLIGEPGVGKTAIAEGLAQRITNGDVPETIEGKKVITLDMGLLVAGTKYRGEFEERLKKLMEEIKQSDDIILFIDEVHTLIGAGAAEGAIDAANILKPALARGELQCIGATTLDEYRKHIEKDPALERRFQPVKVPEPTVDETIQILRGLRERYELHHKLRYTDDALTAAAKLSYQYISDRFLPDKAIDLIDEAGSRVRLRHAQLPDEAKELDKELRKVTKDKNEAVRGQDFEKAGELRDKEMELKAQITAIIDKSKEMVKAETESGEVGPLVTEADIQHIVSSWTGIPVEKVSSDESDRLLKMEETLHQRIIGQDEAVKAISRAIRRARVGLKNPNRPIASFIFSGPTGVGKSELAKALASYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDYDEKDTSYNRIKSLVTEELKQYFRPEFLNRLDEMIVFRQLTKLEVKEIADIMLKEVFDRLKAKEIDLQVTERFRDRVVDEGYNPSYGARPLRRAIMRLLEDSLAEKMLAGEVKEGDSAIVDVDSEGKVIVLNSGSGVPEPLTPALST

SEQ ID NO: 10903 - protein, 832 aa, Triticum aestivum
MFERFTEKAIKVIMLAQEEARRLGHNFVGTEQILLGLIGEGTGIAAKVLKSMGISLKDARVEVEKIIGRGSGFVAVEIPFTPRAKRVLELSLEEARQLGHNYIGSEHLLLGLLREGEGVAARVLESLGADPNNIRTQVIRMVGESTEAVGAGVGGGSSGQKMPTLEEYGTNLTKLAEEGKLDPVVGRQDQIERVTQILGRRTKNNPCLIGEPGVGKTAIAEGLAQRICNGDVPETIEGKKVITLDMGLLVAGTKYRGEFEERLKKLMEEIKQNDDIILFIDEVHTLIGAGAAEGAIDAANILKPALARGELQCIGATTLDEYRKHIEKDPALERRFQPVKVPEPTVEESIQILRGLRERYELHHKLRYTDDALVAAAQLSYQYISDRFLPDKAIDLIDEAGSRVRLRHAQLPDEAKELDKKLRQITKDKNEAVRGQDFEKAGELRDEEMELKAQITAIIDKSKEMVKAETESGEVGPLVTEADIQHIVSSWTGIPVEKVSSDESDRLLKMEETLHTRIIGQDEAVKAISRAIRRARVGLKNPNRPIASFIFSGPTGVGKSELAKALASYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDSDEKDTSYNRIKSLVTEELKQYFRPEFLNRLDEMIVFRQLTKLEVKEIADIMLKEVFDRLKAKEIDLQVTEKFRDRVVDEGYNPSYGARPLRRAIMRLLEDSLAEKMLAGEVKEGDSAIVDVDSDGKVVVLNSGGGIAEPLEPALSA

SEQ ID NO: 10904 - protein, 832 aa, Brachypodium distachyon
MFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLESLGADPNNIRTQVIRMVGESTEAVGAGVGGGSSGQKMPTLEEYGTNLTKLAEEGKLDPVVGRQDQIERVTQILGRRTKNNPCLIGEPGVGKTAIAEGLAQRITNGDVPETIEGKKVITLDMGLLVAGTKYRGEFEERLKKLMEEIKQSDDIILFIDEVHTLIGAGAAEGAIDAANILKPALARGELQCIGATTLDEYRKHIEKDPALERRFQPVKVPEPTVDETIQILRGLRERYELHHKLRYTDDALIAAAKLSYQYISDRFLPDKAIDLIDEAGSRVRLRHAQLPDEAKELDKELRQVTKDKNEAVRGQDFEKAGELRDKEMELKAQITAIIDKSKEMVKAETESGEVGPLVTEADIQHIVSSWTGIPVEKVSSDESDRLLKMEETLHQRIIGQDEAVKAISRAIRRARVGLKNPNRPIASFIFSGPTGVGKSELAKALASYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDYDEKDTSYNRIKSLVTEELKQYFRPEFLNRLDEMIVFRQLTKLEVKEIADIMLKEVFDRLKVKEIDLQVTERFRDRVVDEGYNPSYGARPLRRAIMRLLEDSLAEKMLAGEVKEGDSAIVDVDSEGKVIVLNSGSGVPEPMAPVLST

SEQ ID NO: 10905 - protein, 922 aa, Platanus occidentalis
MASALVQSTNLPTAVVGESLGQLRGSGKTKRNVKMMCNVQAPCLGLRNFSGLRGSNALDNMVRSSCNFHSKVAAAISFPRGKASRGVVVAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADASNIRTQVIRMVGESTEAVGAGVGGGSSGNKMPTLEEYGTNLTKLAEEGKLDPVVGRQPQIERVTQILGRRTKNNPCLIGEPGVGKTAIAEGLAQRIATGDVPETIEGKKVITLDMGLLVAGTKYRGEFEERLKKLMEEIKQSDEIILFIDEVHTLIGAGAAEGAIDAANILKPALSRGELQCIGATTLDEYRKHIEKDPALERRFQPVKVPEPTVDETIQILKGLRERYEIHHKLRYTDEALVAAAQLSYQYISDRFLPDKAIDLIDEAGSRVRLRHAQLPEEARELEKELRQITKEKNEAVRSQDFEKAGELRDREMDLKTQIANLVDKGKEKSKAESEAGDVGPLVTEVDIQHIVSAWTGIPVEKVSSDESDRLLKMEETLHKRVVGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFGRLKAKDIELQVTERFRDRVVEEGYSPSYGARPLRRAIMRLLEDCMAEKMLAGEIKEGDSVIVDVDSDGNVTVLNGSSGAPELAEPAFPV

SEQ ID NO: 10906 - protein, 925 aa, Amborella trichopoda
MAGALVQTAVLPARVVSRNGVRQNHGSGKGKTGTRMMVPIRVRPLSLGSYRGLRGSNAIDLVAIRSERSFHAAVSAAITLPKGKGSQGVVKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGESTEAVGAGVGGGSSGNKMPTLEEYGTNLTKLAEEGKLDPVVGRQMQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPSVDETIQILKGLRERYELHHKLRYTDVALVAAAQLSYQYISDRFLPDKAIDLVDEAGSRVRLRHAQLPEEAKELDKELRQITKEKNEAVRSQDFEKAGELRDREMELKAQITAITEKGKEQSKAEAESGSSLGPIVTEVDIQHIVSSWTGIPVEKVSSDESDRLLKMEETLHKRVIGQDEAVRAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLREVFERLKAKEIELQVTERFRDRVVDEGYSPSYGARPLRRAIMRLLEDSLAEKMLAGEIKEGDSAIVDVDSEGNVTVLNGASGTSDALSEPVPI

SEQ ID NO: 10907 - protein, 922 aa, Centaurea maculosa
MAGALVQSTSFPSAVSSESEGRSKRSGSIKRAVKMMGLQAPPMRVRTFSGLRGVNALDNLVKRGQDFHSKVAAATSVRRAKPTRIVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPNNIRTQVIRMVGESAEAVGAGVGGGSSGNKMPTLEEYGTNLTKLAEEGKLDPVVGRQPQIERVTQILGRRTKNNPCLIGEPGVGKTAIAEGLAQRIATGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALVAAAQLSYQYISDRFLPDKAIDLIDEAGSRVRLRHAQLPEEARELEKELRQITKEKNEAVRGQDFEKAGELRDREMDLKTQISALVDKNKEMSKAETEAGEEGPMVTEADIQHIVSSWTGIPVEKVSTDESDRLLKMEETLHTRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFERLKVKEIELQVTERFRDRVVDEGYNPSYGARPLRRAIMRLLEDSMAEKMLAREIKEGDSVIVDVDSDGNVTVLNGSSGAPPEALPEPIPV

SEQ ID NO: 10908 - protein, 923 aa, Unknown
  Sequence found in Organisms: Solanum tuberosum, Solanum phureja
MARALVQSTSIPSSVAGERTTKFNGSGKTKRAVTMLCNAQSSSLTLRDFTGLRGCNAIDTLVRSGQTLQSKVAAATYVRRPRGCRFVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGESNEAVGASVGGGTSGQKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALVAAAQLSYQYISDRFLPDKAIDLIDEAGSRVRLRHAQLPEEAKELEKELRQITKEKNEAVRGQDFEKAGELRDREMDLKAQITALIDKNKEVSKAESEAADTGPLVTEADIQHIVSSWTGIPVEKVSTDESDRLLKMEETLHTRIIGQDEAVKAISRAIRRARVGLKNPNRPIASFIFSGPTGVGKSELAKALATYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDFDEKDSSYNRIKSLVTEELKQYFRPEFLNRLDEMIVFRQLTKLEVKEIADIMLKEVFERLKVKEIELQVTERFRDRVVDEGYNPSYGARPLRRAIMRLLEDSMAEKMLAGEIKEGDSVIVDVDSDGNVTVLNGSSGTPSDPAPEPIPV

SEQ ID NO: 10909 - protein, 923 aa, Helianthus annuus
MAGALVQSTSFPSAVSSESKVRSKRSGNTKRAVKMMSGLQAPPVRVRTFSGLRGVNALDNMVNRGQDFHSKVAIATSVRRAKPCRIVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPNNIRTQVIRMVGESAEAVGAGVGGGTSGNKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDDALVAAAQLSYQYISDRFLPDKAIDLIDEAGSRVRLRHAQLPEEAKELEKELRQITKEKNEAVRGQDFEKAGELRDREMDLKTQISALIDKNKEMSKAETEAGEEGPTVTEADIQHIVSSWTGIPVEKVSTDESDRLLKMEETLHTRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFERLKGKEIELQVTERFRDRVVEEGYNPSYGARPLRRAIMRLLEDSMAEKMLARDIKEGDSVIVDVDSDGNVTVLNGSSGAPPEALPEPISV

SEQ ID NO: 10910 - protein, 923 aa, Solanum lycopersicum
MARALVQSTSIPSSVAGERTTKFNGSGKTKRAVTMLCNAQSSSLTLRDFTGLRGCNAIDTLVRSGQTLQSKVAAATYVRRPRGCRFVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGESNEAVGASVGGGTSGQKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALVAAAQLSYQYISDRFLPDKAIDLIDEAGSRVRLRHAQLPEEAKELEKELRQITKEKNEAVRGQDFEKAGELRDREMDLKAQITALIDKNKEVSKAESEAADTGPLVTEADIQHIVSSWTGIPVEKVSTDESDRLLKMEETLHTRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDLDEKDSSYNRIKSLVTEELKQYFRPEFLNRLDEMIVFRQLTKLEVKEIADIMLKEVFERLKVKEIELQVTERFRDRVVDEGYNPSYGARPLRRAIMRLLEDSMAEKMLANEIKEGDSVIVDVDSDGNVTVLNGSSGTPSDPAPEPIPV

SEQ ID NO: 10911 - protein, 923 aa, Nicotiana benthamiana
MARALVQSTNIPSSVSGERTTKFNGSGKTNRTVKMLCSAQSPSLRLRDFSGLRGCNAVDTLVRSGQTLQSKVAAATSVRRPRGCRFVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGESNEAVGASVGGGSSGQKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALEAAAQLSYQYISDRFLPDKAIDLIDEAGSRVRLRHAQLPEEAKELEKELRQITKEKNEAVRGQDFEKAGELRDREMDLKAQITALIDKNKEMSKAESEAGDIGPLVTEADIQHIVSSWTGIPVEKVSTDESDRLLKMEETLHTRIIGQDEAVKAISRAIRRARVGLKNPNRPIASFIFSGPTGVGKSELAKSLAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIGDIMLKEVFERLKGKEIELQVTERFRDRVVDEGYNPSYGARPLRRAIMRLLEDSMAEKMLAGEIKEGDSVIVDVDSDGNVTVLNGSSGTPSDHAPEPIPV

SEQ ID NO: 10912 - protein, 353 aa, Zostera marina
MAGALLQSAILPTAYASRSCSQRRGPGKGSRSMGVVRGSPIRLQSYSGLRGLNSIDFKSKIVKDFHSTVAASICKPRGKNRTRSGIVAMFERFTEKAIKVIMLAQEEARRLGHNFVGTEQILLGLIGEGTGIAAKVLKSMGINLKDARQEVEKIIGRGSGFVAVEIPFTPRAKRVLELSLEEARQLGHNYIGSEHLLLGLLREGEGVAARVLESLGADSNNIRTQVIRMVGESTEAVGAGVGGGSSGNKMPTLEEYGTNLTKLAEEGKLDPVVGRQDQIERVTQILGRRTKNNPCLIGEPGVGKTAIAEGLAQRIATGDVPETIEGKKVITLDMGLLVAGTKYRGEFEERLKN

SEQ ID NO: 10913 - protein, 923 aa, Flaveria ramosissima
MAGALVQSTSFPSAVSSESKVCSKRSGNTKRGVKMMAGALAPPVRVRTFSGLRGVNALDNMVNRAQDFHSKVAAATSVRKAKPSRIVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPNNIRTQVIRMVGESAEAVGAGVGGGTSGNKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALVAAAQLSYQYISDRFLPDKAIDLIDEAGSRVRLRHAQLPEEAKELEKELRQITKEKNEAVRGQDFEKAGELRDREMDLKTQISALVDKNKEMSKAETEAGEEGPTVTEADIQHIVSSWTGIPVEKVSTDESDRLLKMEETLHTRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFERLKGKEIELQVTERFRDRVVEEGYNPSYGARPLRRAIMRLLEDSMAEKMLAREIKEGDSVIVDVDSDGNVTVLNGSSGAPPEALPEPISV

SEQ ID NO: 10914 - protein, 923 aa, Nicotiana benthamiana
MARALVQSTNIPSSVAGEMTRQFSGSGKNKKTVKMLCNVQPPSIRLTNFTGLRGCNAIDTLVKSGQTLHSKVAAATSVRRPKGCRFVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGESNEAVGASVGGGTSGQKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALEAAAQLSYQYISDRFLPDKAIDLIDEAGSRVRLRHAQLPEEARELEKELRQITKEKNEAVRGQDFEKAGELRDREMDLKAQISALIDKNKEMSKAESEAGDTGPLVTEADIQHIVSSWTGIPVEKVSTDESDRLLKMEETLHTRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFERLKNKEIELQVTERFRDRVVDEGYNPSYGARPLRRAIMRLLEDSMAEKMLAGEIKEGDSVIVDVDSDGNVTVLNGTSGTPSDPAPEPIPV

SEQ ID NO: 10915 - protein, 923 aa, Silene vulgaris
MAGALLQSTNIPATFAYQRNGQFQRSGKGRKSVKMMATLQAPGYRMKSFSGLHGSNSLDSLGSTNDCFYTKMRAVISVRRGRASRGVVRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGENTEAVGAGVGGGTSGNKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDESLEAAARLSYQYISDRFLPDKAIDLIDEAGSRVRLRHAQLPEEARELEKELRQITKEKNEAVRGQDFEKAGELRDREMDLKAQISALIEKNKEMSKAETEAGDVGPVVTEVDIQHIVASWTGIPVDKVSTDESDRLLKMEETLHSRVIGQDEAVKAISRAIRRARVGLKNPNRPIASFIFSGPTGVGKSELAKTLAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDYDEKDSSYNRIKSLVTEELKQYFRPEFLNRLDEMIVFRQLTKLEVKEIADIMLKEVFERLKNKEIELQVTERFRDRVVDEGYNPSYGARPLRRAIMRLLEDSMAEKMLAREIKEGDSVIVDVDSDGNVIVLNGSSGAPPEPLPEVITV

SEQ ID NO: 10916 - protein, 136 aa, Chenopodium quinoa
MAGALIQSTNIPASFALNGQFQRSGKGKKAVKMMASLQAPGYRVRSFSGLRGGNALDTLGTTSECFYSKMRAVLSVRKGTASRGVVRAMFERFTEKAIKVIMLAQEEARRLGHNFVGTEQILLGLIGEGTGIAAKF

SEQ ID NO: 10917 - protein, 921 aa, Chenopodium quinoa
MAGALIQSTNIPASFALNGQFQRSGKGKKAVKMMASLQAPGYRVRSFSGLRGGNALDTLGTTSECFYSKMRAVLSVRKGTASRGVVRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGENTEAVGAGVGGGTTGNKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALVAAAQLSYQYISDRFLPDKAIDLIDEAGSRVRLRHAQLPEEARELEKELRQLTKEKNEAVRGQDFEKAGELRDREMDLKAQINALIEKNKEMSKAETEAGDVGPTVTETDIQHIVSSWTGIPVEKVSTDESDRLLKMEETLHTRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFERLKNKEIELQVTERFRDRVVDEGYNPSYGARPLRRAIMRLLEDSMAEKMLSREIKEGDSVIVDVDSDGNVMVLNGSSGAPPESLPEVITV

SEQ ID NO: 10918 - protein, 655 aa, Ambrosia trifida
MAGALVQSTSFPSAVSSESKVRSKRSCNAKRAVKMMCGLQAPPMRVRTFSGLRGANALDNLVQRGQDFHSKVAAATSVRKAKPSRIVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPNNIRTQVIRMVGESAEAVGAGVGGGTSGNKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILRGLRERYEIHHKLRYTDDALVAAAQLSYQYISDRFLPDKAIDLIDEAGSRVRLRHAQLPEEARELEKELRQITKEKNEAVRGQDFEKAGELRDREMDLKTQISALVDKNKEMSKAETEVGEEGPTVTEADIQHIVSSWTGIPVEKVSTDESDRLLKMEETLHTRIIGQDEAVKAISRAIRRARVGLKTQTAPSPVSSFRDPLVLVNLNSRKL

SEQ ID NO: 10919 - protein, 922 aa, Chelidonium majus
MARALVQSTNLPAAVVSENHGQRQGSGKGRRTVKMLCNAQASTLRMQGFSGLRGSNALDTMVKSGVDFHSKVAAAISAPRGRGSRSVAKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGESTEAVGAGVGGGSSGTKMPTLEEYGTNLTKLAEEGKLDPVVGRQPQIERVTQILGRRTKNNPCLIGEPGVGKTAIAEGLAQRIATGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALVAAAQLSYQYISDRFLPDKAIDLVDEAGSRVRLRNAQLPEEARELEKELRQITKEKNEAVRGQDFEKAGELRDREMDLKAQITNLVDKGKELTKAESEAADTGPIVTEVDIQHIVSSWTGIPVDKVSSDESDRLLKMEETLHQRVIGQDEAVKAISRAIRRARVGLKNPNRPIASFIFSGPTGVGKSELAKTLASYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIAGIMLKEVFERLKAKDIELQVTERFTDRVVDEGYSPSYGARPLRRAIMRLLEDSMAEKMLGGEIKEGDSVIVDVDGDGNVTVLNGSSGVQDSLPPAIPV

SEQ ID NO: 10920 - protein, 923 aa, Vitis vinifera
MARALVQSTNIFASVADGKHGKFQGSERTKKSVKMMCNVQAPGLRIRGFSGLRGANALDNLVRSGHDFHSRVAAAISVRGGKASRCVARAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGESTEAVGAGVGGGTTGNKMPTLEEYGTNLTKLAEEGKLDPVVGRQQQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPSVDETIQILKGLRERYEIHHKLRYTDEALVSAARLSYQYISDRFLPDKAIDLIDEAGSRVRLRHAQLPEEARELEKELRQITKEKNEAVRSQDFEKAGELRDREMDLKAQISTLIDKGKEMTKAETEAGDIGPMVTEVDIQHIVSAWTGIPVEKVSTDESDRLLKMEETLHRRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKDIADIMLKEVFERLKAKDIELQVTERFRDRVVDEGYNPSYGARPLRRAIMRLLEDSMAEKMLAREIKEGDSVIVDVDSDGNVTVLNGSSGAPPESLPEAMPV

SEQ ID NO: 10921 - protein, 923 aa, Cucumis melo
MARVLVQSTNIPGLVGGRKNGLTSRGSASVKRAVKMMATAHSPGLRIRNFSGLRGFNSLDNMLRSGQDFHSKMAITISSRRRKASRCVPRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGESTEAVGAGVGGGSSGNKMPTLEEYGTNLTKLAEEGKLDPVVGRQQQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPSVDETIQILKGLRERYEIHHKLRYTDEALVAAAQLSYQYISDRFLPDKAIDLVDEAGSRVRLRHAQLPEEARELEKELRQITKEKNEAVRSQDFEKAGELRDREMELKTKISALVDKGKEMSKAESEAGDVGPVVTEVDIQHIVSSWTGIPVEKVSTDESDRLLKMEETLHKRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFDRLKAKEIDLQVTERFRDRVVEEGYNPSYGARPLRRAIMRLLEDSMAEKMLAREIKEGDSVIVDVDSDGNVTVLNGSSGAPESLPDAIPV

SEQ ID NO: 10922 - protein, 925 aa, Valeriana officinalis
MASALVQSTNIPSSVSGKRNGQLKGRGKAKGTITMVASLQTATPMRLTSFTGMRGSNALDNISKPRQDFHSKVAAAISAPRGKGAIKSVVKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPNNIRTQVIRMVGESAEAVGAGVGGGSSGNKMPTLEEYGTNLTKLAEEGKLDPVVGRQAQIERVTQILGRRTKNNPCLIGEPGVGKTAIAEGLAQRIATGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALVAAAQLSYQYISDRFLPDKAIDLIDEAGSRVRLRHAQLPEEARELEKELRQITKEKNEAVRGQDFEKAGELRDREMDLKTQISALVDKNKEMNKAESEAGDTGPLVTEVDIQHIVSSWTGIPVDKVSADESDRLLKMEETLHKRVIGQDEAVMAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRMGFVLDYDEKDSSYNRIKSLVTEELKQYFRPEFLNRLDEMIVFRQLTKLEVKEIADIMLNEVFGRLKKKDIELQVTERFRDRVVDEGYNPSYGARPLRRAIMRLLEDSMAEKMLSREIKEGDSVIVDVDSDGNVTVLNGSSGAPPESLPEPIAV

SEQ ID NO: 10923 - protein, 722 aa, Flaveria ramosissima
MAGALVQSTSFPSAASSESKVCSKRSGNTKRGVKMMSSLQAPPVRVRTFSGLRGVNALDNMVNRAQDFHSKVAAATSVRKAKPSRIVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPNNIRTQVIRMVGESAEAVGAGVGGGTSGNKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALVAAAQLSYQYISDRFLPDKAIDLIDEAGSRVRLRHAQLPEEAKELEKELRQITKEKNEAVRGQDFEKAGELRDREMDLKTQISALVDKNKEMSKAETEAGEEGPTVTEADIQHIVSSWTGIPVEKVSTDESDRLLKMEETLHTRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKGSP

SEQ ID NO: 10924 - protein, 922 aa, Panax ginseng
MARALVQSTNFPSSVAGERNGQFKGSGKTKRTVKMMCTLRTVPTRMRGFSGLRGANALDAMVKSGHDFHSKVAAAISVRRGRASRSVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPNNIRTQVIRMVGESQEAGAVVGGGSSGNKMPTLEEYGTNLTKLAEEGKLDPVVGRQQQIERVTQILGRRTKNNPCLIGEPGVGKTAIAEGLAQRIATGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALVSAAQLSYQYISDRFLPDKAIDLIDEAGSRVRLRHAQLPEEARELEKELRQITKEKNEAVRGQDFEKAGELRDREMDLKTQITALVEKNKEMSKAETEAGDDGPIVTEVDIQHIVSSWTGIPVEKVSTDESDRLLKMEETLHTRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFQRLKAKDIELQVTERFRDRVVEEGYNPSYGARPLRRAIMRLLEDSMAEKMLAREIKEGDSVIIDIDSDGNVTVLNGSSGAPPEALQEPVAV

SEQ ID NO: 10925 - protein, 922 aa, Arnica chamissonis
MAGALVQSTSFPSAVSGQSKVRSKRSGNTKRAVKMTCSLQAPRVSVRAFSGLRGVNALDNMVNRGQDFHSKVAAATSVRRAKACRIVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPNNIRTQVIRMVGESAEAVGAGVGGGTSGNKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDESLVAAAQLSYQYISDRFLPDKAIDLIDEAGSRVRLRHAQLPEEAKELEKELRQITKEKNEAVRGQDFEKAGELRDREMDLKTQISALVDKNKEMNKAETEAGEEGPTVTEADIQHIVSSWTGIPVEKVSTDESDRLLKMEETLHTRIIGQDEAVKAISRAIRRARVGLKNPNRPIASFIFSGPTGVGKSELAKALAAYYFGSQEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFERLKVKEIELQVTERFRDRVVEEGYNPSYGARPLRRAIMRLLEDSMAEKMLAREIKEGDSVIVDVDSDGNVTVLNGSGAPPEALPEPISV

SEQ ID NO: 10926 - protein, 923 aa, Flaveria ramosissima
MAGALVQSTSFPSAVSSESKVRSKRSGNTKRAVKMMCGLQAPPMRVRTFSGLRGANAVDNLVKRGQDFHSKVAAATSVRKAKPSRIVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPNNIRTQVIRMVGESAEAVGAGVGGGTSGNKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALVAAAQLSYQYISDRFLPDKAIDLIDEAGSRVRLRHAQLPEEARELEKELRQITKEKNEAVRGQDFEKAGELRDREMDLKTQISSLVDKNKEMSKAETEAGEEGPTVTEADIQHIVSSWTGIPVEKVSTDESDRLLKMEETLHTRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFERLKGKEIELQVTERFRDRVVEEGYNPSYGARPLRRAIMRLLEDSMAEKMLAREIKEGDSVIVDVDSDGNVTVLNGSSGAPPEALPEPISV

SEQ ID NO: 10927 - protein, 923 aa, Helianthus annuus
MAGALVQSTSFPSAVSSESKVRSKRSGNTKRAVKMMCGLQAPPMRVRTFSGLRGANALDNLVQRGQDFHSKVAAATSVRKAKPSRIVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPNNIRTQVIRMVGESAEAVGAGVGGGTSGNKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDDALVAAAQLSYQYISDRFLPDKAIDLIDEAGSRVRLRHAQLPEEARELEKELRQITKEKNEAVRGQDFEKAGELRDREMDLKTQISALVDKNKEMSKAETEAGEEGPTVTEADIQHIVSSWTGIPVEKVSTDESDRLLKMEETLHTRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFERLKGKEIELQVTERFRDREVEEGYNPSYGARPLRRAIMRLLEDSMAEKMLARDIKEGDSVIVDVDSDGNVTVLNGSSGAPPEALPEPISV

SEQ ID NO: 10928 - protein, 923 aa, Helianthus annuus
MAGALVQSTSFPSAVSSESKVRSKRSGNTKRAVKMMCGLQAPPMRVRTFSGLRGANALDNLVQRGQDFHSKVAAATSVRKAKPSRIVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPNNIRTQVIRMVGESAEAVGAGVGGGTSGNKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDDALVTAAQLSYQYISDRFLPDKAIDLIDEAGSRVRLRHAQLPEEARELEKELRQITKEKNEAVRGQDFEKAGELRDREMDLKTQISALVDKNKEMSKAETEAGEEGPTVTEADIQHIVSSWTGIPVEKVSTDESDRLLKMEETLHTRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFERLKGKEIELQVTERFRDRVVEEGYNPSYGARPLRRAIMRLLEDSMAEKMLARDIKEGDSVIVDVDSDGNVTVLNGSSGAPPEALPEPISV

SEQ ID NO: 10929 - protein, 647 aa, Flaveria ramosissima
MAGALVQSTSFPSAVSSESKVRSKRSGNTKRAVKMMCSLQAPPMRVRTFSGLRGANALDNLVKRGQDFHSKVAAATSVRKAKPSRIVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPNNIRTQVIRMVGESAEAVGAGVGGGTSGNKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDDALVAAAQLSYQYISDRFLPDKAIDLIDEAGSRVRLRHAQLPEEARELEKELRQITKEKNEAVRGQDFEKAGELRDREMDLKTQISALVDKNKEMSKAETEAGEEGPTVTEADIQHIVSSWTGIPVEKVSTDESDRLLKMEETLHTRIIGQDEAVKAISRAIRRARVGLKNPPSNCQFHLLGTHWCW

SEQ ID NO: 10930 - protein, 922 aa, Panax ginseng
MARALVQSTNFPSSVAGERNGQFKGSGKTKRTVKMMCTLRTVPIRMRGFSGLRGANALDAMVKSGHDFHSKVAAAISVRRGRASRSVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPNNIRTQVIRMVGESQEAGAVVGGGSSGNKMPTLEEYGTNLTKLAEEGKLDPVVGRQQQIERVTQILGRRTKNNPCLIGEPGVGKTAIAEGLAQRIATGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALVSAAQLSYQYISDRFLPDKAIDLIDEAGSRVRLRHAQLPEEARELEKELRQITKEKNEAVRGQDFEKAGELRDREMDLKTQITALVEKNKEMSKAETEAGDDGPIVTEVDIQHIVSSWTGIPVEKVSTDESDRLLKMEETLHTRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFQRLKAKDIELQVTERFRDRVVEEGYNPSYGARPLRRAIMRLLEDSMAEKMLAREIKEGDSVIIDIDSDGNVTVLNGSSGAPPEALQEPVAV

SEQ ID NO: 10931 - protein, 727 aa, Ambrosia trifida
MAGALVQSTSFPSAVSSESKVHSKRSGNAKRAVKMMCGLQAPPMRVRTFSGLRGANALDNLVQRGQDFHSKVAAATSVRKAKPSRIVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPNNIRTQVIRMVGESAEAVGAGVGGGTSGNKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDDALVAAAQLSYQYISDRFLPDKAIDLIDEAGSRVRLRHAQLPEEARELEKELRQITKEKNEAVRGQDFEKAGELRDREMDLKTQISALVDKNKEMSKAETEAGEEGPTVTEADIQHIVSSWTGIPVEKVSTDESDRLLKMEETLHTRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKGPPLMSST

SEQ ID NO: 10932 - protein, 262 aa, Fagus grandifolia
MARVLVQTSNIPGVVASQRHQSKGSGKARRAVKMMSSLQAPGLRMGSFSGLRSVNALDTLVKPGLDLHSKVRITINSRKGRGSRCVARAMFERFTEKAIKVIMLAQEEARRLGHNFVGTEQILLGLIGEGTGIAAKVLKSMEINLKDARVEVEKIIGRGSGFVAVEIPFTPRAKRVLELSLEEARQLGHNYIGSEHLLLGLLREGEGVAARVLENLGADPSNIRTQVIRMVGESNEAIGAGVGGGSSGTKMPNLGGVWDQSD

SEQ ID NO: 10933 - protein, 920 aa, Citrullus lanatus
MARVLVQSTNIPGLVGGRKNGLSSRGSANVKRVVKMMATVHAPGLTIRSFSGLRGFNSLDNMLRTGQNFHSKMAITISRRRKASRCVPRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGESTEAVGAGVGGGSSGNKMPTLEEYGTNLTKLAEEGKLDPVVGRQQQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPSVDETIQILKGLRERYEIHHKLRYTDEALVAAAQLSYQYISDRFLPDKAIDLVDEAGSRVRLRHAQLPEEARELEKELRQITKEKNEAVRSQDFEKAGELRDREMELKTKISALVDKGKEMSKAESEAGDVGPVVTEVDIQHIVSSCIPVEKVSTDESDRLLKMEETLHKRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFDRLKAKEIDLQVTERFRDRVVEEGYNPSYGARPLRRAIMRLLEDSMAEKMLAREIKEGDSVIVDVDSDGNVTVLNGSSGAPESLPDAIPV

SEQ ID NO: 10934 - protein, 921 aa, Citrullus lanatus
MARVLVQPTNIPGLVGGRKSPTSRGSVYVKRGVKMMSSVHAPGLRMRSFSGLRGFNSLDNMLRTGQDFHSKMAIAISSRRGKASRCVPRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPTNIRTQVIRMVGESTEAVGAGVGGGTSGNKMPTLEEYGTNLTKLAEEGKLDPVVGRQQQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPSVDETIQILKGLRERYEIHHKLRYTDEALEAAAQLSYQYISDRFLPDKAIDLIDEAGSRVRLRHAQLPEEAREVEKELRQITKEKNEAVRSQDFEKAGELRDREMELKTKISALIDKGKEMSKAESEAGDVGPVVTEVDIQHIVSSWTGIPVEKESTDESDRLLKMEETLHKRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFDRLKGKEIDLQVTERFRDRVVEEGYNPSYGARPLRRAIMRLLEDSMAEKMLAREIKEGDSVIVDVDSDGNVTVLNGGATPESLADAIPV

SEQ ID NO: 10935 - protein, 922 aa, Panax ginseng
MARALVQSTNFPSSVAGERNGQFKGSGKTKRTVKMMCTLRTVPIRIRGFSGLRGANALDAMVKSGHDFHSKVAAAISVRRGRASRSVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPNNIRTQVIRMVGESQEAGAVVGGGSSGNKMPTLEEYGTNLTKLAEEGKLDPVVGRQQQIERVTQILGRRTKNNPCLIGEPGVGKTAIAEGLAQRIATGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALVSAAQLSYQYISDRFLPDKAIDLIDEAGSRVRLRHAQLPEEARELEKELRQITKEKNEAVRGQDFEKAGELRDREMDLKTQITALVEKNKEMSKAETEAGDDGPIVTEVDIQHIVSSWTGIPVEKVSTDESDRLLKMEETLHTRVVGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFQRLKAKDIELQVTERFRDRVVEEGYNPSYGARPLRRAIMRLLEDSMAEKMLAREIKEGDSVIIDIDSDGNVTVLNGSSGAPPEALQEPVAV

SEQ ID NO: 10936 - protein, 922 aa, Eucalyptus grandis
MAGVLAQSRNAPAIVSGQRYGGSGGSAKSRRSVKMMSALTAPSIRMRGFSGLRGSNSLDTLLNSSPDFHSRVANSISFRRGKASRGVVRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENMGADPSNIRTQVIRMVGESTEAVGAGVGGGSSGNKMPTLEEYGTNLTKMAEEGKLDPVVGRQPQIERVVQILGRRTKNNPCLIGEPGVGKTAIAEGLAQRISSGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALVSAAHLSYQYISDRFLPDKAIDLVDEAGSRVRLRHAQLPEEARELEKELRQITKEKNEAVRSQDFEKAGELRDREMDLKAQISALVDKGKEMSKAETEAGDVGPVVTEVDIQHIVSAWTGIPVEKVSSDESDRLLKMEETLHKRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIAHIMLREVFERLKAREIELQVTERFTDMVVEEGYNPSYGARPLRRAIMRLLEDSMAEKMLSGEIKEGDSVIVDVDSDKKVTVLNGSSGTPEATFSTPTP

SEQ ID NO: 10937 - protein, 665 aa, Zostera marina
MSGVLLPTVSPSGLTRRIRSQVRLSGKGKRSVTMMAPSLGSSLRFQNFSGLRKSNTLDFNGKSSNDFHSVVTASISKIIGKPIRGAAVAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLESLGSDPNNIRTQVIRMVGESTEAVGAGVGGGSSGNKMPTLEEYGTNLTKLAEEGKLDPVVGRQDQIERVTQILGRRTKNNPCLIGEPGVGKTAIAEGLAQRISNGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVRVPEPTVEETIQILGGLRERYEIHHKLRYTDEALVAAAKLSYQYISDRFLPDKAIDLIDEAGSRVRLQHAQLPEEAKELDKELRQITKDKNESVRGQDFEKAGELRDREMELKAQISALIDKGKEMNKAESEAGDTGPIVSESDIQHIVSSWTGIPVEKVSSDESDKLLKMEETLHTRVIGQDEAVKAISRAIRRARVGLKNPNRPIASFIFSGPTGVGNLNLQSHWLPITLDLRRQ

SEQ ID NO: 10938 - protein, 693 aa, Arnica chamissonis
MVGESAEAVGAGVGGGTSGNKMPTLEEYGTNLTKLAEEGKLDPVVGRQPQIERVTQILGRRTKNNPCLIGEPGVGKTAIAEGLAQRIATGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALVAAAQLSYQYISDRFLPDKAIDLIDEAGSRVRLRHAQLPEEARELEKELRQITKEKNEAVRGQDFEKAGELRDREMDLKTQISALVDKNKEMSKAETEAGEEGPMVTEADIQHIVSSWTGIPVEKVSTDESDRLLKMEETLHTRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFERLKVKEIELQVTERFRDRVVEEGYNPSYGARPLRRAIMRLLEDSMAEKMLAREIKEGDSVIVDVDSDGNVTVLNGSSGAPPEALPEPISV

SEQ ID NO: 10939 - protein, 925 aa, Cucumis sativus
MARVLVQPTNIPGLVVARKSPSSRGSGNAKRVVKMMSSVHSPGMRMRSFSGLRGLNSLDNMFRPGQDFHSKVAIAISSRRGGRPSRGVPRAMFERFTEKAIKVIMLAQEEARRLGHNFVGTEQILLGLIGEGTGIAAKVLKSMGINLKDARVEVEKIIGRGGGFVAVEIPFTPRAKRVLELSLEEARQLGHNYIGSEHLLLGLLREGEGVAARVLENLGADPANIRTQARILMVGESTEAVGAGVGGGSSGNKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPSVDETIQILKGLRERYEIHHKLRYTDEALEAAAQLSYQYISDRFLPDKAIDLIDEAGSRVRLRHAQLPEEAKEVEKELRQITKEKNDAVRSQDFEKAGELRDREMELKAKISALIDKGKEMSKAESEAGDVGPVVTEVDIQHIVSSWTGIPVEKVSTDESDRLLKMEETLHRRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRMGFDLDYDEKDSSYTRIKSLVTEELKQYFRPEFLNRLDEMIVFRQLTKLEVKEIADIMLKEVFDRLKGKEIDLQVTERFRDRVVDEGYNPSYGARPLRRAIMRLLEDSMAEKMLAREIKEGDSVIVDVDSDGNVTVLNGSSGAAPESLADPIPV

SEQ ID NO: 10940 - protein, 923 aa, Eschscholzia californica
MARALVQSTNLPATVVGESHAQLQGSRRNKKTVKMLCNAQASSLRVQSFSGLRGSNALDGMIKSGVDFHSKVAAAISAPRGKGNRSVAKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGESTEAVGAGVGGGSSGNKMPTLEEYGTNLTKLAEEGKLDPVVGRQPQIERVTQILGRRTKNNPCLIGEPGVGKTAIAEGLAQRIATGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALVAAAQLSYQYISDRFLPDKAIDLVDEAGSRVRLRNAQLPEEARELEKELRQITKEKNESVRGQDFEKAGELRDREMDLKAQITNLVDKGKEKSKAESESSDTGPVVTEVDIQHIVSSWTGIPVDKVSSDESDRLLKMEDTLHARVIGQDEAVKAISRAIRRARVGLKNPNRPIASFIFSGPTGVGKSELAKTLAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYTRIKSLVTEELKQYFRPEFLNRLDEMIVFRQLTKLEVKEIADIMLKEVFGRLKKKEIELQVTERFRDRVVDEGYSPSYGARPLRRAIMRLLEDSMAEKMLGGEIKEGDSVIVDVDGDGNVTVLNGSSGVPDSLPPPAIAV

SEQ ID NO: 10941 - protein, 919 aa, Oryza sativa
MAGTLLQPVALGTTFAGRVSGQRWKSHGTRRPPSMLAMSLSRPVKMAAFVGLRSVHSFSVTPVTNFRSTVASYRSRRGRRARFVTRSMFERFTEKAIKVIMLAQEEARRLGHNFVGTEQILLGLIGEGTGIAAKVLKSMGINLKDARVEVEKIIGRGNGFVAVEIPFTPRAKRVLELSLEEARQLGHNYIGSEHLLLGLLREGEGVAARVLESLGADPSNIRTQVIRMIGETTEAVGAGVGGGSSGNKMPTLEEYGTNLTKLAEEGKLDPVVGRQPQIERVVQILGRRTKNNPCLIGEPGVGKTAIAEGLAQRISTGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVRVPEPTVDETIEILRGLRERYEIHHKLRYTDDALISAAKLSYQYISDRFLPDKAIDLIDEAGSRVRLRHAQVPEEARELDKELKQITKDKNEAVRSQDFEKAGELRDREMELKAQITALIDKSKEMSKAETESGETGPLVNEADIQHIVSSWTGIPVEKVSSDESDKLLKMEETLHQRVIGQDEAVKAISRSIRRARVGLKNPNRPIASFIFAGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDYDEKDSSYSRIKSLVVEEMKQYFRPEFLNRLDEMIVFRQLTKLEVKEIAEIMLKEVFDRLKAKDIDLQVTEKFKERIVDEGFNPSYGARPLRRAIMRLLEDSLAEKMLAGEVKEGDSAIVDVDSEGKVIVLNGQSGLPELSTPAVTV

SEQ ID NO: 10942 - protein, 921 aa, Sorghum bicolor
MAGTLLQSVALGTTFGGRISTQRWRSHGARRPASMLAMSLSRPVKMSAFVGLRSVHSFSVTPTVSNSRSTVASYRSSRRTRRSRFVTRAMFERFTEKAIKVIMLAQEEARRLGHNFVGTEQILLGLIGEGTGIAAKVLKSMGINLKDARVEVEKIIGRGNGFVAVEIPFTPRAKRVLELSLEEARQLGHNYIGSEHLLLGLLREGEGVAARVLESLGADPSNIRTQVIRMIGETTEAVGAGVGGGSSGNKMPTLEEYGTNLTKLAEEGKLDPVVGRQPQIERVVQILGRRTKNNPCLIGEPGVGKTAIAEGLAQRISTGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIEILRGLRERYEIHHKLRYTDEALIAAAKLSYQYISDRFLPDKAIDLIDEAGSRVRLQHAQVPEEARELDKELKQITKQKNEAVRSQDFEKAGELRDREMELKAQITAFIDKSKELSKAEEESGETGPMVNEADIQHIVSSWTGIPVEKVSSDESDKLLKMEETLHTRVIGQDEAVVAISRSIRRARVGLKNPNRPIASFIFAGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDSDEKDSSYSRIKSLVIEEMKQYFRPEFLNRLDEMIVFRQLTKLEVKEIAEIMLKEVFDRLKAKDINLQVTEKFKERVVDEGYNPSYGARPLRRAIMRLLEDSLAEKMLAGEVKEGDSAIVDVDSEGKVVVLNGQGGIPELSTPAITV

SEQ ID NO: 10943 - protein, 922 aa, Fragaria vesca
MARVLVHSTNIPGLVAGQRLGQSKGSGNARRSTKMMCSLRTPALRISSFSGLRSVNALDIMARPGQDLYSKVGVAISSRRRKASRCVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGESTEAVGVGAGQGTSGNKMPTLEEYGTNLTKLAEEGKLDPVVGRQPQIERVVQILGRRTKNNPCLIGEPGVGKTAIAEGLAQRIASGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILRGLRERYEIHHKLRYTDEALISAAQLSYQYISDRFLPDKAIDLIDEAGSRVRLRHAQLPEEARELDKELRQITKEKNEAVRSQDFEKAGELRDREMDLKTQITAITEKGKEMSKAESEAGDVGPLVTEVDIQHIVASWTGIPVDKVSADESDRLLKMEETLHTRVIGQDEAVKAISRAIRRARVGLKNPNRPIASFIFSGPTGVGKSELAKALAAYYFGSQEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFERLKTKEIELQVTERFRDRVVDEGYNPSYGARPLRRAIMRLLEDSMAEKMLAREIKEGDSVIVDVDSDGNVTVLNGNSGSAGSLPEPVPV

SEQ ID NO: 10944 - protein, 922 aa, Panax ginseng
MARALVQSTNFSSSVTGERNGQFKGSGKTRRTVMMMCTLQTVPTRIRDFSGLRGANALDTMVKSGHDFHSKVAAATSVRRGKASRIAPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGTEPNNIRTQVIRMVGESVEAGATVGGGSSGNKMPTLEEYGTNLTKLAEEGKLDPVVGRQQQIERVTQILGRRTKNNPCLIGEPGVGKTAIAEGLAQRIATGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALVSAAQLSYQYISDRFLPDKAIDLIDEAGSRVRLRHAQLPEEARELEKELRQITKEKNEAVRSQDFEKAGELRDRETDLKTQISALVDRNKEMTKAETEAGDGGPLVTEVDIQHIVSSWTGIPVEKVSTDESDRLLKMEETLHTRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFERLKGKDIELQVTERFRDRVVEEGYNPSYGARPLRRAIMRLLEDSMAEKMLAREIKEGDSVIVDVDSDGNVTVLNGSSGAPPESLPEPIAV

SEQ ID NO: 10945 - protein, 921 aa, Malus domestica
MATNLVQSTYIPSVAMGRRLGYSKGSGNARRTVMLCTLRAPALRMSGYTGLRSVNALDISVKPRRDLFSSVKFANTKRRERASRCVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGESTEAVGAGVGGGTSGNKMPTLEEYGTNLTKLAEEGKLDPVVGRQQQIERVVQILGRRTKNNPCLIGEPGVGKTAIAEGLAQRISTGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILRGLRERYEIHHKLRYTDEALVSAAQLSYQYISDRFLPDKAIDLVDEAGSRVRLRHAQLPEEARGIEKELRAITKEKNEAVRSQDFEKAGELRDKEMDLKAQITAVVDKGKEMSKAESEAGDVGPLVTEVDIQHIVSSWTGIPVEKVSTDESDRLLKMEETLHKRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKDIADIMLKEVFERLKKKEIELQVTERFRDRVVDEGYNPSYGARPLRRAIMRLLEDSMAEKMLAREIKEGDSVIVDVDSDGNVTVLNGSSGSPESLPEPIPV

SEQ ID NO: 10946 - protein, 921 aa, Malus domestica
MARNLVQSTYIPSVATGRRLGYSKGSGNARRTVMFCTLRAPALRMSSYTGLRSVNALDVSVKPRHDLFSTVKFANTKRRERASRCVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGESTEAVGAGVGGGTSGNKMPTLEEYGTNLTKLAEEGKLDPVVGRQPQIERVVQILGRRTKNNPCLIGEPGVGKTAIAEGLAQRIATGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILRGLRERYEIHHKLRYTDEALVSAAQLSYQYISDRFLPDKAIDLIDEAGSRVRLRHAQLPEEARELEKELRAITKEKNEAVRSQDFEKAGELRDKEMDLKAQITAVVDKGKEMSKAESEAGDVGPLVTEVDIQHIVSSWTGIPVEKVSTDESDRLLKMEETLHKRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFERLKKKEIELQVTERFRDRVVDEGYNPSYGARPLRRAIMRLLEDSMAEKMLAREIKEGDSVIVDVDSDGNVTVLNGSSGAPESLPEPIPV

SEQ ID NO: 10947 - protein, 923 aa, Artemisia annua
MAGALVQSTSFPSAVSGESKVRSKQSGNNKRAVKMMYSLQAPPMRVNTFSGLRGVNALDNLVNRGQDFHSKVAAATSVRKAKPSRIVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPNNIRTQVIRMVGESAEAVGAGVGGGTSGNKMPTLEEYGTNLTKLAEEGKLDPVVGRQPQIERVTQILGRRTKNNPCLIGEPGVGKTAIAEGLAQRIATGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALVAAAQLSYQYISDRFLPDKAIDLIDEAGSRVRLRHAQLPEEARELEKELRQITKEKNEAVRGQDFEKAGELRDREMDLKTQISALVDKNKEMSKAETEAGEEGPTVTEADIQHIVSSWTGIPVEKVSTDESDRLLKMEETLHTRIVGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFERLKVKDIELQVTERFRDRVVEEGYNPSYGARPLRRAIMRLLEDSMAEKMLAREIKEGDSVIVDVDADGNVTVLNGSSGAPPEALPEPISV

SEQ ID NO: 10948 - protein, 922 aa, Prunus mume
MARVLVQSTNIPGVVAGRRLSQSKGSGNAKRTVKMCCTLRAPGLRISSFSGLRSVNALDIMAKPGQDFYSKMGVAITSRRRKASRCVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGESTEAVGAGVGGGSSGNKMPTLEEYGTNLTKLAEEGKLDPVVGRQPQIERVVQILGRRTKNNPCLIGEPGVGKTAIAEGLAQRIATGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILRGLRERYEIHHKLRYTDEALVSAAQLSYQYISDRFLPDKAIDLIDEAGSRVRLRHAQLPEEARELEKERRLITKEKDEAVRSQDFEKAGELRDREKDLSAQISAVVDKGKEMSKAESEAGDVGPLVTEVDIQHIVSSWTGIPVEKVSTDESDRLLKMEETLHTRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFERLRVKEIELQVTERFRDRVVDEGYNPSYGARPLRRAIMRLLEDSMAEKMLAREIKEGDSVIVDVDSDGNVTVLNGSSGSPESLPEAIPV

SEQ ID NO: 10949 - protein, 923 aa, Silene vulgaris
MAGALLQSTNIPATFAYQRNGQFPRSGKSRKAVKMMATLQAPGYQINSFSGLRGSKSLDTLGSTNDCFYTKMRAVLSVRRGTASRGVVRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGENTETVGAGVGGGTSGNKTPTLEEYGTNLTKLAEEGKLDPVVGRQPQIERVTQILGRRTKNNPCLIGEPGVGKTAIAEGLAQRIATGDVPETIEGKKVITLDMGLLVAGTKYRGEFEERLKKLMEEIKQSDDIILFIDEVHTLIGAGAAEGAIDAANILKPALARGELQCIGATTLDEYRKHIEKDPALERRFQPVKVPEPTVDETIQILKGLRERYEIHHKLRYTDDSLEAAARLSYQYISDRFLPDKAIDLIDEAGSRVRLRHAQLPEEARELEKELRQITKEKNDSVRGQDFEKAGELRDREMDLKAQITAMIEKNKEMSKAETEAGDVGPVVTEVDIQHIVASWTGIPVDKVSADESDRLLKMEDTLHTRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDYDEKDSSYNRIKSLVTEELKQYFRPEFLNRLDEMIVFRQLTKLEVKEIADIMLKEVFERLKSKEIDLQVTERFRDRVVDEGYNPSYGARPLRRAIMRLLEDSMAEKMLSREIKEGDSVIVDVDSDGNTIVLNGSTGAPPESLPEVITV

SEQ ID NO: 10950 - protein, 170 aa, Ambrosia trifida
MTSNVGSSVIEKGGRRIGFDLDYDEKDSSYNRIKSLVTEELKQYFRPEFLNRLDEMIVFRQLTKLEVKEIADIMLKEVFERLKGKEIELQVTERFRDRVVEEGYNPSYGARPLRRAIMRLLEDSMAEKMLARDIKEGDSVIVDVDSDGNVTVLNGSSGAPPEALPEPISV

SEQ ID NO: 10951 - protein, 434 aa, Mimulus guttatus
MARALVQSTNLPSSVSWANNCPFEGSNKTKAGPTMLCNSLATSARMRSFSGLRGANSIDMMLQKNIQTLQSKVSVSRRGKKIRTGARAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGAEPSNIRTQVIRMVGESAEAVGAGVGGGSSGTKMPTLEEYGTNLTKLAEEGKLDPVVGRQAQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGAYTRRVQKAYRKGSSAREKVPTRKSTGAHCG

SEQ ID NO: 10952 - protein, 925 aa, Triphysaria pusilla
MSHALLQSTTLPSSVGLANNGKVKGSNKTRNTATMLSSTQSAPMRMRGFSGLRGANALDFLVSQNRQTLQSKVEAATSPMKRGRKTRMAPRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGESAEAVGAGVGGGSSGNKMPTLEEYGTNLTKLAEEGKLDPVVGRQAQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDESLVAAAQLSYQYISDRFLPDKAIDLVDEAGSRVRLRHAQLPEEARELEKELRQITKEKNEAVRGQDFEKAGELRDREMDLKAQMSALIDKNKEMSKAESEAGDIGPVVTEVDIQHIVSSWTGIPVDKVSADESDRLLKMEETLHTRVVGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVSEELKQYFRPEFLNRLDEMIVFRQLTKLEVKEIADIMLKEVFERLKVKEIELQVTERFRDRVVDEGYNPSYGARPLRRAIMRLLEDSMAEKMLAREIKEGDSVIVDVDSDGNVMVLNGASGTPPEPSPEPLTV

SEQ ID NO: 10953 - protein, 925 aa, Lactuca sativa
MAGALVQSTSFPSTVAGDRKVRSKRSGNTKGEIKMMYSVQTPHMSVRSFSGLRGTNALDNLVKRGQDFHSKVAAATSVRKAKPSRIVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPNNIRTQVIRMVGESAEAVGAGVGGGSSNNKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALVAAAQLSYQYISDRFLPDKAIDLVDEAGSRVRLRHAQLPEEARELEKELRQITKEKNEAVRGQDFEKAGELRDREMDLKTQISALVDKNKEMSKAETEAGEEGPIVTEVDIQHIVSSWTGIPVDKVSTDESERLLKMEETLHKRIIGQDEAVVAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFERLKVKEIELQVTERFRDRVVEEGYNPSYGARPLRRAIMRLLEDSMAEKMLAREIKEGDSVIVDVDSDGNVTVLNGGTGAAPPPEALPEAIGV

SEQ ID NO: 10954 - protein, 925 aa, Triphysaria pusilla
MSHALLQSTTLPSSVGLANNGKVKGSNKTRNTATMLSSTQSAPMRMRGFSGLRGANALDFLVSQNRQTLQSKVEAATSPMKRGRKTRMAPRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGESAEAVGAGVGGGSSGNKMPTLEEYGTNLTKLAEEGKLDPVVGRQAQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDESLVAAAQLSYQYISDRFLPDKAIDLVDEAGSRVRLRHAQLPEEARELEKELRQITKEKNEAVRGQDFEKAGELRDREMDLKAQMSALIDKNKEMSKAESEAGDIGPIVTEVDIQHIVSSWTGIPVDKVSADESDRLLKMEETLHTRVVGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVSEELKQYFRPEFLNRLDEMIVFRQLTKLEVKEIADIMLKEVFERLKVKEIELQVTERFRDRVVDEGYNPSYGARPLRRAIMRLLEDSMAEKMLAREIKEGDSVIVDVDSDGNVMVLNGASGTPPEPSPEPLAV

SEQ ID NO: 10955 - protein, 923 aa, Beta vulgaris
MAGGLIQSTTIPASFAYQRNGQFQRSGKGKQGVKMMASLQAPGYRMRNFSGLRGGNALDTLGSTSECFYSKMRAVLSVRKGTASRGVVRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGENTEAVGAGVGGGTTGNKMPTLEEYGTNLTKLAEEGKLDPVVGRQPQIERVTQILGRRTKNNPCLIGEPGVGKTAIAEGLAQRIATGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALVAAAQLSYQYISDRFLPDKAIDLIDEAGSRVRLEHAQLPEEARELEKELRQLTKEKNESVRSQDFEKAGELRDREMDLKAQISALIEKNKEMSKAETEAGDVGPIVTETDIQHIVSSWTGIPVEKVSTDESDRLLKMEETLHTRVVGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFERLKNKDIELQVTERFRDRVVDEGYNPSYGARPLRRAIMRLLEDSMAEKMLAREIKEGDSVIVDVDSEGNVIVLNGSSGAPPETLPEVITV

SEQ ID NO: 10956 - protein, 921 aa, Setaria italica
MAGTLLQSVALGTTFGGRISTQRWRSHGTRRPASMLAMSLSRPVKMSAFVGLRSVHSFSVTPTVSNSRSAVASYRSSRRTRRSRFVTRAMFERFTEKAIKVIMLAQEEARRLGHNFVGTEQILLGLIGEGTGIAAKVLKSMGINLKDARVEVEKIIGRGNGFVAVEIPFTPRAKRVLELSLEEARQLGHNYIGSEHLLLGLLREGEGVAARVLESLGADPSNIRTQVIRMIGETTEAVGAGVGGGSSGNKMPTLEEYGTNLTKLAEEGKLDPVVGRQPQIERVVQILGRRTKNNPCLIGEPGVGKTAIAEGLAQRISTGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIEILRGLRERYEIHHKLRYTDEALIAAAKLSYQYISDRFLPDKAIDLIDEAGSRVRLQHAQVPEEARELDKELKQVTKQKNEAVRSQDFEKAGELRDREMELKAQITAFIDKSKEMSKAEEESGETGPMVNEADIQHIVSSWTGIPVEKVSSDESDKLLKMEETLHKRVIGQDEAVVAISRSIRRARVGLKNPNRPIASFIFAGPTGVGKSELAKALAAYYFGSQEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDSDEKDSSYGRIKSLVIEEMKQYFRPEFLNRLDEMIVFRQLTKLEVKEIADIMLQEVFDRLKAKDINLQVTEKFKERVVDEGYNPSYGARPLRRAIMRLLEDSLAEKMLAGEVKEGDSAIVDVDSEGKVIVLNSQGGIPELPTPAVTV

SEQ ID NO: 10957 - protein, 921 aa, Setaria italica
MAGTLLQSVALGTTFGGRISTQRWRSHGTRRPASMLAMSLSRPVKMSAFVGLRSVHSFSVTPTVSNSRSAVASYRSSRRTRRSRFVTRAMFERFTEKAIKVIMLAQEEARRLGHNFVGTEQILLGLIGEGTGIAAKVLKSMGINLKDARVEVEKIIGRGNGFVAVEIPFTPRAKRVLELSLEEARQLGHNYIGSEHLLLGLLREGEGVAARVLESLGADPSNIRTQVIRMIGETTEAVGAGVGGGSSGNKMPTLEEYGTNLTKLAEEGKLDPVVGRQPQIERVVQILGRRTKNNPCLIGEPGVGKTAIAEGLAQRISTGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIEILRGLRERYEIHHKLRYTDEALIAAAKLSYQYISDRFLPDKAIDLIDEAGSRVRLQHAQVPEEARELDKELKQVTKQKNEAVRSQDFEKAGELRDREMELKAQITALIDKSKEMSKAEEESGETGPMVNEADIQHIVSSWTGIPVEKVSSDESDKLLKMEETLHKRVIGQDEAVVAISRSIRRARVGLKNPNRPIASFIFAGPTGVGKSELAKALAAYYFGSQEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDSDEKDSSYGRIKSLVIEEMKQYFRPEFLNRLDEMIVFRQLTKLEVKEIADIMLQEVFDRLKAKDINLQVTEKFKERVVDEGYNPSYGARPLRRAIMRLLEDSLAEKMLAGEVKEGDSAIVDVDSEGKVIVLNSQGGIPELPTPAVTV

SEQ ID NO: 10958 - protein, 430 aa, Triphysaria pusilla
MLSSTQTAPMRMRGFSGLRGANALDFLVSQNRQTLQSKVEAATSPMKRGRKSRMAPRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGESAEAVGAGVGGGSSGNKMPTLEEYGTNLTKLAEEGKLDPVVGRQAQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDES

SEQ ID NO: 10959 - protein, 922 aa, Phaseolus vulgaris
MARVLAQSVTVPGLVAEHRHGQQKGSGKLKRPAKMMSAVRTNGLRMSGFTGLRTFNPLDTMLRPGIDFRSKVSIATSARRGRATRCVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPTNIRTQVIRMVGESADSVTATVGSGSSGNKMPTLEEYGTNLTKLAEEGKLDPVVGRQQQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALVAAAQLSYQYISDRFLPDKAIDLIDEAGSRVRLQHAQLPEEARELDKEVRQIIKEKEEAVRNQDFEKAGELRDREMDLKAQISTLVEKGKEMSKAESEAGDEGPTVTEADIQHIVSSWTGIPVEKVSTDESDRLLKMEETLHKRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLNEVFNRLKVKDIELQVTERFRDRVVEEGYNPSYGARPLRRAIMRLLEDSMAEKMLAREIKEGDSVIVDVDSDGNVIVLNGNSGAPETLPEALPV

SEQ ID NO: 10960 - protein, 924 aa, Castanea mollissima
MARVLLQSANVPGLVANQRRNQSKGFGKAKRSVKMMSSLQAPGLRMGSFSGLRSVNALDTLVKPGIDLHSKVRIAINSRQGRGSRCVARAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGESPEAVAAGVAGGSSGNKMPTLEEYGTDLTKLAVEGKLDPVIGRQAQIERVTQILGRRTKNNPCLIGEPGVGKTAIAEGLAQRIATGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALVSAAQLSYQYISDRFLPDKAIDLIDEAGSRVRLRHAQLPEEARELEKELRQITKEKNEAVRSQDFEKAGELRDREMDLKAQISALVDKGKEMSKAETEAGDVGPLVTELDIQHIVSSWTGIPVEKVSTDESDRLLKMEETLHKRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKDIADIMLKEVFERLKTKEIELQVTERFRDRVVDEGYNPSYGARPLRRAIMRLLEDSMAEKMLAREIKEGDSVIVDVDTDGNVTVLKGSSGSPESLPEPEPIPV

SEQ ID NO: 10961 - protein, 921 aa, Pennisetum glaucum
MAGTLLQSVALGTTFAGRISTQRWRSHGTRRPVSMLAMSLSRPVKMSAFVGLRSVHSFSVTPTVSNSRSTVASYRSSRRTRRSRFVTRAMFERFTEKAIKVIMLAQEEARRLGHNFVGTEQILLGLIGEGTGIAAKVLKSMGINLKDARVEVEKIIGRGNGFVAVEIPFTPRAKRVLELSLEEARQLGHNYIGSEHLLLGLLREGEGVAARVLESLGADPSNIRTQVIRMIGETTEAVGAGVGGGSSGNKMPTLEEYGTNLTKLAEEGKLDPVVGRQPQIERVVQILGRRTKNNPCLIGEPGVGKTAIAEGLAQRISTGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIEILRGLRERYEIHHKLRYTDEALIAAAKLSYQYISDRFLPDKAIDLIDEAGSRVRLQHAQVPEEARELDKELKQITKQKNEAVRSQDFEKAGELRDREMELKTQITALIDKSKEMSKAEEESGETGPMVNEADIQHIVSSWTGIPVEKVSSDESDKLLKMEETLHKRVIGQDEAVVAISRSIRRARVGLKNPNRPIASFIFAGPTGVGKSELAKALATYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDSDEKDSSYGRIKSLVIEEMKQYFRPEFLNRLDEMIVFRQLTKLEVKEIADIMLQEVFDRLKAKDINLQVTEKFKERVVDEGYNPSYGARPLRRAIMRLLEDSLAEKMLAGEVKEGDSAIVDVDSEGKVIVLNSQGGIPELPTPAVTV

SEQ ID NO: 10962 - protein, 924 aa, Quercus alba
MARVLLQSANVPGLVANQRRNQSKGFGKAKRSVKMMSSLQAPGLRMGSFSGLRSVNALDTLVKPGIDLHSKVRIAINSRQGRGSRCVARAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGESPEAVAAGVAGGSSGNKMPTLDEYGTDLTKLAVEGKLDPVIGRQAQIERVTQILGRRTKNNPCLIGEPGVGKTAIAEGLAQRIATGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALVSAAQLSYQYISDRFLPDKAIDLIDEAGSRVRLRHAQLPEEARELEKELRQITKEKNEAVRSQDFEKAGELRDREMDLKAQISALVDKGKEMSKAETEAGDVGPLVTELDIQHIVSSWTGIPVEKVSTDESDRLLKMEETLHKRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKDIADIMLKEVFERLKTKEIELQVTERFRDRVVDEGYNPSYGARPLRRAIMRLLEDSMAEKMLAREIKEGDSVIVDVDSDGNVTVLKGSSGSPESLPEPEPIPV

SEQ ID NO: 10963 - protein, 922 aa, Glycine max
MARVLAQSVNVPGLVAEHRHGQQKGSGKLKRSTKMMSALRTNGLRMSGFSGLRTFNPLDTMLRPGIDFHSKVSIATSSRQARATRCVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPTNIRTQVIRMVGESADSVTATVGSGSSGNKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALVAAAQLSYQYISDRFLPDKAIDLIDEAGSRVRLQHAQLPEEARELDKEVRQIIKEKEEAVRNQDFEKAGELRDREMDLKAQISTLVEKGKEMSKAETEAGDEGPIVTEADIQHIVSSWTGIPVEKVSTDESDRLLKMEETLHKRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDYDEKDSSYNRIKSLVTEELKQYFRPEFLNRLDEMIVFRQLTKLEVKEIADIMLKEVFDRLKVKDIELQVTERFRDRVVEEGYNPSYGARPLRRAIMRLLEDSMAEKMLAREIKEGDSVIVDVDSDGNVIVLNGSSGAPESLPETLPV

SEQ ID NO: 10964 - protein, 921 aa, Panicum virgatum
MAGTLLQSVALGTTFAGRISTQQLRSHGARRPVSMLAMSLSRPVKMSAFVGLRSVHSFSITPTVSNSRSAVASYRSSRRTRRSRFVTRAMFERFTEKAIKVIMLAQEEARRLGHNFVGTEQILLGLIGEGTGIAAKVLKSMGINLKDARVEVEKIIGRGNGFVAVEIPFTPRAKRVLELSLEEARQLGHNYIGSEHLLLGLLREGEGVAARVLESLGADPSNIRTQVIRMIGETTEAVGAGVGGGSSGNKMPTLEEYGTNLTKLAEEGKLDPVVGRQPQIERVVQILGRRTKNNPCLIGEPGVGKTAIAEGLAQRISTGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIEILRGLRERYEIHHKLRYTDEALIAAAKLSYQYISDRFLPDKAIDLIDEAGSRVRLQHAQVPEEARELDKELKQITKQKNEAVRSQDFEKAGELRDREMELKAQITALIDKSKEMSKAEEESGETGPMVNEADIQHIVSSWTGIPVEKVSSDESDKLLKMEETLHRRVIGQDEAVVAISRSIRRARVGLKNPNRPIASFIFAGPTGVGKSELAKTLAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDSDEKDSSYGRIKSLVIEEMKQYFRPEFLNRLDEMIVFRQLTKLEVKEIADIMLQEVFDRLKAKDINLQVTEKFKERVVDEGYNPSYGARPLRRAIMRLLEDSLAEKMLAGEVKEGDSAIVDVDSEGKVVVLNGQGGIPELSTPAVAV

SEQ ID NO: 10965 - protein, 922 aa, Cajanus cajan
MARVLAQSINVPGVVAEHRHGQHKGSGKLKRSTKMMSALRTNGLRMSGFSGLRTFNPLDTMLRPGIDFHSKVSIATSSRRAKATRCVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPTNIRTQVIRMVGESADSVTATVGSGSSGNKMPTLEEYGTNLTKLAEEGKLDPVVGRQQQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALVAAAQLSYQYISDRFLPDKAIDLIDEAGSRVRLQHAQLPEEARELDKEVRQIIKEKEEAVRNQDFEKAGELRDKEMDLKAQISTLVEKGKEMSKAESEAGDEGPIVTEADIQHIVSSWTGIPVEKVSTDESDRLLKMEETLHKRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFDRLKVKDIELQVTERFRDRVVEEGYNPSYGARPLRRAIMRLLEDSMAEKMLAREIKEGDSVIVDVDSDGNVIVLNGSSGTPESLPEALPV

SEQ ID NO: 10966 - protein, 668 aa, Triphysaria pusilla
MSHALLQSTTLPSSVGLANNGKVKGSNKTRNTATMLSSTQSAPMRMRGFSGLRGANALDFLVSQNRQTLQSKVEAATSPMKRGRKTRMAPRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGESAEAVGAGVGGGSSGNKMPTLEEYGTNLTKLAEEGKLDPVVGRQAQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDESLVAAAQLSYQYISDRFLPDKAIDLVDEAGSRVRLRHAQLPEEARELEKELRQITKEKNEAVRGQDFEKAGELRDREMDLKAQMSALIDKNKEMSKAESEAGDIGPIVTEVDIQHIVSSWTGIPVDKVSADESDRLLKMEETLHTRVVGQDEAVKAISRAIRRARVGLKNPNRPIASFIFSGPTGVGKSELAKALAAYYLDPKRP

SEQ ID NO: 10967 - protein, 921 aa, Musa acuminata
MARPLFKSSVLPDAVSGSVPLFQGSGKARKPANMMCSRRSSQLRFLGFTGLKGSNDLHLVSGPSKDFRLAVSASVSAPKGKASRGVAVAMFERFTEKAIKVIMLAQEEARRLGHNFVGTEQILLGLIGEGTGIAAKVLKSMGINLKDARIEVEKIIGRGSGFVAVEIPFTPRAKRVLELSLEEARQLGHNYIGSEHLLLGLLREGEGVAARVLENLGADTSNIRTQVIRMVGESTEAVGAGVGGGSSGNKMPTLDEYGTNLTKLAEEGKLDPVVGRQQQIERVVQILGRRTKNNPCLIGEPGVGKTAIAEGLAQRIVTGDVPETIEGKKVITLDMGLLVAGTKYRGEFEERIKKLMEEIKQSDEIILFIDEVHTLIGAGAAEGAIDAANILKPALARGELQCIGATTLDEYRKHIEKDPALERRFQPVKVPEPTVDETIEILRGLRERYEIHHKLRYTDEALIAAAHLSYQYISDRFLPDKAIDLVDEAGSRVRLRHAQLPEDARELDKELRRITKEKNEAVRGQDFEKAGELRDREMELKAQISALVDKGKERSQAESEAGEGGPVVTEADIQHIVSSWTGIPVEKVSSDESDRLLKMEETLHKRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLYDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVREIADIMLKEVFERVKAKDIELQVTERFRDRVVEEGYSPSYGARPLRRAIMRLLEDSMAEKMLAGEIKEGDSAIVDVDADGNVTVLNGRTGLPEQLPPAIPV

SEQ ID NO: 10968 - protein, 924 aa, Ricinus communis
MARLLVHSINVPALAPHIKHGQSQESGTSRRTATKMMCSSRLPALTLRGYTGLRSSNCLDTMLRSGLDFHSRVAITMSRRQQKAKRFLPRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGESTENIPAPVGPGGGSNKMPTLEEYGTNLTKLAEEGKLDPVVGRQPQIERVIQILGRRTKNNPCLIGEPGVGKTAIAEGLAQRIASGDVPETIERKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPSVDETIQILKGLRERYEIHHKLRYTDEALVAAAQLSYQYISDRFLPDKAIDLIDEAGSRVRLRHAQVPEEARELEKEVRQITKEKDEAVRSQDFEKAGELRDREMDLRAQIAAIVEKGKEMSKAETEAGDVGPLVNESDIQHIVSSWTGIPVEKVSTDESDRLLKMEETLHKRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFDRLKVKDIELQVTERFRERVVEEGYNPSYGARPLRRAIMRLLEDSMAEKMLAGEIKEGDSVIVDVDSDGNVIVLNGSSGSPEALPDVLSVV

SEQ ID NO: 10969 - protein, 922 aa, Tripterygium wilfordii
MARVLVHSTNVPALVPGRRLGQSQGSGKARSVKMMCAFRVPRVTMSGFSGLRGVNSLDFMFRSAEDFHSKVNRSINFRRAKPSRCVTKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGESNENAVGVTPGGGGSNKMPTLEEYGTNLTKMAEEGKLDPVVGRQPQIERVVQILGRRTKNNPCLIGEPGVGKTAIAEGLAQRIASGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPSVDETIQILRGLRERYEIHHKLRYTDEALDSAAKLSYQYISDRFLPDKAIDLIDEAGSRVRLRHAQLPEEARELEKELRQITKEKNEAVRSQDFEKAGELRDREMDLKAQISALVDKGKEMSKAESEAGDVGPVVTEVDIQHIVSSWTGIPVEKVSSDESDRLLKMEETLHKRVVGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRMGFDMDYDDKDSSYNRIKSLVTEELKQYFRPEFLNRLDEMIVFRQLTKLEVKEIADIMLKEVFERLKVKEIELQVTERFRDRVVDEGYNPSYGARPLRRAIMRLLEDSMAEKMLAREIKEGDSVIVDVDSDGNVTVLNGSSGAPESLPDALSVV

SEQ ID NO: 10970 - protein, 925 aa, Solanum lycopersicum
MARALVQSTNILPSVAGERAGQFNGSRKDQRTVRMLCNVKCSSSRLNNFAGLRGCNALDTLLVKSGETLHSKVAAATFVRRPRGCRFVPKAMFERFTEKAIKVIMLAQEEARRLGHNFVGTEQILLGLIGEGTGIAAKVLKSMGINLKDARVEVEKIIGRGSGFIAVEIPFTPRAKRVLELSLEEARQLGHNYIGSEHLLLGLLREGEGVAARVLENLGADPTNIRTQVIRMVGESSEAVGASVGGGTSGLKMPTLEEYGTNLTKLAEEGKLDPVVGRQAQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPSVDETIQILKGLRERYEIHHKLHYTDEAIEAAAKLSHQYISDRFLPDKAIDLIDEAGSRVRLRHAQLPEEARELEKELRQITKEKNESVRGQDFEKAGELRDREMDLKAQISALIDKNKEKSKAESEAGDAAGPIVTEADIQHIVSSWTGIPVEKVSTDESDRLLKMEETLHTRVIGQDEAVKAISRAIRRARVGLKNPNRPIASFIFSGPTGVGKSELAKSLATYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDFDEKDSSYNRIKSLVTEELKQYFRPEFLNRLDEMIVFRQLTKLEVKEIADIMLKEVFVRLKNKEIELQVTERFRDRVVDEGYNPSYGARPLRRAIMRLLEDSMAEKMLAGEIKEGDSVIVDVDSDGNVTVLNGSSGAPSDSAPEPILV

SEQ ID NO: 10971 - protein, 922 aa, Cedrus atlantica
MAGALAQSAILPGRIISTKHGQIQNSKRGKRVPKMIGKVHSRSFSMQSFTGLRQETCIDKVGSRVKDFHTTVAASIRLPVGKGNRGVVVAMFERFTEKAIKVIMLAQEEARRLGHNFVGTEQILLGLIGEGTGIAAKVLKSMGINLKEARVEVEKIIGRGSGFVAVEIPFTPRAKRVLELSLEEARQLGHNYIGSEHLLLGLLREGEGVAARVLENLGADPSNIRTQVIRMVGESTEAVGAGVGGGSSSNKMPTLEEYGTNLTKLAEEGKLDPVVGRQPQIERVTQILGRRTKNNPCLIGEPGVGKTAIAEGLAQRIASGDVPETIEGKKVITLDMGLLVAGTKYRGEFEERLKKLMEEIKQSDEIILFIDEVHTLIGAGAAEGAIDAANILKPSLARGELQCIGATTLDEYRKHIEKDPALERRFQPVQVPEPTVDETIQILKGLRERYEIHHKLRYTDEALVAAAKLSYQYISDRFLPDKAIDLIDEAGSRVRLRHAQLPEEARELDKELRQITKEKNEAVRGQDFEKAGELRDREMELKAQISALTEKGKEKSKAESEAGDAGPLVTEVDIQQIVCAWTGIPVEKVSTDESDKLLKMEETLHQRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRGIGFQLDYDEKDSSYTRIKSLVNEELKQYFRPEFLNRLDEMIVFRQLTKTEVKEIADIMLREVFERLKTKEIDLQVTERFTDRVVDEGYSPSYGARPLRRAIMRLLEDSLAEKMLAGEIKEGDSAIVDVDGEGNVIVLNGKTGTVGPSAAALAA

SEQ ID NO: 10972 - protein, 922 aa, Glycine max
MARVLAQSINVPGLLAEHRHGQQKESGKLKRSTKMMSALRTNGLRMSGFSGLRTFNPLDTMLRPGIDFHSKVSIATSSRRARATRCVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPTNIRTQVIRMVGESADSVTATVGSGSSGNKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALVAAAQLSYQYISDRFLPDKAIDLIDEAGSRVRLQHAQLPEEARELDKEVRQIIKEKEEAVRNQDFEKAGELRDREMDLKAQISTLVEKGKEMSKAESEAGDASPVVTEADIQHIVSSWTGIPVEKVSTDESDRLLKMEETLHKRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDYDEKDSSYNRIKSLVTEELKQYFRPEFLNRLDEMIVFRQLTKLEVKEIADIMLKEVFERLKVKDIELQVTERFRDRVVEEGYNPSYGARPLRRAIMRLLEDSMAEKMLAREIKEGDSVIVDVDSDGNVIVLNGSSGAPESLPEALPV

SEQ ID NO: 10973 - protein, 923 aa, Tripterygium wilfordii
MERVLVHSTNVPALVPGQRLGQSQGPGKLRSVKMMCCAVQVPRVTMRGFSGLRGVNSLDFMSRSAEDFHSKVNRSINFRCAKPSRCVTKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGESNENAVGVTPGGGGSNKMPTLEEYGTNLTKLAEEGKLDPVVGRQPQIERVVQILGRRTKNNPCLIGEPGVGKTAIAEGLAQRIASGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPSVDETIQILKGLRERYEIHHKLRYTDEALESAAKLSYQYISDRFLPDKAIDLIDEAGSRVRLRHAQLPEEARELEKELRQITKEKNESVRSQDFEKAGELRDREMDLKAQISALVDKGKEMSKAESEAGDVGPVVTEVDIQHIVSSWTGIPVEKVSSDESDRLLKMEETLHKRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRMGFDMDYDDKDSSYNRIKSLVTEELKQYFRPEFLNRLDEMIVFRQLTKLEVKEIADIMLKEVFERLKVKEIELQVTERFRDRVVEEGYNPSYGARPLRRAIMRLLEDSMAEKMLAREIKEGDSVIVDVDSDGNVTVLNGSSGAPESLPDALSVV

SEQ ID NO: 10974 - protein, 919 aa, Vinca minor
MARALAHFSNLPSVVTGGHGQHRGSGRSTRAVRMLCNAYAAPLRMSSFSGLRASNALDTMARSGQTLHSLVANAPFGRRAGWRKAARMVPRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGESAEAVGAGVGGGSSSNKMPTLEEYGTNLTKLAEEGKLDPVVGRQDQIERVTQILGRRTKNNPCLIGEPGVGKTAIAEGLAQRIANGDVPETIEGKKVITLDMGLLVAGTKYRGEFEERLKKLMEEVKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALVAAAQLSYQYISDRFLPDKAIDLIDEAGSRVRLRHAQLPEEARELEKELRQITKEKNEAVRSQDFEKAGELRDRETDLKAQISALIDKNKEMSKAESEAGDEGPLVTERDIQHIVSSWTGIPVEKVSTDESDRLLKMEETLHTRVVGQDEAVKAISRAIRRARVGLKNPNRPIASFIFSGPTGVGKSELAKALAAYYFGSEESMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFERLKKKDIKLDVTERFKERVVEEGYNPSYGARPLRRAIMRLLEDSMAEKMLAREIKEGDSVIVDVDSDGNVTVLNGDLEAKPAAV

SEQ ID NO: 10975 - protein, 922 aa, Theobroma cacao
MAKVLAQSTIVPALVTSRSHGPSKESSKSKGSAKMMCSLQTPGLRIRSFSGLRGSNSLDNMVRFGQDFRSKVAISISSRRGRGSRCVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGEGNEVSVVPGGSTGNTKMPTLEEYGTNLTKLAEEGKLDPVVGRQVQIERVVQILGRRTKNNPCLIGEPGVGKTAIAEGLAQRIASGDVPDTIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPSVDETIQILKGLRERYEIHHKLRYTDDALISAAQLSYQYISDRFLPDKAIDLIDEAGSRVRLRHAQLPEEARELEKELRQITKSKNEAVRSQDFEKAGELRDREIELRAQITAIQEKDKEMNKAEAEAGEGGPVVTEVDIQHIVSAWTGIPVEKVSTDESDRLLKMEETLHKRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFDRLKAKEIELQVTERFRERVVEEGYNPSYGARPLRRAIMRLLEDSMAEKMLAREIKEGDSVIVDVDSDGNVTVLNGSSGAPESLADPIPVV

SEQ ID NO: 10976 - protein, 694 aa, Solanum lycopersicum
MVGESSEAVGASVGGGTSGLKMPTLEEYGTNLTKLAEEGKLDPVVGRQAQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPSVDETIQILKGLRERYEIHHKLHYTDEAIEAAAKLSHQYISDRFLPDKAIDLIDEAGSRVRLRHAQLPEEARELEKELRQITKEKNESVRGQDFEKAGELRDREMDLKAQISALIDKNKEKSKAESEAGDAAGPIVTEADIQHIVSSWTGIPVEKVSTDESDRLLKMEETLHTRVIGQDEAVKAISRAIRRARVGLKNPNRPIASFIFSGPTGVGKSELAKSLATYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDFDEKDSSYNRIKSLVTEELKQYFRPEFLNRLDEMIVFRQLTKLEVKEIADIMLKEVFVRLKNKEIELQVTERFRDRVVDEGYNPSYGARPLRRAIMRLLEDSMAEKMLAGEIKEGDSVIVDVDSDGNVTVLNGTSGAPSDSAPEPILV

SEQ ID NO: 10977 - protein, 141 aa, Primula obconica
GSGKSKKDVKTMCMLQATPLRLRSFSGLRGSNALDTVSRPSQDFFSTVEAALSVRGGKTRRVAAKAMFERFTEKAIKVIMLAQEEARRLGHNFVGTEQILLGLIGEGTGIAAKVLKSMGINLKEARVEVEKIIEGAVALLL

SEQ ID NO: 10978 - protein, 920 aa, Brachypodium distachyon
MAGTLLLPVALGSTFAGRASGQRWKSHGTRRPASMLAMSLNRPVRMAAFVGLRSAHSFTATPASNYRSTVASYRSSRRGRRTRFVTRAMFERFTEKAIKVIMLAQEEARRLGHNFVGTEQILLGLVGEGTGIAAKVLKSMGINLKDARVEVEKIIGRGNGFVAVEIPFTPRAKRVLELSLEEARQLGHNYIGSEHLLLGLLREGEGVAARVLESLGADPSNIRTQVVRMIGETTEAVGAGVGGGSSGNKMPTLEEYGTNLTKLAEEGKLDPVVGRQPQIERVVQILGRRTKNNPCLIGEPGVGKTAIAEGLAQRISSGDVPETIEGKKVITLDMGLLVAGTKYRGEFEERLKKLMEEIKQSDEIILFIDEVHTLIGAGAAEGAIDAANILKPALARGELQCIGATTLDEYRKHVEKDPALERRFQPVKVPEPSVDETIEILRGLQERYEIHHKLRYTDDALIAAAKLSYQYISDRFLPDKAIDLIDEAGSRVRLRHAQVPEEARELDKELKQITKDKNEAVRGQDFEKAGELRDREMELKAQITALIDKSKEMIKAETDSGETGPMVTEADIQHIVSSWTGIPVEKVSTDESDKLLKMEETLHKRVIGQDEAVKAISRSVRRARVGLKNPNRPIASFIFAGPTGVGKSELAKALASYYFGSEEAMIRLDMSEFMERHTVSKLIGSPPGYVGYTEGGQLTEAVRRRPYSVVLFDEIEKAHPDVFNMMLQILEDGRLTDSKGRTVDFKNTLLIMTSNVGSSVIEKGGRKIGFDLDSDEKDSSYGRIKSLVVEEMKQYFRPEFLNRLDEMIVFRQLTKLEVKDIAEIMLLEVFNRLKAKEINLQVTEKFKERVVDEGYNPSYGARPLRRAIMRLLEDSLAEKILAGEVKEGDSAIVDVDSEGKVIVLNGESGLPELPTPAVTV

SEQ ID NO: 10979 - protein, 922 aa, Gossypium raimondii
MAKILAQSAIVPTLLSSRSHGASKESGKPKRSAKMMCSLQTPGLRIRSFSGLRGSNSLDNIVRYGQDFHSKVGISISSQRGRGSRCVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGEGNEVSVVTGGSGGNTKMPTLEEYGTNLTKLAEEGKLDPVVGRQDQIERVVQILGRRTKNNPCLIGEPGVGKTAIAEGLAQRIASGDVPDTIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPSVDETIQILKGLRERYEIHHKLRYTDEALISAAQLSYQYISDRFLPDKAIDLIDEAGSRVRLRHAQLPEEAKELEKELRQITKSKNEAVRSQDFEKAGELRDREIELRAQITAIQEKDKEMNKAEAEAGDGGPVVTEVDIQHIVSSWTGIPVEKVSTDESDRLLKMEETLHKRVIGQDEAVIAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFDRLKDKEIELQVTERFRERVVEEGYNPSYGARPLRRAIMRLLEDSMAEKMLAREIKEGDSVIVDVDSDGNVTVLNGSSGTPESLGDPISVV

SEQ ID NO: 10980 - protein, 921 aa, Zea mays
MAGTLLQSVALGTPFGGRMRTHCWRSHGTRRPASMLAVSLSRPVKMSAFVGLRSVHSFSVTPTVSNSRSAVASYRSSRQTRRSRFVTQAMFERFTEKAIKVIMLAQEEARRLGHNFVGTEQILLGLIGEGTGIAAKVLKSMGINLKDARVEVEKIIGRGNGFVAVEIPFTPRAKRVLELSLEEARQLGHNYIGSEHLLLGLLREGEGVAARVLESLGADPSNIRTQVIRMIGETTEAVGAGVGGGSSGNKMPTLEEYGTNLTKLAEEGKLDPVVGRQPQIERVVQILGRRTKNNPCLIGEPGVGKTAIAEGLAQRISTGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIEILRGLRERYEIHHKLRYTDEALIAAAKLSYQYISDRFLPDKAIDLIDEAGSRVRLQHAQVPEEARELDKELKQVTKQKNEAVRSQDFEKAGELRDREMELKAQITALIDKSKELSKAEEESGETGPMVNEEDIQHIVSSWTGIPVEKVSSDESDKLLKMEETLHKRVIGQDEAVVAISRSIRRARVGLKNPNRPIASFIFAGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDSDEKDSSYSRIKSLVIEEMKQYFRPEFLNRLDEMIVFRQLTKLEVKEIADIMLQEVFDRLKAKDINLQVTEKFKERVVDEGYNPSYGARPLRRAIMRLLEDSLAEKMLAGEVKEGDSAIVDVDSEGKVVVLNGQGGIPELSTPAITV

SEQ ID NO: 10981 - protein, 920 aa, Gossypium raimondii
MAKVLAQSTIVPSLVTSRSHGRSTGKSKRSVKMMSSLRTPGLRINSFSGLRGSTSLDNMVRVDQDFHSKVAISISSRRGRGSRCVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGEGNEVSVVTGGSTGNTKMPTLEEYGTNLTKLAEEGKLDPVVGRQDQIERVVQILGRRTKNNPCLIGEPGVGKTAIAEGLAQRIATGDVPDTIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPSVDETIQILKGLRERYEIHHKLRYTDEALISAAQLSYQYISDRFLPDKAIDLIDEAGSRVRLRHAQLPEEARELEKELRQITKSKNEAVRSQDFEKAGELRDREIELRAQITAIQEKDKEMNKAEAEAGDGGPLVTEVDIQHIVSSWTGIPVEKVSTDESDRLLKMEETLHKRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFDRLKSKEIELQVTERFRERVVEEGYNPSYGARPLRRAIMRLLEDSMAEKMLAREIKEGDSVIVDVDSDGNVTVLNGSSGTSESLTDPIPVV

SEQ ID NO: 10982 - protein, 917 aa, Catharanthus roseus
MAGALVQSTNLPSAVAGGYGQIKGFRKSGKSRAVKMLCPQNVAPLRIRSFSGLRGSTALDNMVKSGQSLHLKVANATSGRRKASRMAPRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGESAEAVAAGLGGGSSSNKMPTLEEYGTNLTKLAEEGKLDPVVGRQDQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPSVDETIQILKGLRERYEIHHKLRYTDEALVAAAQLSYQYISDRFLPDKAIDLIDEAGSRVRLRHAQLPEEARELEKELRQITKEKNEAVRSQDFEKAGELRDREMDLKAQISALIDKNKEMSKAESEAGEGGPTVTEMDIQHIVSSWTGIPVEKVSTDESDRLLKMEETLHTRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFDRLKKKDIKLDVTERFRERVVEEGYNPSYGARPLRRAIMRLLEDSMAEKMLAREIKEGDSVIVDVDSDGNVTVLNGDLEAQPAGV

SEQ ID NO: 10983 - protein, 920 aa, Gossypium hirsutum
MAKVLAQSTIVPSLVTSRSHGRSTGKSKRSVKMMSSLRTPGLRINSFSGLRGSASLDNMVRVDQDFHSKVAISISSQRGRGSRCVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGEGNEVSVVTGGSTGNTKMPTLEEYGTNLTKLAEEGKLDPVVGRQDQIERVVQILGRRTKNNPCLIGEPGVGKTAIAEGLAQRIATGDVPDTIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPSVDETIQILKGLRERYEIHHKLRYTDEALISAAQLSYQYISDRFLPDKAIDLIDEAGSRVRLRHAQLPEEARELEKELRQITKSKNEAVRSQDFEKAGELRDREIELRAQITAIQEKDKEMNKAEAEAGDGGPLVTEVDIQHIVSSWTGIPVEKVSTDESDRLLKMEETLHKRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFDRLKSKEIELQVTERFRERVVEEGYNPSYGARPLRRAIMRLLEDSMAEKMLAREIKEGDSVIVDVDSDGNVTVLNGSSGTSESLTNPIPVV

SEQ ID NO: 10984 - protein, 922 aa, Pinus taeda
MAGALAQSAILPGGIISRKHGQIQSSKRGKGVPKMIGKVHSRSFSMRSFTGLRQETCIDKVGSPLKDFHAAVAASVRLPVGRGNRGVVVAMFERFTEKAIKVIMLAQEEARRLGHNFVGTEQILLGLIGEGTGIAAKVLKSMGINLKEARVEVEKIIGRGSGFVAVEIPFTPRAKRVLELSLEEARQLGHNYIGSEHLLLGLLREGEGVAARVLENLGADPSNIRTQVIRMVGESTEAVGAGVGGGSSSNKMPTLEEYGTNLTKLAEEGKLDPVVGRQPQIERVTQILGRRTKNNPCLIGEPGVGKTAIAEGLAQRIASGDVPETIEGKKVITLDMGLLVAGTKYRGEFEERLKKLMEEIKQSDEIILFIDEVHTLIGAGAAEGAIDAANILKPSLARGELQCIGATTLDEYRKHIEKDPALERRFQPVQVPEPTVDETIQILKGLRERYEIHHKLRYTDESLVAAAKLSYQYISDRFLPDKAIDLIDEAGSRVRLRHAQLPEEARELDKELRQITKEKNEAVRGQDFEKAGELRDREMELKAQISALTEKGKEKSKAESEAGDASPLVTEVDIQQIVCAWTGIPVEKVSTDESDKLLKMEETLHQRIVGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRGIGFQLDYDEKDSSYTRIKSLVNEELKQYFRPEFLNRLDEMIVFRQLTKTEVKEIADIMLKEVFERLKTKEIDLQVTERFTDRVVDEGYSPSYGARPLRRAIMRLLEDSLAEKMLAGEIKEGDSAIVDVDSEGNVIVLNGKTGTVGPSATALAA

SEQ ID NO: 10985 - protein, 922 aa, Pseudotsuga menziesii
MAGALAQSAILPGRIISTKHGQIQSSKRGKGVPKMIRKVHSRSFSMQSFTGLRQEMCIDKAGSHVKDFHAAVAASICLPVGKGNRGVVVAMFERFTEKAIKVIMLAQEEARRLGHNFVGTEQILLGLIGEGTGIAAKVLKSMGINLKEARVEVEKIIGRGSGFVAVEIPFTPRAKRVLELSLEEARQLGHNYIGSEHLLLGLLREGEGVAARVLENLGADPSNIRTQVIRMVGESTEAVGAGVGGGSSSNKMPTLEEYGTNLTKLAEEGKLDPVVGRQPQIERVTQILGRRTKNNPCLIGEPGVGKTAIAEGLAQRIASGDVPETIEGKKVITLDMGLLVAGTKYRGEFEERLKKLMEEIKQSDEIILFIDEVHTLIGAGAAEGAIDAANILKPSLARGELQCIGATTLDEYRKHIEKDPALERRFQPVQVPEPTVDETIQILKGLRERYEIHHKLRYTDESLVAAAKLSYQYISDRFLPDKAIDLIDEAGSRVRLRHAQLPEEARELDKELRQITKEKNESVRSQDFEKAGELRDREMELKAQIAALTEKGKEKSKAESEAGNASPLVTEVDIQQIVCAWTGIPVEKVSTDESDKLLKMEETLHQRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRGIGFQLDYDEKDSSYTRIKSLVNEELKQYFRPEFLNRLDEMIVFRQLTKTEVKEIADIMLREVFERLKTKEIDLQVTERFTDRVVDEGYSPSYGARPLRRAIMRLLEDSLAEKMLAGEIKEGDSAIVDVDSEGNVIVLNGKTGTAGPSATALAA

SEQ ID NO: 10986 - protein, 922 aa, Picea glauca
MAGALAQSAILPGRIISTKHGQIQSSKRGKGIPKMIGKVHSRSFSMQSFTGLRRETCIDKVGTPVKDFHATVAASICLPVGKGHRGVVVAMFERFTEKAIKVIMLAQEEARRLGHNFVGTEQILLGLIGEGTGIAAKVLKSMGINLKEARVEVEKIIGRGSGFVAVEIPFTPRAKRVLELSLEEARQLGHNYIGSEHLLLGLLREGEGVAARVLENLGADPSNIRTQVIRMVGESTEAVGAGVGGGSSSNKMPTLEEYGTNLTKLAEEGKLDPVVGRQPQIERVTQILGRRTKNNPCLIGEPGVGKTAIAEGLAQRIASGDVPETIEGKKVITLDMGLLVAGTKYRGEFEERLKKLMEEIKQSDEIILFIDEVHTLIGAGAAEGAIDAANILKPSLARGELQCIGATTLDEYRKHIEKDPALERRFQPVQVPEPTVDETIQILKGLRERYEIHHKLRYTEEALVAAAKLSYQYISDRFLPDKAIDLIDEAGSRVRLRHAQLPEEARELDKELRQITKEKNESVRSQDFEKAGELRDREMELKAQISALTEKGKEKSKAESEAGDAGPLVTEVDIQQIVCAWTGIPVEKVSTDESDKLLKMEETLHQRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRGIGFQLDYDEKDSSYTRIKSLVNEELKQYFRPEFLNRLDEMIVFRQLTKTEVKEIADIMLKEVFERLKTKEIGLQVTERFTDRVVDEGYSPSYGARPLRRAIMRLLEDSLAEKMLAGEIKEGDSAIVDVDGEGNVIVLNGKTGTAGPSATALAA

SEQ ID NO: 10987 - protein, 915 aa, Tabernaemontana elegans
MAGALVQSTNLPSVVAAGGYGQIKGSGKSKRAAVKMLCTVYATPLRLTSFSGLRGSNALDTMVNSGQSLHLKVANATSGRRRARRMAPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGESAEAVAAGLGGGSSSNKMPTLEEYGTNLTKMAEEGKLDPVVGRQEQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVRVPEPTVDETIQILKGLRERYEIHHKLRYTDEALVAAAQLSYQYISDRFLPDKAIDLIDEAGSRVRLRHAQLPEEARELEKELRQITKEKNEAVRSQDFEKAGELRDREMDLKTQIAALIDKNKEMSKAESEAGDGGPIVTEVDIQHIVSAWTGIPVEKVSTDESDRLLKMEETLHRRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFDRLKKREIKLEVTERFRERVVEEGYNPSYGARPLRRAIMRLLEDSMAEKMLAREIKEGDSVIVDVDSDGNVTVLNGDAEPVAV

SEQ ID NO: 10988 - protein, 923 aa, Vinca minor
MARVLAQFTPSIVTGGHGQIRGNGRSTRAVRMLCNAYAAPLRMNSFSGLRASNALDTMARTGPSLHSLVANAPFGRRAGRRKANRMVPRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGESAEAVGAGVGGGSSGNKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDESLVAAAQLSYQYISDRFLPDKAIDLIDEAGSRVRLRHAQLPEEARELEKELRQITKEKNEAVRGQDFEKAGELRDREMDLKAQISALIDKNKEMSKAESEAGDSGPLVTEVDIQHIVSSWTGIPVEKVSTDESDRLLKMEETLHTRVVGQDEAVKAISRAIRRARVGLKNPNRPIASFIFSGPTGVGKSELAKALAAYYFGSEESMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFERLKKKDIKLDVTERFKERVVEEGYNPSYGARPLRRAIMRLLEDSMAEKMLAREIKEGDSVIVDVDSDGNVTVLNGDLDSKPVGDATPVGV

SEQ ID NO: 10989 - protein, 694 aa, Solanum phureja
MVGESSEAVGASVGGGTSGLKMPTLEEYGTNLTKLAEEGKLDPVVGRQAQIERVTQILGRRTKNNPCLIGEPGVGKTAIAEGLAQRIANGDVPETIEGKKVITLDMGLLVAGTKYRGEFEERLKKLMEEIKQSDDIILFIDEVHTLIGAGAAEGAIDAANILKPALARGELQCIGATTLDEYRKHIEKDPALERRFQPVKVPEPSVDETIQILKGLRERYEIHHKLRYTDEAIDAAAKLSHQYISDRFLPDKAIDLIDEAGSRVRLRHAQLPEEARELEKELRQITKEKNESVRGQDFEKAGELRDREMDLKAQISALIDKNKEKSKAESEAGDAAGPIVTEADIHHIVSSWTGIPVEKVSTDESDRLLKMEETLHTRVIGQDEAVKAISRAIRRARVGLKNPNRPIASFIFSGPTGVGKSELAKSLATYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDFDEKDSSYNRIKSLVTEELKQYFRPEFLNRLDEMIVFRQLTKLEVKEIADIMLKEVFVRLKNKEIELQVTERFRDRVVDEGYNPSYGARPLRRAIMRLLEDSMAEKMLAGEIKEGDSVIVDVDSDGNVTVLNGSSGAPSDPAPEPILV

SEQ ID NO: 10990 - protein, 922 aa, Gossypium raimondii
MAKILAQSAIVPTLLSSRSHGASKESGKPKRSAKMMCSLQTPGLRIRSFSGLRGSNSLDNIVRYGQDFHSKVGISISSRRGRGSRCVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGEGNEVSVVTGGSGGNTKMPTLEEYGTNLTKLAEEGKLDPVVGRQDQIERVVQILGRRTKNNPCLIGEPGVGKTAIAEGLAQRIASGDVPDTIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPSVDETIQILKGLRERYEIHHKLRYTDEALVSAAQLSYQYISDRFLPDKAIDLIDEAGSRVRLRHAQLPEEAKELEKELRQITKSKNEAVRSQDFEKAGELRDREIELRAQITAIQEKDKEMNKAEAEAGDGGPVVTEVDIQHIVSSWTGIPVEKVSTDESDRLLKMEETLHKRVIGQDEAVIAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFDRLKDKEIELQVTERFRERVVEEGYNPSYGARPLRRAIMRLLEDSMAEKMLARDIKEGDSVIVDVDSDGNVTVLNGSSGTPESLGDPISVV

SEQ ID NO: 10991 - protein, 914 aa, Amsonia hubrichtii
MAGALIQSTNLPSVVAAGGYGQIKGSGKSKRAVKMLCSVYAAPLRMRSFSGLRGSNALDTMVKSGQSLHLKVANATSTRRKASRMAPRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLDNLGADPSNIRTQVIRMVGESAEAVAAGLGGGSSSNKMPTLEEYGTNLTKLAEEGKLDPVVGRQEQIERVTQILGRRTKNNPCLIGEPGVGKTAIAEGLAQRIATGDVPETIEGKKVITLDMGLLVAGTKYRGEFEERLKKLMEEIRQSDEIILFIDEVHTLIGAGAAEGAIDAANILKPALARGELQCIGATTLDEYRKHIEKDPALERRFQPVKVPEPTVDETILILKGLRERYEIHHKLRYTDEALVSAAQLSYQYISDRFLPDKAIDLIDEAGSRVRLRHAQLPEEARELEKELRQITKEKNEAVRGQDFEKAGELRDREMDLKAQISALIDKNKEMSKAETEAGDGGPLVTEVDIQHIVSSWTGIPVEKVSTDESDRLLKMEETLHKRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFERLKKKDIKLDVTERFRERVVEEGYNPSYGARPLRRAIMRLLEDSMAEKMLAREIKEGDSVIVDVDSDGNVTVLNGDAEPVAV

SEQ ID NO: 10992 - protein, 927 aa, Prunus persica
MARVLVQSTNIPGVVAGRRLGQSKGSGNAKRTVKMCCTLRAPGLRISSFSGLRSVNALDIMAKPGQDFYSKMGVAITSRRKASRCVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPKSNHEKLCWCGQVIRMVGESTEAVGAGVGGGSSGNKMPTLEEYGTNLTKLAEEGKLDPVVGRQPQIERVVQILGRRTKNNPCLIGEPGVGKTAIAEGLAQRIATGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILRGLRERYEIHHKLRYTDEALVSAAQLSYQYISDRFLPDKAIDLIDEAGSRVRLRHAQLPEEARELEKERRQITKEKDEAVRSQDFEKAGELRDREKDLSAQISAVVDKGKEMSKAESEAGDVGPLVTEVDIQHIVSSWTGIPVEKVSTDESDRLLKMEETLHTRVVGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFERLRVKEIELQVTERFRDRVVDEGYNPSYGARPLRRAIMRLLEDSMAEKMLAREIKEGDSVIVDVDSDGNVTVLNGSSGSPESLPEAIPV

SEQ ID NO: 10993 - protein, 374 aa, Panax ginseng
MARALVQSTNFPSSVAGERNGQFKGSGKTKRTVKMMCTLRTVPIRIRGFSGLRGANALDAMVKSGHDFHSKVAAAISVRRGRASRSVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPNNIRTQVIRMVGESQEAGAVVGGGSSGNKMPTLEEYGTNLTKLAEEGKLDPVVGRQQQIERVTQILGRRTKNNPCLIGEPGVGKTAIAEGLAQRIATGDVPETIEGKKVITLDMGLLVAGTKYRGEFEERLKKLMEELNKVMKLYYLLMRCTH

SEQ ID NO: 10994 - protein, 656 aa, Vinca minor
MARALAQFTNLPSVVAGGHGQIRGSSRSTRAVTMLCNAYAAPLRMNNFSGLRAANALDTMARYGQSLHSLVANAPFGRRAGRRKASRMVPRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGAEPSNIRTQVIRMVGESAEAVAAVGGGSSGNKMPTLEEYGTNLTKLAEEGKLDPVVGRQAQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALVAAAQLSYQYISDRFLPDKAIDLIDEAGSRVRLRHAQLPEEAREIEKELRQITKEKNEAVRGQDFEKAGELRDREMDLKQQISALIDKNKEMSKAESEAGDSGPLVTEVDIQHIVSSWTGIPVDKVSADESDRLLKMEETLHTRVVGQDEAVKAISRAIRRARVGLKNPNGQLLASSSLDLLVWGSLNLLKH

SEQ ID NO: 10995 - protein, 693 aa, Citrus sinensis
MVGESTEAVGAGVGGGSSGNKMPTLEEYGTNLTKLAEEGKLDPVVGRQPQIERVVQILGRRTKNNPCLIGEPGVGKTAIAEGLAQRIASGDVPDTIEGKKVITLDMGLLVAGTKYRGEFEERLKKLMEEIKQSDEIILFIDEVHTLIGAGAAEGAIDAANILKPSLARGELQCIGATTLDEYRKHIEKDPALERRFQPVKVPEPSVDETIQILKGLRERYEIHHKLRYTDEALVSAAQLSYQYISDRFLPDKAIDLIDEAGSRVRLRHAQLPEEARELEKELRQITKEKNEAVRGQDFEKAGELRDREMDLKAQISALVDKGKEMSKAETEAGDVGPVVTEVDIQHIVSAWTGIPVEKVSTDESDRLLKMEETLHKRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFDRLKTKDIELQVTERFRERVVEEGYNPSYGARPLRRAIMRLLEDSMAEKMLAREIKEGDSVIVDVDSDGNVTVLNGSSGAPESLADPLPVV

SEQ ID NO: 10996 - protein, 922 aa, Abies balsamea
MAGALAQSAILPGRIISTKHGQIQSSKRGKRVPKMIGKVHSRPFSMQSFTGLRQETCIDKVGSRVKDFHAAVAASVCLPVGKGNRGVVVAMFERFTEKAIKVIMLAQEEARRLGHNFVGTEQILLGLIGEGTGIAAKVLKSMGINLKEARVEVEKIIGRGSGFVAVEIPFTPRAKRVLELSLEEARQLGHNYIGSEHLLLGLLREGEGVAARVLENLGADPSNIRTQVIRMVGESTEAVGAGVGGGSSSNKMPTLEEYGTNLTKLAEEGKLDPVVGRQPQIERVTQILGRRTKNNPCLIGEPGVGKTAIAEGLAQRIASGDVPETIEGKKVITLDMGLLVAGTKYRGEFEERLKKLMEEIKQSDEIILFIDEVHTLIGAGAAEGAIDAANILKPSLARGELQCIGATTLDEYRKHIEKDPALERRFQPVQVPEPTVDETIQILKGLRERYEIHHKLRYTDEALVAAAKLSYQYISDRFLPDKAIDLIDEAGSRVRLRHAQLPEEARELDKELRQITKEKNESVRSQDFEKAGELRDREMELKAQISSLTEKGKEKSKAESEAGDASPLVTEVDIQQIVCAWTGIPVEKVSTDESDKLLKMEETLHQRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRGIGFQLDYDEKDSSYTRIKSLVNEELKQYFRPEFLNRLDEMIVFRQLTKSEVKEIADIMLKEVFERLKTKEIDLQVTERFTDRVVDEGYSPSYGARPLRRAIMRLLEDSLAEKMLAGEIKEGDSAIVDVDGEGNVIVLNGKTGTAGSSATALAA

SEQ ID NO: 10997 - protein, 933 aa, Cucumis sativus
MARVLVQSTNIPGLVGGRKNGLTTRGSANVKRAVKMMSTAHSPGLRIRNFSGLRGFNSLDNMLRSRQNFHSKVATAISSRRRKASRCVPRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSKLFIFNLMFYKLSKQVIRMVGESTEAVGAGVGGGSSGNKMPTLEEYGTNLTKLAEEGKLDPVVGRQQQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPSVDETIQILKGLRERYEIHHKLRYTDEALVAAAQLSYQYISDRFLPDKAIDLVDEAGSRVRLRHAQLPEEARELEKELRQITKEKNEAVRSQDFEKAGELRDREMELKTKISALVDKGKEMSKAESEAGDVGPVVTEVDIQHIVSSWTGIPVEKVSTDESDRLLKMEETLHKRVIGQDEAVQAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRMGFDLDYDEKDSSYNRIKSLVTEELKQYFRPEFLNRLDEMIVFRQLTKLEVKEIADIMLKEVFDRLKAKEIDLQVTERFRDRVVEEGYNPSYGARPLRRAIMRLLEDSMAEKMLAREIKEGDSVIVDVDSDGNVTVLNGSSGAPESLPDAIPV

SEQ ID NO: 10998 - protein, 922 aa, Pinus pinaster
MAGALAQSAILPGGIISTKHGQIQSSKRGKGVPKMIGKVHSRSFSMRSFTGLRQETCIDKVGSPLKDFHAAVAASVRLPVGRGNRGVVVAMFERFTEKAIKVIMLAQEEARRLGHNFVGTEQILLGLIGEGTGIAAKVLKSMGINLKEARVEVEKIIGRGSGFVAVEIPFTPRAKRVLELSLEEARQLGHNYIGSEHLLLGLLREGEGVAARVLENLGADPSNIRTQVIRMVGESTEAVGAGVGGGSSSNKMPTLEEYGTNLTKLAEEGKLDPVVGRQPQIERVTQILGRRTKNNPCLIGEPGVGKTAIAEGLAQRIASGDVPETIEGKKVITLDMGLLVAGTKYRGEFEERLKKLMEEIKQSDEIILFIDEVHTLIGAGAAEGAIDAANILKPSLARGELQCIGATTLDEYRKHIEKDPALERRFQPVQVPEPTVDETIQILKGLRERYEIHHKLRYTDESLVAAAKLSYQYISDRFLPDKAIDLIDEAGSRVRLRHAQLPEEARELDKELRQITKEKNEAVRGQDFEKAGELRDREMELKAQISALTEKGKRKSKAESEAGDASPLVTEVDIQQIVCAWTGIPVEKVSTDESDKLLKMEETLHQRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRGIGFQLDYDEKDSSYTRIKSLVNEELKQYFRPEFLNRLDEMIVFRQLTKTEVKEIAHIMLKEVFERLKTKEIDLQVTERFTDRVVDEGYSPSYGARPLRRAIMRLLEDSLAEKMLAGEIKEGDSAIVDVDSEGNVTVLNGKTGTVGPSATALAA

SEQ ID NO: 10999 - protein, 925 aa, Papaver somniferum
MAGALVQSTNIRTSTFGKSHDKKQRGSSGSANRRTVKMLCNSVQMRGLRISAPSLTVGGFNGLRGTNAIDKLVFSGHDFHSKVALSIAAPRGRGSRCVARAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPNNIRTQVIRMVGESTEAVGAGVGGGSTNSKMPTLEEYGTNLTKLAEEGKLDPVVGRAAQIERVTQILGRRTKNNPCLIGEPGVGKTAIAEGLAQRIASGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDESIQILKGLRERYEIHHKLRYTDEALEAAARLSYQYISDRFLPDKAIDLIDEAGSRVRLRNAQLPEEARELEKELRQITKEKNEAVRGQDFEKAGELRDREMDLRAQITNVVDKGKELSKAESESGDTGPVVTEVDIQHIVASWTGIPVNKVSSDESDKLLKMEDTLHTRVIGQDEAVKAISRAIRRARVGLKNPNRPIASFIFSGPTGVGKSELAKTLASYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSNVIEKGGRRIGFDLDYDEKDSSYNRIKSLVQEELKQYFRPEFLNRLDEMIVFRQLTKLEVKEIADIMLKEVFERLRKKEIELQVTERFRDRVVDEGYNPSYGARPLRRAIMRLLEDSMAEKMLGGEIKEGDSVIVDVDGDGNVTVLNGTSPQLV

SEQ ID NO: 11000 - protein, 916 aa, Lolium multiflorum
MAGTLVLPVALGTTFAGRTKKSHGTRRPTSMLAMSLNRPVRMAGFGGLRSAHSFTTMPSSNFRSTAASYRSSRRGRRSRFVTRAMFERFTEKAIKVIMLAQEEARRLGHNFVGTEQVLLGLVGEGTGIAAKVLKSMGINLKDARVEVEKIIGRGNGFVAVEIPFTPRAKRVLELSLEEARQLGHNYIGSEHLLLGLLREGEGVAARVLESLGADPSNIRTQVVRMIGETTEAVGAGVGGGSSGNKMPTLEEYGTNLTKLAEEGKLDPVVGREPQIERVIQILGRRTKNNPCLIGEPGVGKTAIAEGLAQRISTGDVPETIEGKKVITLDMGLLVAGTKYRGEFEERLKKLMEEIKQSDEIILFIDEVHTLIGAGAAEGAIDAANILKPALARGELQCIGATTLDEYRKHVEKDPALERRFQPVKVPEPSVDETIEILRGLRERYEIHHKLHYTDDSLIAAAKLSYQYISDRFLPDKAIDLIDEAGSRVRLRHAQVPEEARELDKELKQITKDKNEAVRGQDFEKAGELRDREMELKAQITALIDKSKEMIKAETASGETGPMVHESDIQHIVSSWTGIPVEKVSTDESDKLLKMEETLHKRVIGQDEAVKAISRSVRRARVGLKNPNRPIASFIFAGPTGVGKSELAKTLASYYFGSEEAMIRLDMSEFMERHTVSKLIGSPPGYVGYTEGGQLTEAVRRRPYSVVLFDEIEKAHPDVFNMMLQILEDGRLTDSKGRTVDFKNTLLIMTSNVGSSVIEKGGRKIGFDLETDEKDSSYGRIKSLVVEEMKQYFRPEFLNRLDEMIVFRQLTKLEVKEIADIMLQEVFTRLKLKEINLQVTEKFKERVVDEGYNPSYGARPLRRAIMRLLEDSLAEKILAGEVKEGDSAIVDVDSEGKVVVLNGQSGLPELPTPAVTV

SEQ ID NO: 11001 - protein, 926 aa, Musa acuminata
MAGSLVQSAVLPAVIMNRSHSQLQGSGKAKRGARMICQLQMHPLRLQGFAGLRVADNLFSSRHRQDFHSVVSGYITNPRGRPSRLVTKAMFERFTEKAIKVIMLAQEEARRLGHNFVGTEQILLGLIGEGTGIAAKVLKSMGISLKDARVEVEKIIGRGSGFVAVEIPFTPRAKRVLELSLEEARQLGHNYIGSEHLLLGLLHEGEGVAARVLESLGADPSNIRTQANFCLVIRMVGESTEAVGAGVVGGSSGNKMPTLEEYGTNLTKLAEEGKLDPVVGRQEQIERVTQILGRRTKNNPCLIGEPGVGKTAIAEGLAQRIANGDVPETIEGKKVITLDMGLLVAGTKYRGEFEERLKKLMDEIKQSDDIILFIDEVHTLIGAGAAEGAIDAANILKPALARGELQCVGATTLDEYRKHIEKDPALERRFQPVKVPEPTVDEAIQILRGLRERYEIHHKLCYTDEAIVAAAQLSFQYISDRFLPDKAIDLIDEAGSRVRLRHAKLPEDARELDRELRQITKEKNEAVRSQYFEKAGELRDREMELKAQISALIDKGKERSKAESEAGVSGPVVTEADIQHIVSSWTGIPVEKVSTDESDRLLKMEETLHKRVIGQDEAVKAISRAIRRARVGLKNPNRPIASFIFSGPTGVGKSELAKSLASYYFGSEEAMIRLDMSEFMERHTVSKLIGSPPGYVGYTEGGQLTESVRRRPYTVVLFDEIEKAHPDVFNMMLQILEDGRLTDSKGRTVSFKSTLLIMTSNVGSSVIEKGGRRIGFDLDYDEKDSSYNRIKSLVTEELKQYFRPEFLNRLDEMIVFRQLTKLEVKEIADIMLEEVFDRLKGKDIKLQVTERFKDRVVEEGYNPSYGARPLRRAIMRLLEDSLAEKMLAREIKEGDSAIVDVDFDGNVTVLSGGTGTPESTPEAIPI

SEQ ID NO: 11002 - protein, 923 aa, Cicer arietinum
MARVLAQPINVPGLVAGHRQNQHKASGKSKRSVKMMCAFRTNRLRMPGFSGLRTFNHLDTMLRPGLDFHSKVSIAISSSRRARATRCIPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPTNIRTQVIRMVGESADSVTATVGSGSSNNKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALVAAAQLSYQYISDRFLPDKAIDLIDEAGSRVRLQHAQLPEEAKELDKEVRQIVKEKEEAVRNQDFEKAGELRDKEMDLKAQISSVVEKGKEMNKAESEAGDEGPLVTEVDIQHIVSSWTGIPVDKVSADESDRLLKMEDTLHKRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDYDEKDSSYNRIKSLVTEELKQYFRPEFLNRLDEMIVFRQLTKLEVKDIADIMLKEVFKRLETKDIELQVTERFRDRVVEEGYNPSYGARPLRRAIMRLLEDSMAEKMLAREIKEGDSVIVDVDSDGNVIVLNGSSGNPESLPEALPV

SEQ ID NO: 11003 - protein, 919 aa, Glycine max
MARVLVQSTGMPGLLSGQRHGKHKGSGKSKRSVKMMSTLRMPALRMSSFSGLRTLNPMDSLSRPRHTFPLNTTSRRERAKRCVPKAMFERFTEKAIKVIMLAQEEARRLGHNFVGTEQILLGLIGEGTGIAAKVLKSMGINLKDARVEVEKIIGRGSGFVAVEIPFTPRAKRVLEFSLEEARQLGHNYIGSEHLLLGLLREGEGVAARVLENLGADPNNIRAQVIRMVGEGADSVGATVGPGSSNNNKMPTLEEYGTNLTKLAEEGKLDPVVGRQQQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDDALVAAAQLSHQYISDRFLPDKAIDLIDEAGSRVRLQHAQLPEEARELDKEVRQIVKEKEEFVRNQDFEKAGELRDREMDLKAQISALIEKGKEMSKAESEAGDEGPMVTEVDIQHIVSSWTGIPVEKVSTDESDRLLKMEETLHKRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDYDEKDSSYNRIKSLVTEELKQYFRPEFLNRLDEMIVFRQLTKLEVKEIADIMLKEVFDRLKAKEIDLSVTERFRERVVDEGYNPSYGARPLRRAIMRLLEDSMAEKMLAREIKEGDSVIVDADSDGNVIVLNGSSGAPDSLEEALPV

SEQ ID NO: 11004 - protein, 502 aa, Manihot esculenta
MARLLVHSTNIPAIASGIKHGQSQESDTSRRTTTKMMCSSRSPTLILRGFSGLRSSNCLDTLLSSRHDFHSKVAITMSRRQQKAKRFSPRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGESTENIPATVGPGGGSNKMPTLEEYGTNLTKLAEEGKLDPVVGRQPQIERVIQILGRRTKNNPCLIGEPGVGKTAIAEGLAQRIASGDVPETIERKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPSVDETIQILKGLRERYEIHHKLRYTDEALVAAAQLSYQYISDRFLPDKAIDLIDEAGSRVRLRHAQA

SEQ ID NO: 11005 - protein, 332 aa, Cicer arietinum
MARVLAQPINVPGLVAGHRQNQHKASGKSKRSVKMMCAFRTNRLRMPGFSGLRTFNHLDTMLRPGLDFHSKVSIAISSSRRARATRCIPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPTNIRTQVIRMVGESADSVTATVGSGSSNNKMPTLEEYGTNLTKLAEEGKLDPVVGRQPQIERVTQILGRRTKNNPCLIGEPGVGKTAIAEGLAQRIANGDVPETIEGKRL

SEQ ID NO: 11006 - protein, 916 aa, Festuca arundinacea
MAGTLVLPVALGTTFAGRTKKSHGTRRPTSMLAMSLNRPVRMAGFGGLRSAHSFTTMPSSNFRSTAASYRSSRRGRRSRFVTRAMFERFTEKAIKVIMLAQEEARRLGHNFVGTEQVLLGLVGEGTGIAAKVLKSMGINLKDARVEVEKIIGRGNGFVAVEIPFTPRAKRVLELSLEEARQLGHNYIGSEHLLLGLLREGEGVAARVLESLGADPSNIRTQVVRMIGETTEAVGAGVGGGSSGNKMPTLEEYGTNLTKLAEEGKLDPVVGREPQIERVVQILGRRTKNNPCLIGEPGVGKTAIAEGLAQRIYSGDVPETIEGKKVITLDMGLLVAGTKYRGEFEERLKKLMEEIKQSDEIILFIDEVHTLIGAGAAEGAIDAANILKPALARGELQCIGATTLDEYRKHVEKDPALERRFQPVKVPEPSVDETIEILRGLRERYEIHHKLSYTDDSLIAAAKLSYQYISDRFLPDKAIDLIDEAGSRVRLRHAQVPEEARELDKELKQITKDKNEAVRGQDFEKAGELRDREMELKAQITALIDKSKEMIKAETASGETGPMVHESDIQHIVSSWTGIPVEKVSTDESDKLLKMEETLHKRVIGQDEAVKAISRSVRRARVGLKNPNRPIASFIFAGPTGVGKSELAKTLASYYFGSEEAMIRLDMSEFMERHTVSKLIGSPPGYVGYTEGGQLTEAVRRRPYSVVLFDEIEKAHPDVFNMMLQILEDGRLTDSKGRTVDFKNTLLIMTSNVGSSVIEKGGRKIGFDLETDEKDSSYGRIKSLVVEEMKQYFRPEFLNRLDEMIVFRQLTKLEVKEIADIMLQEVFTRLKLKEINLQVTEKFKERVVDEGYNPSYGARPLRRAIMRLLEDSLAEKILAGEVKEGDSAIVDVDSEGKVVVLNGQSGLPELPTPAVTV

SEQ ID NO: 11007 - protein, 922 aa, Medicago truncatula
MARVLAQSINVPGLVVGHKQSQHKGSGKSKRSVKMMCASRTIGLRMPGFSGLRTINHLDTMLRPGLDFHAKVSMAISSRRARAKRIIPRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPTNIRTQVIRMVGESADNVTATVGSGSSNNKTPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDDIILFIDEVHTLIGAGAAEGAIDAANILKPALARGELQCIGATTLDEYRKHIEKDPALERRFQPVKVPEPTVDETIQILKGLRERYEIHHKLRYTDDALIAAAQLSYQYISDRFLPDKAIDLIDEAGSRVRLQHAQLPEEAKELDKEVRKIVKEKEEFVRNQDFEKAGELRDKEMDLRAQISALVEKGKEMSKAESEAADEGPIVTEVDIQHIVSSWTGIPVDKVSADESDRLLKMEDTLHKRVIGQDEAVEAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLREVFQRLKNKEIELQVTERFRDRVVDEGYNPSYGARPLRRAIMRLLEDSMAEKMLAREIKEGDSVIVDVDSEGNVIVLNGTSGTQESLPEALAI

SEQ ID NO: 11008 - protein, 926 aa, Populus trichocarpa
MARLLVHSANIPAVAPCPRHCQYEESKKSRASSAKMMCSLPLRGLVISGYSGLRSANCLDTLLRHGHSFHSKVAITISPRQQKAKRFVPRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGESTENLAGSTVGPGSSNNKMPTLEEYGTNLTKLAEEGKLDPVVGRQPQIERVVQILGRRTKNNPCLIGEPGVGKTAIAEGLAQRIASGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPSVDETIQILKGLRERYEIHHKLRYTDEALIAAAQLSYQYISDRFLPDKAIDLIDEAGSRVRLRHAQVPEEARELEKEVRQITKEKDEAVRGQDFEKAGELRDREMDLRAQIAAIVEKGKEMSKAETEAGDVGPTVTESDIQHIVSSWTGIPVEKVSTDESNRLLKMEDTLHKRVIGQDEAVKAISRAIRRARVGLKNPNRPIASFIFSGPTGVGKSELAKALAAYYFGSEEAMIRLDMSEYMERHTVAKLIGSPPGYVGYTEGGQLTEAVRRRPYTVVLFDEIEKAHPDVFNIMLQILEDGRLTDSKGRTVDFKNTLLIMTSNVGSSVIEKGGRKMGFDLDYDEKDSSYNRIKSLVTEELKQYFRPEFLNRLDEMIVFRQLSKLEVKDIADIMLKEVFERLKVKEIELQVTERFRDRVVDEGYNPSYGARPLRRAIMRLLEDSMAEKMLSAEIKEGDSVIIDVDSDGNVVVLNGQSGGAPDALPDMLNVV

SEQ ID NO: 11009 - protein, 922 aa, Lupinus angustifolius
MAKVLAQSVNVPGLVAGQRHGQHKGQGELKRAVKTMCASRTNRLRMNGYSGLRTSNPLDIMLRPGLDFHSKVAIATSSRRARATRSIPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPTNIRTQVIRMVGESADSVAATVGPGSSGNKMPTLEEYGTNLTKLAQEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALVAAAQLSYQYISDRFLPDKAIDLVDEAGSRVRLQHAQLPEEARELDKEARQIIKEKEEAVRNQDFEKAGELRDKEMDLKAQISTLVEKGKEMSKAETEAGDTGPIVTEVDIQHIVSSWTGIPVDKVSTDESDRLLKMEDTLHKRIVGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLNEVFNRLKTKDIELQVTERFKDRVVDEGYNPSYGARPLRRAIMRLLEDSMAEKMLAREIKEGDSVIVDVDSDGNVIVLNGSSGTPESLPEPLPV

SEQ ID NO: 11010 - protein, 923 aa, Arnica chamissonis
MAGSLIQAAYFPSVDHEKKLHTNKSGKAKRTVKMMAYSYAPPMRMRTFSGLRGSNALDSIMKTGQDFHSKVALATSVRSRRATRIVPKAMFERFTEKAIKVIMLAQEEARRLGHNFVGTEQILLGLIGEGTGIAAKVLKSMGISLKEARVEVEKIIGRGSGFVAVEIPFTPRAKRVLELSLEEARQLGHNYIGSEHLLLGLLREGDGVAARVLENLGVDTSNIRTQVIRMVGESAEAVGAGVGGGTSSSKMPTLEEYGTNLTKLAEEGKLDPVVGRQAQVERVTQILGRRTKNNPCLIGEPGVGKTAIAEGLAQRIASGDVPETIEGKKVITLDMGLLVAGTKYRGEFEERLKKLMEEIKESDDIILFIDEVHTLIGAGAAEGAIDAANILKPALARGELQCIGATTLDEYRKHIEKDPALERRFQPVKVPEPTVDETIQILRGLRERYEIHHKLQYTDDALVAAAELSHQYISDRFLPDKAIDLIDEAGSRVRLRHAQLPEEARELEKELRQITKEKNEAVRGQDFEKAGELRDREMDLKTQISALIDKNKEMSKAESEAGDEGPTVTEADIQHIVATWTGIPVEKVSSDESDRLLKMEDTLHTRIIGQDEAVKAISRAIRRARVGLKNPNRPIASFIFSGPTGVGKSELAKSLAAYYFGSEDAMIRLDMSEFMERHTVSKLIGSPPGYVGYTEGGQLTEAVRRRPYTLVLFDEIEKAHPDVFNMMLQILEDGRLTDSKGRTVDFKNTLLIMTSNVGSNVIEKGGRRIGFDLDYDEKDNSYNRIKSLVTEELKQYFRPEFLNRLDEMIVFRQLTKLEVKEIADIMLKEVFERLKGKEIELQVTERFRDRVVEEGYNPSYGARPLRRAIMRLLEDSMAEKMLAHEIKEGDSVIVDVDSDGNVTVLNGSSGGPPEEVLPEPIAV

SEQ ID NO: 11011 - protein, 924 aa, Manihot esculenta
MARLLVHSTNIPAIASGVKHGQSQESETSRRATTKMMCSSRSPTLVLRGFSGLRSSNSLDMLLRSGQDFHSKVGITMSRRQQKAKRFSPRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADTSNIRTQVIRMVGESTENIPAPVGPGGGSNKMPTLEEYGTNLTKLAEEGKLDPVVGRQPQIERVVQILGRRTKNNPCLIGEPGVGKTAIAEGLAQRIASGDVPETIERKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPSVDETIEILKGLRERYEIHHKLRYTDEALVSAAQLSYQYISDRFLPDKAIDLIDEAGSRVRLRHAQVPEEARELEKEVRQITKEKDEAVRSQDFEKAGELRDREMDLRAQIAAIVEKGKEMSKAETEAGDVGPIVTESDIQHIVSSWTGIPVEKVSTDESDRLLKMEETLHKRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVILFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFDRLKGKDIELQVTERFRERVVEEGYNPSYGARPLRRAIMRLLEDSMAEKMLAGDIKEGDSVIVDVDSDGNVIVLNGSSGSPESLPDVLSIV

SEQ ID NO: 11012 - protein, 927 aa, Cleome gynandra
MAMATRALAQFTPPSLACYQRNISSRESGRSRRSPRMMSSQLQAPGLRIQGFLGLRGQNVLDTLGRSSQDFHSKVRLTMTSRRRKPRRCMPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGENNEVTANVGGGSSSNKMPTLEEYGTNLTKLAEEGKLDPVVGRQPQIERVVQILGRRTKNNPCLIGEPGVGKTAIAEGLAQRIASGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPSVDETIQILKGLRERYEIHHKLRYTDEALVAAAQLSYQYISDRFLPDKAIDLIDEAGSRVRLRHAQVPEEAKELEKELRQITKEKNEAVRGQDFEKAGTLRDREIELRAEISAIQAKGKEMSKAESETGDGGPLVTESDIQHIVSSWTGIPVEKVSTDESDRLLKMEETLHKRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDSDEKDSSYNRIKSLVTEELKQYFRPEFLNRLDEMIVFRQLTKLEVKEIADIMLKEVFERLKKKEIELQVTERFRERVVDEGYNPSYGARPLRRAIMRLLEDSMAEKMLSGEIKENDSVIVDVDSDGNVTVLNGSSGAPKALEEEDSLTVL

SEQ ID NO: 11013 - protein, 926 aa, Populus trichocarpa
MARLLVHSANIPAVAPCLRHCQFEESKKRRDSSAKMMSSSPSQGLVMSGYSGLRSANCLDTLLRHGQSFHSKVAITISPRQQKAKRFVPRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGESTENLAGSTVGPGSSNNKMPTLEEYGTNLTKLAEEGKLDPVVGRQPQIERVIQILGRRTKNNPCLIGEPGVGKTAIAEGLAQRIASGDVPETIEGKKVITLDMGLLVAGTKYRGEFEERLKKLMEEIKQSDEIMLFIDEVHTLIGAGAAEGAIDAANILKPALARGELQCIGATTLDEYRKHIEKDPALERRFQPVKVPEPSVDETIQILKGLRERYEIHHKLRYTDESLVAAAQLSYQYISDRFLPDKAIDLIDEAGSRVRLRHAQVPEEARELEKEVRQITKEKDEAVRGQDFEKAGELRDREMDLRAQIAAIVEKGKEMSKAETEAGDVGPTVTESDIQHIVSSWTGIPVEKVSTDESDRLLKMEDTLHKRVVGQDEAVKAISRAIRRARVGLKNPNRPIASFIFSGPTGVGKSELAKALAAYYFGSEEAMIRLDMSEYMERHTVAKLIGSPPGYVGYTEGGQLTEAVRRRPYTVVLFDEIEKAHPDVFNIMLQILEDGRLTDSKGRTVDFKNTLLIMTSNVGSSVIEKGGRKIGFDLDYDEKDSSYNRIKSLVTEELKQYFRPEFLNRLDEMIVFRQLTKLEVKDIADIMLKEVFERLKAKEIELQVTERFRDRVVDEGYNPAYGARPLRRAIMRLLEDSMAEKMLSAEIKEGDSVIIDVDSDGNVIVLNGQSGGAPDALPDVLNVA

SEQ ID NO: 11014 - protein, 928 aa, Papaver somniferum
MAGALVQSTNIRASISSTFGKSHDKKQRGSSGLANRRTVKMLCNSVQMRGLRISAPSLTVGGFNGLRGTNAIDKLVFSGHDFHYKVAISIGAPRGRGSRCVARAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPNNIRTQVIRMVGESTEAVGAGVGGGSTNSKMPTLEEYGTNLTKLAEEGKLDPVVGRAAQIERVTQILGRRTKNNPCLIGEPGVGKTAIAEGLAQRIASGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDESIQILKGLRERYEIHHKLRYTDEALEAAARLSYQYISDRFLPDKAIDLIDEAGSRVRLRNAQLPEEARELEKELRQITKEKNEAVRGQDFEKAGELRDREMDLRAQITNVVDKGKELSKAESESGDTGPVVTEVDIQHIVASWTGIPVDKVSSDESDKLLKMEDTLHTRVIGQDEAVKAISRAIRRARVGLKNPNRPIASFIFSGPTGVGKSELAKTLASYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSNVIEKGGRRIGFDLDYDEKDSSYNRIKSLVQEELKQYFRPEFLNRLDEMIVFRQLTKLEVKEIADIMLKEVFERLRKKEIELQVTERFRDRVVDEGYNPSYGARPLRRAIMRLLEDSMAEKMLGGEIKEGDSVIVDVDGDGNVTVLNGTSPQLV

SEQ ID NO: 11015 - protein, 927 aa, Eutrema parvulum
MATRVLAQSTPPSLACYQRNLPSRGSGRSKRSVKMMCSQLQVSGLRMQGFLGLRGNNVLDTLGRSRQDFNSKVRHAMNVPRGKASRCVAKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGENNEVTANVGGGSSSNKMPTLEEYGTNLTKLAEEGKLDPVVGRQPQIERVVQILGRRTKNNPCLIGEPGVGKTAIAEGLAQRIASGDVPETIEGKKVITLDMGLLVAGTKYRGEFEERLKKLMEEIRQSDEIILFIDEVHTLIGAGAAEGAIDAANILKPALARGELQCIGATTLDEYRKHIEKDPALERRFQPVKVPEPTVDETIQILKGLRERYEIHHKLRYTDDSLVAAAQLSYQYISDRFLPDKAIDLIDEAGSRVRLRHAQVPEEARELEKELRQITKEKNEAVRGQDFEKAGTLRDREIELRAEVSAIQAKGKEMSKAESETGEEGPMVTESDIQHIVSSWTGIPVEKVSTDESDRLLKMEETLHKRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADILLKEVFERLKKKEIELQVTERFRERVVDEGYNPSYGARPLRRAIMRLLEDSMAEKMLAREIKEGDSVIVDVDSEGKVTVLNGGSGTPTTSLEEQEDSLPVA

SEQ ID NO: 11016 - protein, 695 aa, Cleome spinosa
MVGENNEVTANVGGGSSGNKMPTLEEYGTNLTKLAEEGKLDPVVGRQQQIERVVQILGRRTKNNPCLIGEPGVGKTAIAEGLAQRISSGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPSVDETIQILKGLRERYEIHHKLRYTDEALVAAAQLSYQYISDRFLPDKAIDLIDEAGSRVRLRHAQVPEEAKELEKELRQITKEKNEAVRGQDFEKAGTLRDREIELRAEVSAIQAKGKEMSKAESETGDGGPLVTESDIQHIVSSWTGIPVEKVSTDESDRLLKMEETLHKRVVGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLESDEKDSSYNRIKSLVTEELKQYFRPEFLNRLDEMIVFRQLTKMEVKEIGDIMLREVFERLKKKEIELQVTERFRERVVEEGYNPSYGARPLRRAIMRLLEDSMAEKMLSGEIKEGDSVIVDVDSDGNVTVLNGSSGAPPKALEEEDPLPVV

SEQ ID NO: 11017 - protein, 925 aa, Cleome gynandra
MATRVLAQSTPPSLACYQRNIPSRESGRSRRSARMMSSQAQAPGLRIQGFLGLRGQNVLDTLGRSCQDFHSKVRLAMTSPRGKPRRCMPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGENNEVTANVGGGSSSNKMPTLEEYGTNLTKLAEEGKLDPVVGRQQQIERVVQILGRRTKNNPCLIGEPGVGKTAIAEGLAQRIASGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPSVDETIQILKGLRERYEIHHKLRYTDEALVAAAQLSYQYISDRFLPDKAIDLIDEAGSRVRLRHAQVPEEAKELEKELRQITKEKNEAVRGQDFEKAGTLRDREIELRAEISAIQAKGKEMSKAESETGDGGPLVTESDIQHIVSSWTGIPVEKVSTDESDRLLKMEETLHKRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDSDEKDSSYNRIKSLVTEELKQYFRPEFLNRLDEMIVFRQLTKLEVKEIADIMLKEVFDRLKKKEIELQVTERFRERVVEEGYNPSYGARPLRRAIMRLLEDSMAEKMLSGEIKEGDSVIVDVDSEGEVTVLNGSSGAPKALEEEDPLPIV

SEQ ID NO: 11018 - protein, 726 aa, Cajanus cajan
MARVLAQSISMPGLLSGQRHDQHKGSGKLKRSVKMMSSLRVPALRMSGFSGLRSLNTLDYLSRPRQNFHSKMLTTTSSRRERAKRCVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPNNIRAQVIRMVGEGADSVGATVGPGSSNNNKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDDALIAAAQLSHQYISDRFLPDKAIDLIDEAGSRVRLQHAQLPEEARELDKEVRQIVKEKEEAVRNQDFEKAGELRDREMDLKTQISALIEKGKEMSKAESEAGDGGPSVTEVDIQHIVSSWTGIPVEKVSTDESDRLLKMEETLHKRVIGQDEAVKAISRAIRRARVGLKNPNRPIASFIFSGPTGVGKSELAKALATYYFGSEEAMIRLDMSEFMERHTVSKLIGSPPGYVGYTEGGQLTEAVRRRTRLYCLMRLRKPILMYST

SEQ ID NO: 11019 - protein, 927 aa, Arabidopsis lyrata
MATRVLAQSTPPSLACYQRNVPSRGSGRSRRSVKMMCSQLQVSGLRMQGFLGLRGNNALDTLGKNRQDFHSKVRQAMNVPKGKASRFTVKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGENNEVTANVGGGSSSNKMPTLEEYGTNLTKLAEEGKLDPVVGRQPQIERVVQILGRRTKNNPCLIGEPGVGKTAIAEGLAQRIASGDVPETIEGKKVITLDMGLLVAGTKYRGEFEERLKKLMEEIRQSDEIILFIDEVHTLIGAGAAEGAIDAANILKPALARGELQCIGATTLDEYRKHIEKDPALERRFQPVKVPEPTVDETIQILKGLRERYEIHHKLRYTDDSLVAAAQLSYQYISDRFLPDKAIDLIDEAGSRVRLRHAQVPEEARELEKELRQITKEKNEAVRGQDFEKAGTLRDREIELRAEVSAIQAKGKEMSKAESETGEEGPMVTESDIQHIVSSWTGIPVEKVSTDESDRLLKMEETLHKRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADILLKEVFERLKKKEIELQVTERFKERVVDEGYNPSYGARPLRRAIMRLLEDSMAEKMLAREIKEGDSVIVDVDAEGNVTVLNGGSGTPTTSLEEQEDSLPVA

SEQ ID NO: 11020 - protein, 923 aa, Phaseolus vulgaris
MARVLAQSIGMPGLLSGQRHGQHKGSGKSRRSLKMMSSLQMPALRMSSFSGLRTVNNLDLLSRSRRSLPSKMLTSTSSRRERAKRFVPRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPNNIRSQVIRMVGEGADSVGATVGPGSSNNNKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLQYTDDALVAAAQLSHQYISDRFLPDKAIDLIDEAGSRVRLQHAQLPEEARELDKEVRQIVKDKEEAVRNQDFEKAGGLRDKEMDLKAQISTLIEKGKEMSKAEMEAGDGCPMVTEVDIQHIVSSWTGIPVEKVSTDESDRLLKMEETLHTRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKMGFDLSYDEKDSSYNRIKSLVTEELKQYFRPEFLNRLDEMIVFRQLTKLEVKEIADIMLKEVFERLKVKEIDLSVTEKFRERVVEEGYNPSYGARPLRRAIMRLLEDSMAEKMLAREIKEGDSVIVDADSDGNVIVLNGTSGVQESLSESLPV

SEQ ID NO: 11021 - protein, 927 aa, Arabidopsis thaliana
MATRVLAQSTPPSLACYQRNVPSRGSGRSRRSVKMMCSQLQVSGLRMQGFMGLRGNNALDTLGKSRQDFHSKVRQAMNVPKGKASRFTVKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGENNEVTANVGGGSSSNKMPTLEEYGTNLTKLAEEGKLDPVVGRQPQIERVVQILGRRTKNNPCLIGEPGVGKTAIAEGLAQRIASGDVPETIEGKKVITLDMGLLVAGTKYRGEFEERLKKLMEEIRQSDEIILFIDEVHTLIGAGAAEGAIDAANILKPALARGELQCIGATTLDEYRKHIEKDPALERRFQPVKVPEPTVDETIQILKGLRERYEIHHKLRYTDESLVAAAQLSYQYISDRFLPDKAIDLIDEAGSRVRLRHAQVPEEARELEKELRQITKEKNEAVRGQDFEKAGTLRDREIELRAEVSAIQAKGKEMSKAESETGEEGPMVTESDIQHIVSSWTGIPVEKVSTDESDRLLKMEETLHKRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADILLKEVFERLKKKEIELQVTERFKERVVDEGYNPSYGARPLRRAIMRLLEDSMAEKMLAREIKEGDSVIVDVDAEGNVTVLNGGSGTPTTSLEEQEDSLPVA

SEQ ID NO: 11022 - protein, 926 aa, Theobroma cacao
MAKVLAQSTIVPALVTSRSHGPSKESSKSKGSAKMMCSLQTPGLRIRSFSGLRGSNSLDNMVRFGQDFRSKVAISISSRRGRGSRCVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQARNALTNLILFQISVSVVPGGSTGNTKMPTLEEYGTNLTKLAEEGKLDPVVGRQVQIERVVQILGRRTKNNPCLIGEPGVGKTAIAEGLAQRIASGDVPDTIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPSVDETIQILKGLRERYEIHHKLRYTDDALISAAQLSYQYISDRFLPDKAIDLIDEAGSRVRLRHAQLPEEARELEKELRQITKSKNEAVRSQDFEKAGELRDREIELRAQITAIQEKDKEMNKAEAEAGEGGPVVTEVDIQHIVSAWTGIPVEKVSTDESDRLLKMEETLHKRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFDRLKAKEIELQVTERFRERVVEEGYNPSYGARPLRRAIMRLLEDSMAEKMLAREIKEGDSVIVDVDSDGNVTVLNGSSGAPESLADPIPVV

SEQ ID NO: 11023 - protein, 916 aa, Avena sativa
MAGTLVLPVALGATFEGRARKSHGTRRPTSMLAMSLNRPVRMAAFSGPRSVHSFTTMPSSSFRLTAASYRSSRRGRRCRFVTRAMFERFTEKAIKVIMLAQEEARRLGHNFVGTEQVLLGLVGEGTGIAAKVLKSMGINLKDARVEVEKIIGRGNGFVAVEIPFTPRAKRVLELSLEEARQLGHNYIGSEHLLLGLLREGEGVAARVLESLGADPSNIRTQVVRMIGETTEAVGAGVGGGSSGNKMPTLEEYGTNLTKLAEEGKLDPVVGREPQIERVIQILGRRTKNNPCLIGEPGVGKTAIAEGLAQRINSGDVPETIEGKKVITLDMGLLVAGTKYRGEFEERLKKLMEEIKQSDEIILFIDEVHTLIGAGAAEGAIDAANILKPALARGELQCIGATTLDEYRKHVEKDPALERRFQPVKVPEPSVDETIEILRGLRERYEIHHKLSYTDDSLIAAAKLSYQYISDRFLPDKAIDLIDEAGSRVRLRHAQVPEEARELDKELKQITKDKNEAVRGQDFEKAGELRDREMELKTQITALIDKSKEMIKAETASGETGPMVHESDIQHIVSSWTGIPVEKVSTDESDKLLKMEETLHKRVIGQDEAVKAISRSVRRARVGLKNPNRPIASFIFAGPTGVGKSELAKTLASYYFGSEEAMIRLDMSEFMERHTVSKLIGSPPGYVGYTEGGQLTEAVRRRPYSVVLFDEIEKAHPDVFNMMLQILEDGRLTDSKGRTVDFKNTLLIMTSNVGSSVIEKGGRKIGFDLESDEKDSSYGRIKSLVIEEMKQYFRPEFLNRLDEMIVFRQLTKLEVKEIADIMLQEVFTRLKLKEINLQVTEKFKERVVDEGYNPSYGARPLRRAIMRLLEDSLAEKILAGEVKEGDSAIVDVDSEGKVVVLNGQSGLPDLPTPAVSV

SEQ ID NO: 11024 - protein, 927 aa, Eutrema halophilum
MATRVLAQSTPPSLACYQRNVPSRGSGRTRRPVKMMCSQLQVSGLRMQGFLGLRGNNVLDTLGRSRQDFHSRVRQAMNVPKGKASRCVTKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGENNEVTANVGGGSSSNKMPTLEEYGTNLTKLAEEGKLDPVVGRQPQIERVVQILGRRTKNNPCLIGEPGVGKTAIAEGLAQRIASGDVPETIEGKKVITLDMGLLVAGTKYRGEFEERLKKLMEEIRQSDEIILFIDEVHTLIGAGAAEGAIDAANILKPALARGELQCIGATTLDEYRKHIEKDPALERRFQPVKVPEPTVDETIQILKGLRERYEIHHKLRYTDDSLVAAAQLSYQYISDRFLPDKAIDLIDEAGSRVRLRHAQVPEEARELEKELRQITKEKNEAVRGQDFEKAGTLRDREIELRAEVSAIQAKGKEMSKAESETGEEGPMVTESDIQHIVSSWTGIPVEKVSTDESDRLLKMEETLHKRIIGQDEAVVAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKPEVKEIADILLKEVFERLKKKEIELQVTERFKERVVDEGYNPSYGARPLRRAIMRLLEDSMAEKMLAREIKEGDSVIVDVDSEGKVTVLNGGSGTPTTSLEEQEDSLPIV

SEQ ID NO: 11025 - protein, 920 aa, Triticum aestivum
MAGTLVLPVALETTFAGRTGGRHCKSHGTRRTPSMLAMSLNRPVRMAAFVGLRSVHSFSAMRSSNFRSTVASYRFSRRGRRASFVTRAMFERFTEKAIKVIMLAQEEARRLGHNFVGTEQVLLGLVGEGTGIAAKVLKSMGINLKDARVEVEKIIGRGNGFVAVEIPFTPRAKRVLELSLEEARQLGHNYIGSEHLLLGLLREGEGVAARVLESLGADPSNIRTQVVRMIGETTEAVGAGVGGGSSGNKMPTLEEYGTNLTKLAEEGKLDPVVGREPQIERVVQILGRRTKNNPCLIGEPGVGKTAIAEGLAQRISSGDVPETIEGKKVITLDMGLLVAGTKYRGEFEERLKKLMEEIKQSDEIILFIDEVHTLIGAGAAEGAIDAANILKPALARGELQCIGATTLDEYRKHVEKDPALERRFQPVKVPEPSVDETIEILRGLRERYEIHHKLRYTDDSLIAAAKLSYQYISDRFLPDKAIDLIDEAGSRVRLRHAQVPEEARELDKELKQITKDKNEAVRGQDFEKAGELRDREMELKAQITALIDKSKEMNKAETESGETGPMVHESDIQHIVSSWTGIPVEKVSTDESDKLLKMEETLHKRVIGQDEAVKAISRSVRRARVGLKSPNRPIASFIFAGPTGVGKSELAKTLASYYFGSEEAMIRLDMSEFMERHTVSKLIGSPPGYVGYTEGGQLTEAVRRRPYSVVLFDEIEKAHPDVFNMMLQILEDGRLTDSKGRTVDFKNTLLIMTSNVGSSVIEKGGRKIGFDLDSDEKDSSYGRIKSLVIEEMKQYFRPEFLNRLDEMIVFRQLTKLEVKEIADIMLQEVFTRLKTKDINLQVTEKFKERVVDEGYNPSYGARPLRRAIMRLLEDSLAEKILGGEVKEGDSVIVDVDPEGKVIVLNGESGLPELPTPAVAV

SEQ ID NO: 11026 - protein, 555 aa, Chelidonium majus
MFERFTEKAIKVIMLAQEEARRLGHNFVGTEQILLGFIGEGTGIAAKVLKSMGINLKDARVEVEKIIGRGSGFVAVEIPFTPRAKRVLELSLEEARQLGHNYIGSEHLLLGLLREGEGVAARVLENLGADPNNIRTQVIRMVGESTEAGAVVGGSSTNNKMPTLEEYGTNLTKLAEEGKLDPVVGRQSQIERVTQILGRRTKNNPCLIGEPGVGKTAIAEGLAQRIATGDVPETIEGKKVITLDMGLLVAGTKYRGEFEERLKKLMEEIKQSDDIILFIDEVHTLIGAGAAEGAIDAANILKPALARGELQCIGATTLDEYRKHIEKDPALERRFQPVKVPEPTVDESIQILKGLRERYEIHHKLRYTDEALVAAAQLSYQYISDRFLPDKAIDLIDEAGSRVRLRNAQLPEEARELEKELRQITKEKNEAVRGQDFEKAGELRDREMDLRAQITNLVDKGKELSKAESEAGDSGPVVTEVDIQHIVASWTGIPVDKVSSDESDRLLKMEDTLHTRVIGQDEAVRAISRAIRRARVGLKTLTVQLPASYSPVLLV

SEQ ID NO: 11027 - protein, 929 aa, Brassica rapa
MAMATRVMSQYTPLSLACSQRNAPSRGSGTSKRSVKMMCTQLQVSGSRMQGFLGLRGNNVLDTLGRSRQSFGGKVRQAMNVPKGKGSRGVVKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGENNEVTANVGGGSGSNKMPTLEEYGTNLTKLAEEGKLDPVVGRQPQIERVVQILGRRTKNNPCLIGEPGVGKTAIAEGLAQRIASGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDESLVAAAQLSYQYISDRFLPDKAIDLIDEAGSRVRLRHAQVPEEARELEKELRQITKEKNEAVRGQDFEKAGTLRDREIELRAEVSAIQAKGKEMSKAESETGEEGPMVTESDIQHIVSSWTGIPVEKVSTDESDRLLKMEETLHKRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADILLQEVFERLKKKEIELQVTERFRERVVDEGYNPSYGARPLRRAIMRLLEDSMAEKMLAREIKEGDSVIVDVDSEGKVTVLNGGSGTPTTSLEEQEDSLPVA

SEQ ID NO: 11028 - protein, 887 aa, Flaveria ramosissima
MAGALVQSTSFPSAVSSESKVCSKRSGNTKRGVKMMAGALAPPVRVRTFSGLRGVNALDNMVNRAQDFHSKVAAATSVRKAKPSRIVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPNNIRTQVIRMVGESAEAVGAGVGGGTSGNKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALVAAAQLSYQYISDRFLPDKAIDLIDEAGSRVRLRHAQLPEEAKELEKELRQITKEKNEAVRGQDFEKAGELRDREMDLKTQISALVDKNKEMSKAETEAGEEGPTVTEADIQHIVSSWTGIPVEKVSTDESDRLLKMEETLHTRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFERLKGKEIELQVTERFRDRVVEEGYNPSYGARPLRRAIMRLLEDSMAEKMLAREI

SEQ ID NO: 11029 - protein, 275 aa, Arachis hypogaea
MFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPTNIRTQVIRMVGESADSVTATVGSGSSGNKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEINKVMR

SEQ ID NO: 11030 - protein, 927 aa, Aquilegia formosa
MARALIQSAILPTGVSCGTHGQLLESGKGKRAVKMMCNVHSSHIRVCGFSGLRAPNALDTLVKSGFDFHSKVAAAVSAPRGKGRRIVAKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPNNIRTQVIRMVGESTEAVGAGVGGGSSNNKMPTLEEYGTNLTKLAEEGKLDPVVGRQVQIERVTQILGRRTKNNPCLIGEPGVGKTAIAEGLAQRIASGDVPETIEGKKVITLDMGLLVAGTKYRGEFEERLKKLMEEIKQSDEIILFIDEVHTLIGAGAAEGAIDAANILKPSLARGELQCIGATTLDEYRKHIEKDPALERRFQPVKVPEPSVDETIQILKGLRERYEIHHKLRYTDEALVAAAQLSYQYISDRFLPDKAIDLIDEAGSRVRLRNAQLPEEARELEKELRQITKEKNEAVRGQDFEKAGELRDKEMDLKARITSLIDKGKEKTKAESEASEAGPLVTEVDIQHIVSSWTGIPVDKVSSDESERLLKMEETLHKRIIGQDEAVHAISRAIRRARVGLKNPNRPIASFIFSGPTGVGKSELAKTLAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIQKGGRRMGFDLDFNKEKEKEEDTSYNRIKSLVTEELKHYFRPEFLNRLDEMIVFRQLTKVEVKEIAVIMLKEVSDRLKTKGIELQVTENFTNKVVNQGYSKTYGARPLRRAIMRLLEDSMAEKMLAGEIKEGDSVIVDVDADGKVTVLNGSSGTLEPSAPALPV

SEQ ID NO: 11031 - protein, 925 aa, Cleome spinosa
MSTRVLAESAAPSLACYQRNIPSRESGRSRRSARMMSSQPQAPGLRIQGFLGLRGQNVLDMLGRSRQDFHSKVRLTMSSRRGKPSRCMPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGENNEVTANVGGGSNSNKMPTLEEYGTNLTKLAEEGKLDPVVGRQPQIERVVQILGRRTKNNPCLIGEPGVGKTAIAEGLAQRIASGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPSVDETIQILNGLRERYEIHHKLRYTDEALVAAAHLSYQYISDRFLPDKAIDLIDEAGSRVRLRHAQVPEEAKELEKELRQITKEKNEAVRGQDFEKAGTLRDREIELRAEISAIQAKGKEMSKAESETGDGGPFVTESDIQHIVSSWTGIPVEKVSTDESDRLLKMEETLHTRVIGQDEAVKAISRAIRRARVGLKNPNHPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLESDEKDSSYNRIKSLVTEELKQYFRPEFLNRLDEMIVFRQLTKLEVKEIADIMLKEVFERLKKKEIELQVTERFRERVVDEGYNPSYGARPLRRAIMRLLEDSMAEKMLSREIKEGDSVIVDVDSDGNVTVLNGSSGAPKALEEEDPLPVV

SEQ ID NO: 11032 - protein, 923 aa, Vigna unguiculata
MARVLAQSIGMPGLLSGQRQGQHKASGKSRRSVKMMATIRMPASRMSSFSGLRTLNTLDLLSRPRQNFPSKMLTSTSSRRERAKRCVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPNNIRAQVIRMVGEGADSVGATVGPGGGNNTKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLQYTDEALEAAAQLSHQYISDRFLPDKAIDLIDEAGSRVRLQHAQLPEEARELDKELRQIVKEKDEAVRNQDFEKAGELRDKEMDLKTQISSLIEKGKEMSKAESEAGDGGPMVTEVDIQHIVSSWTGIPVEKVSTDESDRLLKMEETLHTRVIGQDEAVKAISRAIRRARVGLKNPNRPIASFIFSGPTGVGKSELAKALAAYYFGSEEAMIRLDMSEFMETHTVSKLIGSPPGYVGYTESGQLTEAVRRRPYTVVLFDEIEKAHPDVFNMMLQILEDGRLTDSKGRTVDFKNTLLIMTSNVGSSVIEKGGRKMGFDLDYDEKDSSYNRIKSLVTEELKQYFRPEFLNRLDEMIVFRQLTKLEVKEIADIMLKEVFERLKAKEIDLSVTERFRERVVEEGYNPSYGARPLRRAIMRLLEDSMAEKMLAREIKEGDSVIVDADSDGNVIVLNGSSGAPESLTEALPV

SEQ ID NO: 11033 - protein, 926 aa, Medicago truncatula
MSRALAQSINVPGLVAGRRHVNNNKGAARSRRSVRMMFTTRTASPRLSSYSGLRTLNSLDSMLRPGQDFHSKVLTQIGTNRAKGGRGSRCVTKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPTNIRTQVIRMVGEGADSVGATVGSGSSNNKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVPETIQILKGLRERYEIHHKLRYTDEALVAAAELSHQYISDRFLPDKAIDLIDEAGSRVRLQHAQLPEEARGLEKEVRQIVKEKDEAVRNQEFEKAGELRDKEMDLKTQISALIEKNKEMNKAESEAGDVGALVTEVDIQHIVASWTGIPVDKVSVDESDRLLKMEDTLHKRIIGQHEAVEAISRAIRRARVGLKNPNRPIASFIFSGPTGVGKSELAKALASYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFERLKTKEIELSVTERFRERVVDEGYNPSYGARPLRRAIMRLLEDSMAEKMLAREIKEGDSVIVDADSDGNVIVLNGSTGAPDSLPDALPV

SEQ ID NO: 11034 - protein, 925 aa, Mimulus guttatus
MTHTLIRPTNLPSSVVLGNNGQLNGSNKARKAPTMLCSTQPTAIRLQSFSGLRRANSLDIMVWQPRHTLQSKVAAAIAPVRQGRKSRMAPRAMFERFTEKAIKVIMLAQEEARRLGHNFVGTEQILLGLIGEGSGIAAKVIKSMGINLKDARIEVEKIIGRGSGFVAVEIPFTPRAKRVLELALEEARQLGHNYIGSEHVLLGLLREGEGVAARVLENLGADPNNIRTQVIRMVGESVEAVTVKGDGNSNGKMPTLEEYGTNLTKLAEEGKLDPVVGRAAQIERVTQILGRRTKNNPCLIGEPGVGKTAIAEGLAQRIANGDVPETIEGKKVITLDMGLLVAGTKYRGEFEERLKKLMEEIKQSDDIILFIDEVHTLIGAGAAEGAIDAANILKPALARGELQCIGATTLDEYRKHIEKDPALERRFQPVKVPEPTVDEAIQILKGLRERYEIHHKLRYTDESLVAAAQLAHQYISDRFLPDKAIDLIDEAGSRVRLRHAQLPEEARELEKELRQITKEKNEAVRGQDFEKAGELRDREMDFKAQISVLIDKNKEMTKAENEAGDGGAIVTEVDIQHIVASWTGIPVDKVSTDESDRLLKMEDTLHTRVIGQDEAVKAISRAIRRARVGLKNPNRPIASFIFSGPTGVGKSELAKSLATYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFVRLKDKDIELQVTERFRDRVVDEGYDPSYGARPLRRAIMRLLEDSMAEKMLGGEIKEGDSVIVDVDSDGKVVVLNGSSGAPSEMAEEPIVFV

SEQ ID NO: 11035 - protein, 927 aa, Medicago truncatula
MSRVLAQSINVPGLVAGRRHVNNNNGSVRSRPRSVRMMYATQTATMRLSGFSGLRPLNSLDSMFRPRQDFHSKVLTQIGTNRARGGRGSRCVTRAMFERFTEKAIKVIMLAQEEARRLGHNFVGTEQILLGLIGEGTGIGAKVLKSMGINLKDSRVEVEKIIGRGSGFVAVEIPFTPRAKRVLELSLEEARQLGHNYIGSEHLLLGLLREGEGVAARVLENLGADPTNIRTQVIRMVGEGADNVGATVGSGSSNSKMPTLEEYGTNLTKLAEEGKLDPVVGRQPQIERVTQILGRRTKNNPCLIGEPGVGKTAIAEGLAQRIANGDVPETIEGKQVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVSETIQILKGLRERYEIHHKLRYTDDALVAAAELSYQYISDRFLPDKAIDLIDEAGSRVRLQHAQLPEEARGLEKEVRQIVKEKDEAVRNQEFEKAGELRDKEMDLKAQISGLIQKNKEMSKAESEAGDVGALVTEVDIQHIVAAWTGIPVDKVSVDESDRLLKMEETLHKRVIGQHEAVEAISRAIRRARVGLKNPNRPIASFIFSGPTGVGKSELAKTLASYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFERLKTKEIELSVTERFRERVVDEGYNPSYGARPLRRAIMRLLEDSMAEKMLAREIKEGDSVIVDADSDGNVIVLNGSSGAPNSLPESLPV

SEQ ID NO: 11036 - protein, 926 aa, Cicer arietinum
MSRLLVHSLNVPGLVPGQRHGNNNKVLAKVRRPVKMMFATGTAASRMPGFSGLRTVNSLDSMLRPRLDFHSKVLTQIGTNRARSGRGNRVVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPTNIRTQVIRMVGEGADNVGATVGSGSSNNKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDDALVAAAQLSHQYISDRFLPDKAIDLIDEAGSRVRLQHAQLPEEAKELEKEVRKIVKEKDQAVRNQEFEKAGELRDQEMDLKAQISAVVEKGKEMSKAESEAGDIGALVTEVDIQHIVAAWTGIPVDKVSTDESDRLLKMEDTLHKRIIGQHEAVEAISRAIRRARVGLKNPNRPIASFIFSGPTGVGKSELAKALATYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFERLKAKDIELSVTERFKERVVDEGYNPSYGARPLRRAIMRLLEDSMAEKMLAREIKEGDSVIVDADSDGNVIVLNGSSGASDSLPEALPV

SEQ ID NO: 11037 - protein, 830 aa, Elaeis guineensis
MFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLESLGADPSNIRTQVIRMVGESTEAVGAGVGGGSSGNKMPTLEEYGTNLTKLAEEGKLDPVVGRQEQIERVTQILGRRTKNNPCLIGEPGVGKTAIAEGLAQRIANGDVPETIEGKKVITLDMGLLVAGTKYRGEFEERLKKLMDEIKQSDEIILFIDEVHTLIGAGAAEGAIDAANILKPALARGELQCIGATTLDEYRKHIEKDPALERRFQPVRVPEPTVDETIQILKGLRERYEIHHKLRYTDEALVAAAQLSYQYISDRFLPDKAIDLIDEAGSRVRLRHAQLPEEARELDKELRQITKEKNESVRSQDFEKAGELRDREMELKAQISALIDKGKERSKAESEAGDSGPLVTEADIQHIVSSWTGIPVEKVSSDESDRLLKMEETLHKRVVGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFERLKAKDIELQVTERFRDRVVEEGYSPSYGARPLRRAIMRLLEDSLAEKMLAGEIKEGDSAIVDVNSDGNVTVLSGASGVPEPPAIPV

SEQ ID NO: 11038 - protein, 919 aa, Glycine max
MARVLAQSTGMPGLLSGRRHGPHKGSGKTKRSVKMMSTLRIPALRMSSFSGLRTLNPLDSVSRPRHTFPLTTTSRRERAKRCVPKAMFERFTEKAIKVIMLAQEEARRLGHNFVGTEQILLGLIGEGTGIAAKVLKSMGINLKDARVEVEKIIGRGSGFVAVEIPFTSRAKRVLELSLEEARQLGHNYIGSEHLLLGLLREGEGVAARVLENLAADPNNIRAQVIRMVGEGADSVGATVGPGSSNNNKMPTLEEYGTNLTKLAEEGKLDPVMGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVNETIQILKGLRERYEIHHKLHYTDDALVAAAQLSHQYISDRFLPDKAIDLIDEAGSRVRLQHAQLPEEARELDKEVRQIVKEKEESVRNQDFEKAGELRDKEMDLKAQISALIEKGKEMSKAESEAGDEGPMVTEVDIQHIVSSWTGIPVEKVSTDESDRLLKMEETLHKRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDYDEKDSSYNRIKSLVTEELKQYFRPEFLNRLDEMIVFRQLTKLEVKEIADIMLKEVFQRLKAKEIDLSVTERFRERVVDEGYNPSYGARPLRRAIMQLLEDSMAEKMLAREIKEGDSVIVDSDSEGNVIVLNGSSGAPDSLEDVLVS

SEQ ID NO: 11039 - protein, 240 aa, Zostera marina
MFERFTEKAIKVIMLAQEEARRLGHNFVGTEQILLGLIGEGTGIAAKVLKSMGINLKDARQEVEKIIGRGSGFVAVEIPFTPRAKRVLELSLEEARQLGHNYIGSEHLLLGLLREGEGVAARVLESLGADSNNIRTQVIRMVGESTEAVGAGVGGGSSGNKMPTLEEYGTNLTKLAEEGKLDPVVGRQDQIERVTQILGRRTKNNPCLIGEPGVGKTAIAEGLAQRIATGDVPETIEGKR

SEQ ID NO: 11040 - protein, 926 aa, Trigonella foenum-graecum
MSRVLAQSINVPGLVAGRRHVNNNKGSARSRRSVRMMYATRAAAPRLCSYSGLRTLNSLDSMFRPGQDFHSKVLTQIGTNRAKGGRGSRFVTKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPTNIRTQVIRMVGEGADSVGATVGPGSSNNKMPTLEEYGTNLTKLAEEGKLDPVVGREPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVPETIQILRGLRERYEIHHKLRYTDEALVAAAELSHQYISDRFLPDKAIDLIDEAGSRVRLQHAQLPEEARGLEKEVRQIVKEKDEAVRNQEFEKAGELRDKEMDLKTQISALIEKNKEMNKAESEAGDVGALVTEVDIQHIVASWTGIPVDKVSVDESDRLLKMEDTLHKRIIGQDEAVEAISRAIRRARVGLKNPNRPIASFIFSGPTGVGKSELAKALATYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRLGFDLDYDEKDSSYNRIKSLVTEELKQYFRPEFLNRLDEMIVFRQLTKLEVKEIADIMLKEVFERLKIKEIELSVTERFRERVVDEGYNPSYGARPLRRAIMRLLEDSMAEKMLAREIKEGDSVIVDADSDGNVIVLNGSSGAPDSLPDVLPV

SEQ ID NO: 11041 - protein, 687 aa, Cynara scolymus
  misc_feature (3)..(3): Xaa can be any naturally occurring amino acid
  misc_feature (26)..(26): Xaa can be any naturally occurring amino acid
MQXCGAGVGGGSSEQMPTLEEYGTNXTKLAEEGKLDPVVGRQPQIERVTQILGRRTKNNPCLIGEPGVGKTAIAEGLAQRIATGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALVAAAQLSYQYISDRFLPDKAIDLIDEAGSRVRLRHAQLPEEARELEKELRQITKEKNEAVRGQDFEKAGELRDREMDLKTQISALVDKNKEMSKAETEAGEEGPMVTEADIQHIVSSWTGIPVEKVSTDESDRLLKMEETLHTRIIGQDEAVKAISRAIRRARVGLKNPNRPIASFIFSGPTGVGKSELAKALATYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFERLKVKEIELQVTERFRDRVVEEGYNPSYGARPLRRAIMRLLEDSMAEKMLAREIKEGDSVIVDVDSDGNVTVLNGSSGAPPEALPEPIPV

SEQ ID NO: 11042 - protein, 923 aa, Podocarpus macrophillus
MAGTLAQSAVLPSRVISHGQIQSSKRSKQVTKMMGKMQSRSSTIGSFTGLRQQTSIHMGVRPAKDFHRAVATAVSSVQVKANKGVVVCMFERFTEKAIKVIMLAQEEARRLGHNFVGTEQILLGLIGEGTGIAAKVLKSMGINLKEARVEVEKIIGRGSGFVAVEIPFTPRAKRVLELSLEEARQLGHNYIGSEHLLLGLLREGEGVAARVLENLGADPSNIRTQVIRMVGESTEAVGAGVGGGSSSNKMPTLEEYGTNLTKMAEEGKLDPVVGRQPQIERVTQILGRRTKNNPCLIGEPGVGKTAIAEGLAQRIASGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVQVPEPTVDETIQILKGLRERYEIHHKLRYTDEALIAAAQLSYQYISDRFLPDKAIDLVDEAGSRVRLRHAQVPEEARELDKELRQITKEKNEAVRNQDFEKAGELRDREMELKAQITALTEKGKEKSKAETEAGDVGPLVTEVDIQHIVAAWTGIPVSKVSTDESDRLLKMEETLHQRIVGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKMGFQFADDIDMEEDSNYTRIKSLVLEELKRYFRPEFLNRLDEMIVFRQLNKQEVREISDIMLKEVFERLKTKEIELQVTERFKDRVVDEGYSPSYGARPLRRAIMRLLEDCMAEKMLSGEIKEGDSAIVDVDLEGNVTVLNGRSGTTAPSTTPVAV

SEQ ID NO: 11043 - protein, 215 aa, Papaver somniferum
MFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPNNIRTQVIRMVGESTEAVGAGVGGGSTNSKMPTLEEYGTNLTKLAEEGKLDPVVGRAAQIERVTQILGRRTKNKPLLDRRTWCG

SEQ ID NO: 11044 - protein, 644 aa, Secale cereale
MPTLEEYGTNLTKLAEEGKLDPVVGREPQIERVVQILGRRTKNNPCLIGEPGVGKTAIAEGLAQRISSGDVPETIEGKKVITLDMGLLVAGTKYRGEFEERLKKLMEEIKQSDEIILFIDEVHTLIGAGAAEGAIDAANILKPALARGELQCIGATTLDEYRKHVEKDPALERRFQPVKVPEPSVDETIEILRGLRERYEIHHKLRYTDDSLIAAAKLSYQYISDRFLPDKAIDLIDEAGSRVRLRHAQVPEEARELDKELKQITKDKNEAVRGQDFEKAGELRDREMELKAQITALIDKSKEMNKAETESGETGPMVHESDIQHIVSSWTGIPVEKVSTDESDKLLKMEETLHKRVIGQDEAVKAISRSVRRARVGLKSPNRPIASFIFAGPTGVGKSELAKTLASYYFGSEEAMIRLDMSEFMERHTVSKLIGSPPGYVGYTEGGQLTEAVRRRPYSVVLFDEIEKAHPDVFNMMLQILEDGRLTDSKGRTVDFKNTLLIMTSNVGSSVIEKGGRKIGFDLDSDEKDSSYGRIKSLVIEEMKQYFRPEFLNRLDEMIVFRQLTKLEVKEIADIMLQEVFTRLKTKDINLQVTEKFKERVVDEGYNPSYGARPLRRAIMRLLRGQPSRRSSLGRGRVEGRATL

SEQ ID NO: 11045 - protein, 833 aa, Flaveria ramosissima
MFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPNNIRTQVIRMVGESAEAVGAGVGGGTSGNKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDDALVAAAQLSYQYISDRFLPDKAIDLIDEAGSRVRLRHAQLPEEARELEKELRQLTKEKNEAVRGQDFEKAGELRDREMDLKTQISALVDKNKEMSKAETEAGEEGPTVTEADIQHIVSSWTGIPVEKVSTDESDRLLKMEETLHTRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFERLKGKEIELQVTERFRDRVVEEGYNPSYGARPLRRAIMRLLEDSMAEKMLARDIKEGDSVIVDVDSDGNVTVLNGSSGAPPEALPEPVSV

SEQ ID NO: 11046 - protein, 933 aa, Physcomitrella patens
MAAVTQSLMVPAVGASHGQIHSSNKSQTPARVGPLGRKKAQIKNSSVPSTRIQSFSGMRKASVIDALTVKQGRDFKSTVAAALAVDNQEGTSKGVITAMFERFTEKAIKVIMLAQEEARRLGHNFVGTEQILLGLIGEGTGIAAKVLKSMGVNLKEARVEVEKIIGRGSGFVAVEIPFTPRAKRVLELSLEEARQLGHNYIGTEHLLLGLLREGEGVAARVLENLGADPSNIRTQVIRMVGESTESVGAGVGGGSSGNKMPTLEEYGTNLTKLAEEGKLDPVVGRQPQIERVTQILGRRTKNNPCLIGEPGVGKTAIAEGLAQRIATGDVPETIEGKKVITLDMGLLVAGTKYRGEFEERLKKLMEEIKQADDIILVIDEVHTLIGAGAAEGAIDAANILKPALARGELQCIGATTLDEYRKHIEKDAALERRFQPVLVPEPTVDETIQILKGLRERYEIHHKLRYTDEALVAAAQLSYQYISDRFLPDKAIDLIDEAGSRVRLRHAQLPEEARELDKELRGVTKEKNEAVRGQDFEKAGELRDREMELKAQISAITQKGKEQMKAESEAGDTGPTVEESDIQHIVSAWTGIPVEKVSSDESDRLLKMEDTLHQRVVGQDEAVKAISRAIRRARVGLKNPNRPIASFIFSGPTGVGKSELAKALASYYFGSEEAMVRLDMSEFMERHTVSKLIGSPPGYVGYSEGGQLTEAVRRRPYTVVLFDEIEKAHPDVFNMMLQILEDGRLTDSKGRTVDFKNTLLIMTSNVGSSVIEKGGGGIGFQLDYGEKDSSYNRIKSLVNEELKQYFRPEFLNRLDEIIVFRQLTKLEVKEIADIMLKEVFERLKKKEIDLQVTERFRDRVVDEGYSPSYGARPLRRAIMRLLEDSMAERMLAGEIKEGDSAIIDVDSEGGVTVLNGTTGSSSSTAIEAPAGIA

SEQ ID NO: 11047 - protein, 352 aa, Flaveria ramosissima
MFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPNNIRTQVIRMVGESAEAVGAGVGGGTSGNKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQI

SEQ ID NO: 11048 - protein, 832 aa, Sorghum bicolor
MFERFTEKAIKVIMLAQEEARRLGHNFVGTEQILLGLIGEGTGIAAKVLKSMGINLKDARVEVEKIIGRGNGFVAVEIPFTPRAKRVLELSLEEARQLGHNYIGSEHLLLGLLREGEGVAARVLESLGADPSNIRTQVIRMIGETTEAVGAGVGGGSSGNKMPTLEEYGTNLTKLAEEGKLDPVVGRQPQIERVVQILGRRTKNNPCLIGEPGVGKTAIAEGLAQRISTGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIEILRGLRERYEIHHKLRYTDEALIAAAKLSYQYISDRFLPDKAIDLIDEAGSRVRLQHAQVPEEARELDKELKQITKQKNEAVRSQDFEKAGELRDREMELKAQITAFIDKSKELSKAEEESGETGPMVNEADIQHIVSSWTGIPVEKVSSDESDKLLKMEETLHTRVIGQDEAVVAISRSIRRARVGLKNPNRPIASFIFAGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDSDEKDSSYSRIKSLVIEEMKQYFRPEFLNRLDEMIVFRQLTKLEVKEIAEIMLKEVFDRLKAKDINLQVTEKFKERVVDEGYNPSYGARPLRRAIMRLLEDSLAEKMLAGEVKEGDSAIVDVDSEGKVVVLNGQGGIPELSTPAITV

SEQ ID NO: 11049 - protein, 703 aa, Lactuca sativa
MFILVEWVIRMVGESAEAVGAGVGGGSSGNKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPIVDETIQILKGLREQYEIHHKLRYTDEALVAAAHLSYQYISDRFLPDKAIDLIDEAGSRVRLRHAQLPEEARELEKELRQITKEKNEAVRGQDFEKAGELRDREMDLKTQISALVDKNKEMSKVETEAGEEGPTVTEADIQHIVSSWTGIPVEKVSTDESDRLLKMEETLHTRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFERLKGKDIELQVTERFRDRVVEEGYNPSYGARPLRRAIMRLLEDSMAEKMLARDIKEGDSVIVDVDSDGNVTVLNGSSGAPLEALPEPISV

SEQ ID NO: 11050 - protein, 923 aa, Lotus japonicus
MSRVLAQSITIPGLVCGRSHGHNNRSTMSRRSLKMMSTLQAPALRMSGFSGLRTYNNLDTMLRPGLDFRSKVFGVTTSRKARASRCIPKAMFERFTEKAIKVIMLSQEEARRLGHNFVGTEQILLGLVGEGTGIAARVLKAMGISLKDARVEVEKTIGRGSGFVAVEIPFTPRAKRVLELSLEEARQLGHNYIGSEHLLLGLLREGEGVAARVLQDLGADPNNIRAQVIRMVGESNNETAGVAVGRGGSSNKMPTLEEYGTNLTKLANEGKLDPVVGRQQQIERVIQILGRRTKNNPCLVGEPGVGKTAIAEGLAQRIATGDVPETIEGKEVITLDMGLLVAGTKYRGEFEERLKKLMEEIKQNDNIILFIDEVHTLIGAGAAEGAIDAANILKPALARGELQCIGATTLDEYRKHIEKDPALERRFQPVRVPEPTVDESIQILRGLRERYERHHKLSYTDDALVAASQLSHQYISDRFLPDKAIDLIDEAGSRVRLRHAQLPEEARELDKEVRQIVKEKDEAVRNQDFEKAGELRDREMDLKTQISALIEKGKEMSKAESEADGAGPVVTEVDIQHIVASWTGVPVDKVSSDESDRLLKMEETLHKRVIGQDEAVKAICRAIRRARVGLKNPNRPIASFIFSGPTGVGKSELAKTLASYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDYDEKDSSYNRIKSLVTEELKQYFRPEFLNRLDEMIVFRQLTKLEVKEIADIMLKEVFDRLKTKEIDLSVTERFRDRVVEEGYDPSYGARPLRRAIMRLLEDSMAEKMLAGEIKEGDSVIIDADSDGKVIVLNGSSGAPESLPEALPV

SEQ ID NO: 11051 - protein, 833 aa, Cucumis melo
MFERFTEKAIKVIMLAQEEARRLGHNFVGTEQILLGLIGEGTGIAAKVLKSMGINLKDARVEVEKIIGRGGGFVAVEIPFTPRAKRVLELSLEEARQLGHNYIGSEHLLLGLLREGEGVAARVLENLGADPANIRTQVIRMVGESTEAVGAGVGGGSSGNKMPTLEEYGTNLTKLAEEGKLDPVVGRQQQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPSVDETIQILKGLRERYEIHHKLRYTDEAIEAAAQLSYQYISDRFLPDKAIDLIDEAGSRVRLRHAQLPEEAKEVEKELRQITKEKNDAVRSQDFEKAGELRDREMELKAKISALIDKGKEMSKAESEAGDVGPVVTEVDIQHIVSSWTGIPVEKVSTDESDRLLKMEETLHRRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSNVIEKGGRRIGFDLDYDEKDSSYNRIKMLVTEELKQYFRPEFLNRLDEMIVFRQLTKLEVKEIADIMLKEVFDRLKGKEIDLQVTERFRERVVDEGYNPSYGARPLRRAIMRLLEDSMAEKMLAREIKEGDSVIVDVDSDGNVTVLNGSSGAAPESLADPIPV

SEQ ID NO: 11052 - protein, 826 aa, Phalaenopsis aphrodite
EKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLESLGADPSNIRTQVIRMVGESTEAVGAGVGGGSSGNKMPTLEEYGTNLTKLAEEGKLDPVVGRQQQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALIAAAQLSYQYISDRFLPDKAIDLIDEAGSRVRLRHAQLPEDARELDKELRQITKDKNEAVRSQDFEKAGELRDREMELKAQISALIDKGKEISKAESEAGDAGPIVTEVDIQHIVSSWTGIPVEKVSSDESDRLLKMEETLHQRVIGQDEAVKAISRAIRRARVGLKNPNRPIASFIFSGPTGVGKSELAKALAAYYFGSEDAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFERLKTKDIELQVTERFRDRVVEEGYSPSYGARPLRRAIMRLLEDSLAERMLSGEIKEGDSAIVDVDSDGNVTVLNGSSGAPETISPAMSI

SEQ ID NO: 11053 - protein, 694 aa, Aquilegia formosa
MVGESTDAVGAGVGGGTSGNKMPTLEEYGTNLTKLAEEGKLDPVVGRQIQIERVTQILGRRTKNNPCLIGEPGVGKTAIAEGLAQRIATGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPSVDETVQILKGLRERYEIHHKLRYTDEALEAAAQLSYQYISDRFLPDKAIDLIDEAGSRVRLRDAQLPEEARELEKELRQITKEKNEAARGQDFEKAGELRDREMDLKTQIMSLVDKGKEKTKAENEAGDSGPVVTEVDIQHIVASWTGIPVDKVSVDESGRLLRMEETLHKRVIGQNEAVEAISRAIRRARVGLKHPNRPIASFIFSGPTGVGKSELAKALASYYFGSEESMIRLDMSEFMERHTVSKLIGSPPGYVGYTEGGQLTEAVRRRPYTVVLFDEIEKAHPDVFNMMLQILEDGRLTDSKGRTVDFKNTLLIMTSNIGSSVIEKGGRRMGFDLDFNKTEKDTSYSRIKSLVTEELKQYFRPEFLNRLDEMIVFRRLTKLEVKEISVIMLREVFERLRVKGIELQVTEKFKDRVVNEGYNPSYGARPLRRAIMRLLEDSMAEKMLGGEIKEGDSVIVDVDESGNVTVLNGSSGAPEPLSPALQI

SEQ ID NO: 11054 - protein, 832 aa, Zea mays
MFERFTEKAIKVIMLAQEEARRLGHNFVGTEQILLGLIGEGTGIAAKVLKSMGINLKDARVEVEKIIGRGNGFVAVEIPFTPRAKRVLELSLEEARQLGHNYIGSEHLLLGLLREGEGVAARVLESLGADPSNIRTQVIRMIGETTEAVGAGVGGGSSGNKMPTLEEYGTNLTKLAEEGKLDPVVGRQPQIERVVQILGRRTKNNPCLIGEPGVGKTAIAEGLAQRISTGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIEILRGLRERYEIHHKLRYTDEALIAAAKLSYQYISDRFLPDKAIDLIDEAGSRVRLQHAQVPEEARELDKELKQVTKQKNEAVRSQDFEKAGELRDREMELKAQITALIDKSKELSKAEEESGETGPMVNEEDIQHIVSSWTGIPVEKVSSDESDKLLKMEETLHKRVIGQDEAVVAISRSIRRARVGLKNPNRPIASFIFAGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDSDEKDSSYSRIKSLVIEEMKQYFRPEFLNRLDEMIVFRQLTKLEVKEIADIMLQEVFDRLKAKDINLQVTEKFKERVVDEGYNPSYGARPLRRAIMRLLEDSLAEKMLAGEVKEGDSAIVDVDSEGKVVVLNGQGGIPELSTPAITV

SEQ ID NO: 11055 - protein, 832 aa, Brachypodium distachyon
MFERFTEKAIKVIMLAQEEARRLGHNFVGTEQILLGLVGEGTGIAAKVLKSMGINLKDARVEVEKIIGRGNGFVAVEIPFTPRAKRVLELSLEEARQLGHNYIGSEHLLLGLLREGEGVAARVLESLGADPSNIRTQVVRMIGETTEAVGAGVGGGSSGNKMPTLEEYGTNLTKLAEEGKLDPVVGRQPQIERVVQILGRRTKNNPCLIGEPGVGKTAIAEGLAQRISSGDVPETIEGKKVITLDMGLLVAGTKYRGEFEERLKKLMEEIKQSDEIILFIDEVHTLIGAGAAEGAIDAANILKPALARGELQCIGATTLDEYRKHVEKDPALERRFQPVKVPEPSVDETIEILRGLQERYEIHHKLRYTDDALIAAAKLSYQYISDRFLPDKAIDLIDEAGSRVRLRHAQVPEEARELDKELKQITKDKNEAVRGQDFEKAGELRDREMELKAQITALIDKSKEMIKAETDSGETGPMVTEADIQHIVSSWTGIPVEKVSTDESDKLLKMEETLHKRVIGQDEAVKAISRSVRRARVGLKNPNRPIASFIFAGPTGVGKSELAKALASYYFGSEEAMIRLDMSEFMERHTVSKLIGSPPGYVGYTEGGQLTEAVRRRPYSVVLFDEIEKAHPDVFNMMLQILEDGRLTDSKGRTVDFKNTLLIMTSNVGSSVIEKGGRKIGFDLDSDEKDSSYGRIKSLVVEEMKQYFRPEFLNRLDEMIVFRQLTKLEVKDIAEIMLLEVFNRLKAKEINLQVTEKFKERVVDEGYNPSYGARPLRRAIMRLLEDSLAEKILAGEVKEGDSAIVDVDSEGKVIVLNGESGLPELPTPAVTV

SEQ ID NO: 11056 - protein, 507 aa, Gossypium raimondii
MAKVLAQSTIVPSLVTSRSHGRSTGKSKRSVKMMSSLRTPGLRINSFSGLRGSASLDNMVRVDQDFHSKVAISISSQRGRGSRCVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGEGNEVSVVTGGSTGNTKMPTLEEYGTNLTKLAEEGKLDPVVGRQDQIERVVQILGRRTKNNPCLIGEPGVGKTAIAEGLAQRIATGDVPDTIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPSVDETIQILKGLRERYEIHHKLRYTDEALISAAQLSYQYISDRFLPDKAIDLIDEAGSRVRLRHAQVCLYNNLVMK

SEQ ID NO: 11057 - protein, 924 aa, Pinus taeda
MAGTLAQSAILPGSIINSKYGPVKGSKRSRRAVKMIGNAHARSFPMQTFSGLRRVTSIDNIACPRKDFHAAVAAAVYLPSSKGNPRRGVVVAMFERFTEKAIKVIMLAQEEARRLGHNFVGTEQILLGLIGEGTGIAAKVLKSMGINLKEARIEVEKVIGRGSGFVAVEIPFTPRAKRVLELSLEEARQLGHSYIGSEHLLLGLLREGEGVAARVLENLGAEPSNIRTQVVRMVGENRDDDRAVVGPGSGSNKTPTLEEYGTNLTKLAEEGKLDPVVGRQPQIERVTQILGRRTKNNPCLIGEPGVGKTAIAEGLAQRIASGDVPETIEGKKVITLDMGLLVAGTKYRGEFEERLKKLMEEVKQSDDLILFIDEVHTLIGAGAAEGAIDAANILKPALARGELQCIGATTLDEYRKHIEKDPALERRFQPVQVPEPTVDETIQILKGLRERYEIHHKLRYTDEALVSAAQLSHQYISDRFLPDKAIDLIDEAGSRVRLRHAQLPEEARELEKELRQITKEKNEAVRSQDFEKAGELRDREMELKAQIVAITEKGKEKSKAESEASDEGPTVTEADIEHIVSSWTGIPVEKVSTDESDRLLKMEETLHHRVIGQDEAVKAISRAIRRARVGLKNPNRPIASFIFSGPTGVGKSELAKALAAYYFGSEEAMIRLDMSEFMERHTVSKLIGSPPGYVGYSEGGQLTEAVRRRPYTVVLFDEIEKAHPDVFNMMLQILEDGRLTDSKGRTVDFKNTLLIMTSNVGSSVIEKGGARIGFNLDYGEKDSSYTRIKSLVNEEMKQYFRPEFLNRLDEIIVFRQLTKIEVKEISDIMLKEVFERLKQKEIDLQVTERFRDRVVDEGYSPSYGARPLRRAIMRLLEDCMAEKMLAGEIKAGDSAIIDVDPEGNVTVLNGNSHSSASIPTMVTA

SEQ ID NO: 11058 - protein, 939 aa, Solanum phureja
MARALVQSTDILSSVAVAGERAGQFNGSRKNQRTVRMICDVKFPSLKLKSFVGLRGCNALDTLLVKSGETLHSKVAAATFVRRSQGCRFVPKAMFERFTEKAIKGIMLAQDEARRLGHDFVGTEQILLGLIGEGTGIAAKVLKSMGINLKDARVEVEKIIGRGSVFITVEIPFTPLAKRVLELSLEEARQLGHNYIHSEHLLLGLLRQGEGVAARVLENLGADPSNIRTQATNFPFSNWFEMLFLKPRVIRMVGESSDGATVGGGTSGLKMPTLEEYGTNLTKLAEEGKLDPVVGRQAQIERVTQILGRRTKNNPCLIGEPGVGKTAIAEGLAQRIANGDVPETIEGKKVITLDMGLLVAGTKYRGEFEERLKKLMEEIKQSDDIILFIDEVHTLIGAGAAEGAIDAANILKPALARRELQCIGATTLDEYRKHIEKDPALERRFQPVKVPEPSVDETIQILKGLRERYEIHHKLRYTDEAIEAAAKLSHQYISDRFLPDKAIDLIDEAGSRVRLRHAQLPEEARELEKELRQITKEKNESVRGQDFEKAGELRDREMDLKAQISALIYKNKEKSKAESEAGDAAGPLVTEADIQHIVSSWTGIPVEKVSTDESDRLLKMEETLHTRVIGQDEAVKAISRAIRRARVGLKNPNRPIASFIFSGPTGVGKSELAKSLATYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDFDEKDSSYNRIKSLVTEELKQYFRPEFLNRLDEMIVFRQLTKLEVKEIADIMLKEVFVRLKNKEIELQVTERFRDRVVDEGYNPSYGARPLRRAIMRLLEDSMAEKMLASEIKEGDSVIVDVDSDGNVTVLNGSSGAPSDPQIY

SEQ ID NO: 11059 - protein, 666 aa, Brassica napus
MARLLANFTARPLLGPGRHVQSDDYRKPRRCVKMMYTSQTPVLSIQSFSGLRAANAVDLIARPAHGFFSKVNLQISSRKGKSSRCVTKAMFERFTEKAIKVIMLSQEEARRLGHNFVGTEQILLGLIGEGTGIAAKVLKSMGINLKDSRVEVEKIIGRGSGFVAVEIPFTPRAKRVLELSLEEARQLGHNYIGSEHLLLGLLREGEGVAARVLENLGVDASNIRTQVVRMVGENNEVTASVGGGSSGNSKMPTLEEYGTNLTKLAEEGKLDPVVGRQPQIERVVQILARRTKNNPCLIGEPGVGKTAIAEGLAQRIASGDVPETIEGKTVITLDMGLLVAGTKYRGEFEERLKKLMEEIRQSDDIILFIDEVHTLIGAGAAEGAIDAANILKPALARGELQCIGATTLDEYRKHIEKDPALERRFQPVKVPEPTVDEAIQILHGLRERYEIHHKLRYTDEALVAAAQLSHQYISDRFLPDKAIDLIDEAGSRVRLRHAQVPEEARELEKQLRQITKEKNEAVRGQDFEKAGSHRDREIELRAEIAAVLAKGKEVSKAETEAGEEGGPTVTESDIQHIVSTWTGIPVEKVSSDESSRLLKMEQTLHTRVIGQDEAVKAISRAIRRARVGLKNPNRPIASFIFSGPPVWGNQSLPKPWLLTTSVQRKQ

SEQ ID NO: 11060 - protein, 934 aa, Physcomitrella patens
MAHSLTLPSAGAELTIGQLKCGAKSRRRAAARAAVGRLNVQAKSASLSLTPFQSFSGMRKASVIDSLTVKQGRDFKSVVSNSVAICNESRPSKAVTTAMFERFTEKAIKVIMLAQEEARRLGHNFVGTEQILLGLIGEGTGIAAKVMKSMGVNLKEARVEVEKIIGRGSGFVAVEIPFTPRAKRVLELSLEEARQLGHNYIGTEHLLLGLLREGEGVAARVLENLGADPSNIRTQVIRMVGENTEAVGVGAGSGSSGNKMPTLEEYGTNLTKLAEEGKLDPVVGRVAQIERVTQILGRRTKNNPCLIGEPGVGKTAVAEGLAQRIASGDVPETIEGKKVITLDMGLLVAGTKYRGEFEERLKKLMEEIKQADDIILVIDEVHTLIGAGAAEGAIDAANILKPALARGELQCIGATTLDEYRKHIEKDPALERRFQPVLVPEPTVEETIEILRGLRERYEIHHKLRYTDEALIAAAQLSYQYISDRFLPDKAIDLIDEAGSKVRLKHAQLPEEAKELDKELRAVTKEKNEAVRGQDFEKAGELRDREMELKAQISAFIEKDKEQMKAESETGDVGPTVEESDIQQIVSAWTGIPVEKVSSDESDRLLKMEDTLHNRVIGQDEAVKAISRAIRRARVGLKNPNRPIASFIFSGPTGVGKSELAKSLASYYFGSEEAMVRLDMSEFMERHTVSKLIGSPPGYVGYSEGGQLTEAVRRRPYTVVLFDEIEKAHPDVFNMMLQILEDGRLTDSKGRTVDFKNTLLIMTSNVGSSVIEKGGGGIGFQLDYGEKDSSYNRIKSLVNEELKQYFRPEFLNRLDEIIVFRQLTKLEVKEIADIMLKEVFERLKKKEIDLQVTERFRDRVVDEGYSPSYGARPLRRAIMRLLEDSMAERMLSGEIKEGDSAIIDVDGDGNVTVLNGTTGTASKTDTDMAPAGIA

SEQ ID NO: 11061 - protein, 833 aa, Papaver somniferum
MFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGESTEAVGAGVGGGSSGNKMPTLEEYGTNLTKLAEEGKLDPVVGRQPQIERVTQILGRRTKNNPCLIGEPGVGKTAIAEGLAQRIATGDVPETLEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETILILKGLRERYEIHHKLRYTDEALVAAANLSYQYISDRFLPDKAIDLIDEAGSRVRLRNAQLPEEARELEKELRQITKEKNESVRGQDFEKAGELRDREMDLKAQISALIDKGKERSKAESEAADTGPIVTEVDIQHIVSSWTGIPVDKVSSDESDKLLKMEETLHKRVIGQDEAVKAISRAIRRARVGLKNPNRPIASFIFSGPTGVGKSELAKTLAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKDIADIMLKEVFERLKVKEIELQVTERFRDRVVDEGYSPSYGARPLRRAIMRLLEDSMAEKMLQGEIKEGDSVIVDVDGDGNVTVLNGSNTGIPDALPPSVPV

SEQ ID NO: 11062 - protein, 833 aa, Papaver somniferum
MFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGESTEAVGAGVGGGSSGNKMPTLEEYGTNLTKLAEEGKLDPVVGRQPQIERVTQILGRRTKNNPCLIGEPGVGKTAIAEGLAQRIATGDVPETLEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETILILKGLRERYEIHHKLRYTDEALVAAANLSYQYISDRFLPDKAIDLIDEAGSRVRLRNAQLPEEARELEKELRQITKEKNESVRGQDFEKAGELRDREMDLKAQISALIDKGKEKSKAESEAADTGPIVTEVDIQHIVSSWTGIPVDKVSSDESDKLLKMEETLHKRVIGQDEAVKAISRAIRRARVGLKNPNRPIASFIFSGPTGVGKSELAKTLAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKDIADIMLKEVFERLKDKEIELQVTERFRDRVVDEGYSPSYGARPLRRAIMRLLEDSMAEKMLQGEIKEGDSVIVDVDGDGNVTVLNGSNTGIPDALPPSIPV

SEQ ID NO: 11063 - protein, 929 aa, Eutrema parvulum
MARLLANYTSRPLLGPGRHFQSEEYRKPRRCVKMMYSLQTTVLSIQSFSGLRASNAVDRVARPSQDFFSKVNLQISSRREKASRCVPKAMFERFTEKAIKVIMLSQEEARRLGHNFVGTEQILLGLIGEGTGIAAKVLKSMGINLKDSRVEVEKIIGRGSGFVAVEIPFTPRAKRVLELSLEEARQLGHNYIGSEHLLLGLLREGEGVAARVLENLGVDPSNIRTQVIRMVGENNEVTASVGGGSSGNSKMPTLEEYGTNLTKLAEEGKLDPVVGRQPQIERVVQILARRTKNNPCLIGEPGVGKTAIAEGLAQRIASGDVPETIEGKTVITLDMGLLVAGTKYRGEFEERLKKLMEEIRQSDDIILFIDEVHTLIGAGAAEGAIDAANILKPALARGELQCIGATTLDEYRKHIEKDPALERRFQPVKVPEPTVEEAIQILHGLRERYEIHHKLRYTDDALVAAAQLSHQYISDRFLPDKAIDLIDEAGSRVRLRHAQVPEEARELEKQLRQITKEKNEAVRGQDFEKAGSHRDREIELRAEIAAVLAKGKEVSKAETEVGEGGPTVTESDIQHIVSTWTGIPVEKVSSDESSRLLKMEQTLHTRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTLVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVVVRLKDKEIELQVTERFKERVVDEGFDPSYGARPLRRAIMRLLEDSMAEKMLSRDIKDGDSVIVDVDAEGSVVVLNGKSGGGGGFVAGEAMEEDPVPVL

SEQ ID NO: 11064 - protein, 928 aa, Eutrema parvulum
MARLLANYTSRPLLGPGRHFQSEEYRKPRRCVKMMYSLQTTVLSIQSFSGLRASNAVDRVARPSQDFFSKVNLQISSRREKASRCVPKAMFERFTEKAIKVIMLSQEEARRLGHNFVGTEQILLGLIGEGTGIAAKVLKSMGINLKDSRVEVEKIIGRGSGFVAVEIPFTPRAKRVLELSLEEARQLGHNYIGSEHLLLGLLREGEGVAARVLENLGVDPSNIRTQVIRMVGENNEVTASVGGGSSGNSKMPTLEEYGTNLTKLAEEGKLDPVVGRQPQIERVVQILARRTKNNPCLIGEPGVGKTAIAEGLAQRIASGDVPETIEGKTVITLDMGLLVAGTKYRGEFEERLKKLMEEIRQSDDIILFIDEVHTLIGAGAAEGAIDAANILKPALARGELQCIGATTLDEYRKHIEKDPALERRFQPVKVPEPTVEEAIQILHGLRERYEIHHKLRYTDDALVAAAQLSHQYISDRFLPDKAIDLIDEAGSRVRLRHAQVPEEARELEKQLRQITKEKNEAVRGQDFEKAGSHRDREIELRAEIAAVLAKGKEVSKAETEVGEGGPTVTESDIQHIVSTWTGIPVEKVSSDESSRLLKMEQTLHTRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTLVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVVVRLKDKEIELQVTERFKERVVDEGFDPSYGARPLRRAIMRLLEDSMAEKMLSRDIKDGDSVIVDVDAEGSVVVLNGKNGDGGGFVAEEAMEDPIPVL

SEQ ID NO: 11065 - protein, 837 aa, Panax ginseng
MFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGTEPNNIRTQVIRMVGESVEAGATVGGGSSGNKMPTLEEYGTNLTKLAEEGKLDPVVGRQQQIERVTQILGRRTKNNPCLIGEPGVGKTAIAEGLAQRIATGDVPETIEGKKVITLDMGLLVAGTKYRGEFEERLKKLMEEIKQSDEIILFIDEVHTLIGAGAGAGAAEGAIDAANILKPALARGELQCIGATTLDEYRKHIEKDPALERRFQPVKVPEPTVDETIQILKGLRERYEIHHKLRYTDEALVSAAQLSYQYISDRFLPDKAIDLIDEAGSRVRLRHAQLPEEARELEKELRQITKEKNEAVRSQDFEKAGELRDRETDLKTQISALVDRNKEMTKAETEAGDGGPLVIEVDIQHIVSSWTGIPVEKVSTDESDRLLKMEETLHTRIIGQDEGVKAISRAIHRARVGLKNPNRPIASFIFSGPTGVGKSELAKALAAYYFGSEEAMIRLDMSEFMERHTVSKLIGSLPGYVGYTEGGQLTEAVRRRPYTVVLFDEIEKAQPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQFTKLEVKEIADIMLKEVFERLKGKDIELQVTERFRDRVVEEGYNPSYGARPLRRAIMRLLEDSMAEKMLAREIKEGDSVIVDVDSDGNVTVLNGSSGAPPPESLPEPIAV

SEQ ID NO: 11066 - protein, 932 aa, Brassica napus
MARLLANSTSRSLLGSGRDFQSEDYRKPRRCVKMMMYTSQTSVLSIHSFSGLRASSNALDRVARPSHDFFGKVNLQISSSRKGKASRGVTKAMFERFTEKAIKVIMLSQEEARRLGHNFVGTEQILLGLIGEGTGIAAKVLKSMGINLKDSRVEVEKIIGRGSGFVAVEIPFTPRAKRVLELSLEEARQLGHNYIGSEHLLLGLLREGEGVAARVLENLGVDASNIRTQVIRMVGENNEVTASVGGGSSGNSKMPTLEEYGTNLTKLAEEGKLDPVVGRQPQIERVVQILARRTKNNPCLIGEPGVGKTAIAEGLAQRIASGDVPETIEGKTVITLDMGLLVAGTKYRGEFEERLKKLMEEIRQSDDIILFIDEVHTLIGAGAAEGAIDAANILKPALARGELQCIGATTLDEYRKHIEKDPALERRFQPVKVPEPTVDEAIQILHGLRERYEIHHKLRYTDEALVAAAQLSHQYISDRFLPDKAIDLIDEAGSRVRLRHAQVPEEARELERQLRQITKEKNEAVRGQDFEKAGSHRDREIELRAEIAAVLAKGKEVNKAETEAGEEGGPTVTESDIQHIVSTWTGIPVEKVSSDESSRLLKMEQTLHTRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTLVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVVVRLKDKEIELQVTERFKERVVDEGFDPSYGARPLRRAIMRLLEDSMAEKMLSREIKDGDSVIVDVDAEGSVVVLNGKNGSGDGFVAEEAMEDPIPVL

SEQ ID NO: 11067 - protein, 833 aa, Triphysaria pusilla
MFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQIIRMVGESAEVVGAGVGGGSSGSKMPTLEEYGTNLTKLAEEGKLDPVVGRQLQIERVVQILGRRTKNNPCLIGEPGVGKTAIAEGLAQRIATGDVPETIEGKKVITLDMGLLVAGTKYRGEFEERLKKLMEEIRQSDEIILFIDEVHTLIGAGAAEGAIDAANILKPALARGELQCIGATTLDEYRKHIEKDPALERRFQPVKVPEPTVDEAIQILRGLRERYEIHHKLRYTDDAIVAAAQLAHQYISDRFLPDKAIDLIDEAGSRVRLRHAQLPEEAKELEKELRQITKEKNEAVRGQDFEKAGELRDREMDLRSQISTLIDKNKEMTKAETEAGDEGPTVTEVDIQHIVSSWTGIPVDKVSTDESGRLLKMEETLHKRVIGQDEAVKAISRAIRRARVGLKNPNRPIASFIFSGPTGVGKSELAKSLATCYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSNVIEKGGRRIGFDLDYNEKDSSYNRIKSLVTEELKQYFRPEFLNRLDDMIVFRQLTKLEVKEISDIMLKEVFVRLKEKDIELQVTERFRDRVVDEGYDPSYGARPLRRAIMRLLEDSMAEKMLAREIKEGDSVIVDVDSDGKVVVLNGSGGAAPEPAPEPVVV

SEQ ID NO: 11068 - protein, 338 aa, Flaveria ramosissima
MFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPNNIRTQVIRMVGESAEAVGAGVGGGTSGNKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGLQPLMNIESTLRRTQHWRDGSSP

SEQ ID NO: 11069 - protein, 857 aa, Panax ginseng
MISIPRWQLQSLFDEEEPVEVYRKLCLSGSQKKQIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPNNIRTQVIRMVGESQEAGAVVGGGSSGNKMPTLEEYGTNLTKLAEEGKLDPVVGRQQQIERVTQILGRRTKNNPCLIGEPGVGKTAIAEGLAQRIATGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALVSAAQLSYQYISDRFLPDKAIDLIDEAGSRVRLRHAQLPEEARELEKELRQITKEKNEAVRGQDFEKAGELRDREMDLKTQITALVEKNKEMSKAETEAGDDGPIVTEVDIQHIVSSWTGIPVEKVSTDESDRLLKMEETLHTRVVGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFQRLKAKDIELQVTERFRDRVVEEGYNPSYGARPLRRAIMRLLEDSMAEKMLAREIKEGDSVIIDIDSDGNVTVLNGSSGAPPEALQEPVAV

SEQ ID NO: 11070 - protein, 829 aa, Tropaeolum majus
FTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGENNEVPANVGGGSSNNKMPTLEEYGTNLTKLAEEGKLDPVVGRQPQIERVVQILGRRTKNNPCLIGEPGVGKTAIAEGLAQRIASGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALVAAAQLSYQYISDRFLPDKAIDLIDEAGSRVRLRHAQVPEEARELEKELRQITKEKNEAVRGQDFEKAGTLRDREIELRAEITAIQTKGKEMNKAENETGDTGPLVTEVDIQHIVSSWTGIPVEKVSTDESDRLLKMEETLHKRVIGQDEAVKAISRAIRRARVGLKNPNRPIASFIFSGPTGVGKSELAKALATYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKDIADIMLKEVFDRLKTKDIELQVTERFRERVVDEGYNPSYGARPLRRAIMRLLEDSMAEKMLAREIKEGDSVIVDVDSDGNVTVLNGSSGAPESLEEDPIPVV

SEQ ID NO: 11071 - protein, 824 aa, Papaver somniferum
MFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPNNIRTQVIRMVGESTEAVGAGVGGGSTNSKMPTLEEYGTNLTKLAEEGKLDPVVGRAAQIERVTQILGRRTKNNPCLIGEPGVGKTAIAEGLAQRIASGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDESIQILKGLRERYEIHHKLRYTDEALEAAARLSYQYISDRFLPDKAIDLIDEAGSRVRLRNAQLPEEARELEKELRQITKEKNEAVRGQDFEKAGELRDREMDLRAQITNVVDKGKELSKAESESGDTGPVVTEVDIQHIVASWTGIPVDKVSSDESDKLLKMEDTLHTRVIGQDEAVKAISRAIRRARVGLKNPNRPIASFIFSGPTGVGKSELAKTLASYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSNVIEKGGRRIGFDLDYDEKDSSYNRIKSLVQEELKQYFRPEFLNRLDEMIVFRQLTKLEVKEIADIMLKEVFERLRKKEIELQVTERFRDRVVDEGYNPSYGARPLRRAIMRLLEDSMAEKMLGGEIKEGDSVIVDVDGDGNVTVLNGTSPQLV

SEQ ID NO: 11072 - protein, 934 aa, Ceratodon purpureus
MAHSLMVPSVGASPVAQLQGGAKSRRWAAARGALVGRKNVQAESASLSISLFQSFSGMRKAFGIDSLSVKQGKDLRSVVARSTAVSKQSGASRAVTTAMFERFTEKAIKVIMLAQEEARRLGHNFVGTEQILLGLIGEGTGIAAKVLKSMGVNLKEARVEVEKIIGRGSGFVAVEIPFTPRAKRVLELSLEEARQLGHNYIGTEHLLLGLLREGEGVAARVLENLGADPSNIRTQVIRMVGENTEAVGVGGGSGSSGNKMPTLEEYGTNLTKLAEEGKLDPVVGRVAQIERVTQILGRRTKNNPCLIGEPGVGKTAVAEGLAQRIASGDVPETIEGKKVITLDMGLLVAGTKYRGEFEERLKKLMEEIKQADDIILVIDEVHTLIGAGAAEGAIDAANILKPALARGELQCIGATTLDEYRKHIEKDPALERRFQPVLVPEPTVDETIEILKGLRERYEIHHKLRYTDEALVAAAQLSYQYISDRFLPDKAIDLIDEAGSRVRLKHAQLPEEARELDKELRAVTKEKNEAVRGQDFEKAGELRDREMELKAQISAFIEKGKEQMKAESETDDVGPTVEESDIQQIVAAWTGIPMEKVSSDESDRLLKMEDTLHNRVVGQDEAVKAISRAIRRARVGLKNPNRPIASFIFSGPTGVGKSELAKALASYYFGSEEAMVRLDMSEFMERHTVSKLIGSPPGYVGYSEGGQLTEAVRRRPYTVVLFDEIEKAHPDVFNMMLQILEDGRLTDSKGRTVDFKNTLLIMTSNVGSSVIEKGGGGIGFQLDYGEKDSSYNRIKSLVNEELKQYFRPEFLNRLDEIIVFRQLTKLEVKEIADIMLKEVFERLKKKEIDLQVTERFRDRVVDEGYSPSYGARPLRRAIMRLLEDSMAERMLSGEIKEGDSAIIDVDSDGTVTVLNGTTGTSSNTLIDVTPSGIA

SEQ ID NO: 11073 - protein, 819 aa, Panax ginseng
MLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPNNIRTQVIRMVGESQEAGAVVGGGSSGNKMPTLEEYGTNLTKLAEEGKLDPVVGRQQQIERVTQILGRRTKNNPCLIGEPGVGKTAIAEGLAQRIATGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALVSAAQLSYQYISDRFLPDKAIDLIDEAGSRVRLRHAQLPEEARELEKELRQITKEKNEAVRGQDFEKAGELRDREMDLKTQITALVEKNKEMSKAETEAGDDGPIVTEVDIQHIVSSWTGIPVEKVSTDESDRLLKMEETLHTRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVFQRLKAKDIELQVTERFRDRVVEEGYNPSYGARPLRRAIMRLLEDSMAEKMLAREIKEGDSVIIDIDSDGNVTVLNGSSGAPPEALQEPVAV

SEQ ID NO: 11074 - protein, 928 aa, Brassica rapa
MARLLANFTARPLLGPGRHVQSDDYRKPRRCVKMMYTSQTPVLSIQSFSGLRAANAVDLIARPAHGFFSKVNLQISSRKGKASRCVTKAMFERFTEKAIKVIMLSQEEARRLGHNFVGTEQILLGLIGEGTGIAAKVLKSMGINLKDSRVEVEKIIGRGSGFVAVEIPFTPRAKRVLELSLEEARQLGHNYIGSEHLLLGLLREGEGVAARVLENLGVDASNIRTQVVRMVGENNEVTASVGGGSSGNSKMPTLEEYGTNLTKLAEEGKLDPVVGRQPQIERVVQILARRTKNNPCLIGEPGVGKTAIAEGLAQRIASGDVPETIEGKTVITLDMGLLVAGTKYRGEFEERLKKLMEEIRQSDDIILFIDEVHTLIGAGAAEGAIDAANILKPALARGELQCIGATTLDEYRKHIEKDPALERRFQPVKVPEPTVDEAIQILHGLRERYEIHHKLRYTDEALVAAAQLSHQYISDRFLPDKAIDLIDEAGSRVRLRHAQVPEEARELEKQLRQITKEKNEAVRGQDFEKAGSHRDREIELRAEIAAVLAKGKEVSKAETEAGEEGGPTVTESDIQHIVSTWTGIPVEKVSSDESSRLLKMEQTLHTRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTLVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVVVRLKDKEIELQVTERFKERVVDEGFDPSYGARPLRRAIMRLLEDSMAEKMLSREIKDGDSVIVDVDAEGSVVVLNGKSGGGGSFAEEAMEDPILVL

SEQ ID NO: 11075 - protein, 836 aa, Brassica napus
MFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGENNEVTANVGGGSGSNKMPTLEEYGTNLTKLAEEGKLDPVVGRQPQIERVVQILGRRTKNNPCLIGEPGVGKTAIAEGLAQRIASGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDESLVAAAQLSYQYISDRFLPDKAIDLIDEAGSRVRLRHAQVPEEARELEKELRQITKEKNEAVRGQDFEKAGTLRDREIELRAEVSAIQAKGKEMSKAESETGEEGPMVTESDIQHIVSSWTGIPVEKVSTDESDRLLKMEETLHKRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADILLQEVFERLKKKEIELQVTERFRERVVDEGYNPSYGARPLRRAIMRLLEDSMAEKMLAREIKEGDSVIVDVDSEGKVTVLNGGSGTPTTSLEEQEDSLPVA

SEQ ID NO: 11076 - protein, 937 aa, Physcomitrella patens
MSSLAHSLTLPSVGANLNVGQLNGGAKSWRRAAAKASLGRRNMHSKSVSSTIGPFQSFSGMRKASVIDSLIVKQGKDFKSVVANSTQVLNQCQPSKAVTTAMFERFTEKAIKVIMLSQEEARRLGHNFVGTEQILLGLIGEGTGIAAKVLKSMGVNLKEARVEVEKIIGRGSGFVAVEIPFTPRAKRVLELSLEEARQLGHNYIGTEHLLLGLLREGEGVAARVLENLGADPSNIRTQVIRMVGENTEAVGVRSGSGSSGNKMPTLEEYGTNLTKLAEEGKLDPVVGRISQIERVTQILGRRTKNNPCLIGEPGVGKTAVAEGLAQRIASGDVPETIEGKNVVTLDMGLLVAGTKYRGEFEERLKKLMEEIKQADDIILVIDEVHTLIGAGAAEGAIDAANILKPALARGELQCIGATTLDEYRKHIEKDPALERRFQPVLVPEPTVEETIEILRGLRERYEIHHKLRYTDEALIAAAQLSYQYISDRFLPDKAIDLIDEAGSKVRLKHAQLPEEAKELDKELRAVTKEKNEAVRGQDFEKAGELRDREMELKAQISAFIEKDKEKVKAESETGDVGPTVEEADIQQIVSAWTGIPVEKVSSDESDRLLKMEDTLHNRVIGQDEAVKAISRAIRRARVGLKNPNRPIASFIFSGPTGVGKSELAKSLASYYFGSEEAMVRLDMSEFMERHTVSKLIGSPPGYVGYSEGGQLTEAVRRRPYTVVLFDEIEKAHPDVFNMMLQILEDGRLTDSKGRTVDFKNTLLIMTSNVGSSVIEKGGGGIGFQLDYGEKDSSYNRIKSLVNEELKQYFRPEFLNRLDEIIVFRQLTKLEVKEIADIMLKEVFERLKKKEIDLQVTERFRDRVVEEGYSPSYGARPLRRAIMRLLEDSMAERMLSGEIKEGDSAIIDVDGDGNVTVLNGTTGTSSKTDIDVSPAGIA

SEQ ID NO: 11077 - protein, 748 aa, Lupinus angustifolius
  misc_feature (715)..(742): Xaa can be any naturally occurring amino acid
MARVLAQSINIPGIVSGQRNGQHKGSGKSKRPVKMMSTLRMPGIRLTTFSGLRASNPLDTMLRPGQDFHSKVLTATSSRRARASRCVPKAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPTNIRTQVIRMVGESADSVPASVGGQGSGSNKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQNDDIILFIDEVHTLIGAGAAEGAIDAANILKPALARGELQCIGATTLDEYRKHIEKDPALERRFQPVKVPEPTVDESIQILRGLRERYELHHKLRYTDDALVAAAQLSYQYISDRFLPDKAIDLIDEAGSRVRLQHAQLPEDARVLDKEVRQIVKEKGEAVRNQDFEKAGELRDKEMDLKAQISALVEKGKEMSKAESEAGDEGPVVTEVDIQHIVASWTGIPVDKVSADESDRLLKMEETLHKRIIGQDEAVKAISRAIRRARVGLKNPNRPIASFIFSGPTGVGKSELAKSLASYYFGSEEAMIRLDMSEFMERHTVSKLIGSPPGYVGYTEGGQLTEAVRRRPYTVVLXXXXXXXXXXXXXXXXXXXXXXXXXXXXSRTHFL

SEQ ID NO: 11078 - protein, 836 aa, Arabidopsis thaliana
MFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGENNEVTANVGGGSSSNKMPTLEEYGTNLTKLAEEGKLDPVVGRQPQIERVVQILGRRTKNNPCLIGEPGVGKTAIAEGLAQRIASGDVPETIEGKKVITLDMGLLVAGTKYRGEFEERLKKLMEEIRQSDEIILFIDEVHTLIGAGAAEGAIDAANILKPALARGELQCIGATTLDEYRKHIEKDPALERRFQPVKVPEPTVDETIQILKGLRERYEIHHKLRYTDESLVAAAQLSYQYISDRFLPDKAIDLIDEAGSRVRLRHAQVPEEARELEKELRQITKEKNEAVRGQDFEKAGTLRDREIELRAEVSAIQAKGKEMSKAESETGEEGPMVTESDIQHIVSSWTGIPVEKVSTDESDRLLKMEETLHKRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADILLKEVFERLKKKEIELQVTERFKERVVDEGYNPSYGARPLRRAIMRLLEDSMAEKMLAREIKEGDSVIVDVDAEGNVTVLNGGSGTPTTSLEEQEDSLPVA

SEQ ID NO: 11079 - protein, 833 aa, Euphorbia peplus
MFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLENLGADPSNIRTQVIRMVGESTENIPAPVGPGGSNNKMPTLEEYGTNLTKLAEEGKLDPVVGRQPQIERVIQILGRRTKNNPCLIGEPGVGKTAIAEGLAQRIATGDVPETIERKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDDSLVAAAQLSYQYISDRFLPDKAIDLIDEAGSRVRLRHAQVPEEARELEKEVRQIIKEKDEAVRGQDFEKAGELRDREMDLRAQITAIVEKGKEMSKAESEAADEGPMVHESDIQHIVSSWTGIPVEKVSTDESDRLLKMEDTLHKRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYTRIKSLVTEELKQYFRPEFLNRLDEMIVFRQLNRAEVKDIADIMLKEVFDRLKNKEIELQVTERFRERVVEEGYNPSYGARPLRRAIMRLLEDSMAEKMLAGEIKEGDSVIVDVDSSGNVIVLNGSSGSPEAMPDVLSIV

SEQ ID NO: 11080 - protein, 929 aa, Brassica napus
MARLLANFTARPLLGPGRHVQSDEYRKPRRCVKMMYTSQTPVLSIQSFSGLRSANAVDLIARPAHGFFSKVNLQISSRKGKASRCVTTKAMFERFTEKAIKVIMLSQEEARRLGHNFVGTEQILLGLIGEGTGIAAKVLKSMGINLKDSRVEVEKIIGRGSGFVAVEIPFTPRAKRVLELSLEEARQLGHNYIGSEHLLLGLLREGEGVAARVLENLGVDASNIRTQVIRMVGENNEVTASVGGGSSGNSKMPTLEEYGTNLTKLAEEGKLDPVVGRQPQIERVVQILARRTKNNPCLIGEPGVGKTAIAEGLAQRIASGDVPETIEGKTVITLDMGLLVAGTKYRGEFEERLKKLMEEIRQSDDIILFIDEVHTLIGAGAAEGAIDAANILKPALARGELQCIGATTLDEYRKHIEKDPALERRFQPVKVPEPTVDEAIQILHGLRERYEIRHKLRYTDEALVAAAQLSHQYISDRFLPDKAIDLIDEAGSRVRLRHAQVPEEARELEKQLRQITKEKNEAVRGQDFEKAGSHRDREIELRAEIAAVLAKGKEVSKAETEAGEEGGPTVTESDIQHIVSTWTGIPVEKVSSDESSRLLKMEQTLHTRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTLVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVVVRLKDKEIELQVTERFKERVVDEGFDPSYGARPLRRAIMKLLEDSMAEKMLSREIKDGDSVIVDVDAEGSVVVLNGKSGGGGSFAEEAMEDPILVL

SEQ ID NO: 11081 - protein, 933 aa, Physcomitrella patens
MAHSLTIPSVGASPVGQFNGSRKSKKQGAARAASMGRRNVDKSASMSVARFQSFSGMRKGSVVDALVVKQGKDFKSVVANSTAVTGHSRPSRGVTTAMFERFTEKAIKVIMLAQEEARRLGHNFVGTEQILLGLIGEGTGIAAKVLKSMGVNLKEARVEVEKIIGRGSGFVAVEIPFTPRAKRVLELSLEEARQLGHNYIGTEHLLLGLLREGEGVAARVLENLGADPSNIRTQVIRMVGENTEAVGVGGGSGSSGNKMPTLEEYGTNLTKLAEEGKLDPVVGRVAQIERVTQILGRRTKNNPCLIGEPGVGKTAVAEGLAQRIASGDVPETIEGKKVITLDMGLLVAGTKYRGEFEERLKKLMEEIKQADDIILVIDEVHTLIGAGAAEGAIDAANILKPALARGELQCIGATTLDEYRKHIEKDPALERRFQPVLVPEPTVEETIDILKGLRERYEIHHKLRYTDEALVAAAQLSYQYISDRFLPDKAIDLIDEAGSKVRLKHAQLPEEARELDKQLRAVTKEKNEAVRGQDFEKAGELRDKEMELKAQISAFIEKGKEQMKAESETGDVGPTVEESDIQQIVAAWTGIPMEKVSSDESDRLLKMEDTLHTRVIGQDEAVKAISRAIRRARVGLKNPNRPIASFIFSGPTGVGKSELAKALASYYFGSEEAMVRLDMSEFMERHTVSKLIGSPPGYVGYSEGGQLTEAVRRRPYTVVLFDEIEKAHPDVFNMMLQILEDGRLTDSKGRTVDFKNTLLIMTSNVGSSVIEKGGGGIGFQLDYGEKDSSYNRIKSLVNEELKQYFRPEFLNRLDEIIVFRQLTKLEVKEIADIMLKEVFERLKKKEIDLQVTERFRDRVVDEGYSPSYGARPLRRAIMRLLEDSMAERMLSGEIKEGDSAIIDVDGDGNVTVLNGTTGTSTNTAVDQAPAGIA

SEQ ID NO: 11082 - protein, 933 aa, Physcomitrella patens
MAHSLTLPSVGSSLVGQLNDSAKSKRRTIAQAASTGRKNLKKSASLSVSGFQSFSGMRKASAVDALTVKQGKDLKSVVAKSMAVAGHSRPSRGVTFAMFERFTEKAIKVIMLAQEEARRLGHNFVGTEQILLGLIGEGTGIAAKVLKSMGVNLKEARVEVEKIIGRGSGFVAVEIPFTPRAKRVLELSLEEARQLGHNYIGTEHLLLGLLREGEGVAARVLENLGADPSNIRTQVIRMVGENNEAVGVGGGSGSGSNKMPTLEEYGTNLTKLAEEGKLDPVVGRVAQIERVTQILGRRTKNNPCLIGEPGVGKTAVAEGLAQRIASGDVPETIEGKKVITLDMGLLVAGTKYRGEFEERLKKLMEEIKQADDIILVIDEVHTLIGAGAAEGAIDAANILKPALARGELQCIGATTLDEYRKHIEKDPALERRFQPVLVPEPTVEETIEILKGLRERYEIHHKLRYTDEALIAAAQLSYQYISDRFLPDKAIDLIDEAGSKVRLKHAQLPEEARELDKQLRAVTKEKNEAVRGQDFEKAGELRDKEMELKAQISVFIEKGKEQMKAESETGDVGPTVEESDIQQIVAAWTGIPMEKVSSDESDRLLKMEDTLHNRVIGQDEAVKAISRAIRRARVGLKNPNRPIASFIFSGPTGVGKSELAKALASYYFGSEEAMVRLDMSEFMERHTVSKLIGSPPGYVGYSEGGQLTEAVRRRPYTVVLFDEIEKAHPDVFNMMLQILEDGRLTDSKGRTVDFKNTLLIMTSNVGSSVIEKGGGGIGFQLDYGEKDSSYNRIKSLVNEELKQYFRPEFLNRLDEIIVFRQLTKLEVKEIADIMLKEVFERLKKKEIDLQVTERFRDRVVDEGYSPSYGARPLRRAIMRLLEDSMAERMLSGEIKEGDSAIIDVDSDGGVTVLNGTTGTSTNTAIDQAPAGIA

SEQ ID NO: 11083 - protein, 919 aa, Physcomitrella patens
MAHSLTLPSVGSSLVGQLNDSAKSKRRTIAQAASTGRKNLKKSASLSVSGFQSFSGMRKASAVDALTVKQGKDLKSVVAKSMAVAGHSRPSRGVTFAMFERFTEKAIKVIMLAQEEARRLGHNFVGTEQILLGLIGEGTGIAAKVLKSMGVNLKEARVEVEKIIGRGSGFVAVEIPFTPRAKRVLELSLEEARQLGHNYIGTEHLLLGLLREGEGVAARVLENLGADPSNIRTQVIRMVGENNEAVGVGGGSGSGSNKMPTLEEYGTNLTKLAEEGKLDPVVGRVAQIERVTQILGRRTKNNPCLIGEPGVGKTAVAEGLAQRIASGDVPETIEGKKVITLDMGLLVAGTKYRGEFEERLKKLMEEIKQADDIILVIDEVHTLIGAGAAEGAIDAANILKPALARGELQCIGATTLDEYRKHIEKDPALERRFQPVLVPEPTVEETIEILKGLRERYEIHHKLRYTDEALIAAAQLSYQYISDRFLPDKAIDLIDEAGSKVRLKHAQLPEEARELDKQLRAVTKEKNEAVRGQDFEKAGELRDKEMELKAQISVFIEKGKEQMKAESETGDVGPTVEESDIQQIVAAWTGIPMEKVSSDESDRLLKMEDTLHNRVIGQDEAVKAISRAIRRARVGLKNPNRPIASFIFSGPTGVGKSELAKALASYYFGSEEAMVRLDMSEFMERHTVSKLIGSPPGYVGYSEGGQLTEAVRRRPYTVVLFDEIEKAHPDVFNMMLQILEDGRLTDSKGRTVDFKNTLLIMTSNVGSSVIEKGGGGIGFQLDYGEKDSSYNRIKSLVNEELKQYFRPEFLNRLDEIIVFRQLTKLEVKEIADIMLKEVFERLKKKEIDLQVTERFRDRVVDEGYSPSYGARPLRRAIMRLLEDSMAERMLSGEIKEGDSAIIDVDSDANYNEEFEVEKD

SEQ ID NO: 11084 - protein, 835 aa, Pteridium aquilinum
MFERFTEKAIKVIMLAQEEARRLGHNFVGTEQILLGLIGEGTGIAAKVLKSMGVNLKEARIEVEKIIGRGSGFVAVEIPFTPRAKRVLELSLEEARQLGHNYIGSEHLLLGLLREGEGVAARVLENLGADPSNIRTQVIRMVGESTEAVGAGVGGGSSNAKMPTLEEFGTNLTKLAEDGKLDPVVGRQPQIERVTQILGRRTKNNPCLIGEPGVGKTAIAEGLAQRISAGDVPETIEGKKVITLDMGLLVAGTKYRGEFEERLKKLMEEIKQADDIILFIDEVHTLIGAGAAEGAIDAANILKPALARGELQCIGATTLDEYRKHIEKDPALERRFQPVQVPEPTVDETIQILQGLRERYEIHHKLRYTDEALVAAAQLSYQYISDRFLPDKAIDLIDEAGSRVRLRHAQLPEEAKELDKELRQITKEKNEAVRGQDFEKAGELRDREMELKAQISAITEKGKEKIKAESEAGDVGPLVTEADIQQIVSAWTGIPVEKVSIDESSRLLKMEETLHKRVIGQDEAVKAISRAIRRARVGLKNPNRPIASFIFSGPTGVGKSELAKALAAYYFGSEEAMVRLDMSEFMERHTVSKLIGSPPGYVGYSEGGQLTEAVRRRPYTVVLFDEIEKAHPDVFNMMLQILEDGRLTDSKGRTVDFKNTLLIMTSNVGSSVIEKGGGGIGFQLDYGEKDSSYNRIKTLVNEELKQYFRPEFLNRLDEIIVFRQLTKSEVKEIADIMLKEVFDRVKKKLIDIQVTERFRDRIVDEGYSPSYGARPLRRAIMRLLEDSMAERILGGEIKEGDSAIIDVDTEGNVTVLNGTTGTASTSAIEAPAGIA

SEQ ID NO: 11085 - protein, 929 aa, Eutrema halophilum
MARLLANFTVRPLLGPGRHLQSEEYRKPRSRVKMMSSLHAPVLSIRNYSGLRVNSALDLMASRSPDFFAKVNISISSRKGKASRCVPKAMFERFTEKAIKVIMLSQEEARRLGHNFVGTEQILLGLIGEGTGIAAKVLKSMGINLKDSRVEVEKIIGRGSGFVAVEIPFTPRAKRVLELSLEEARQLGHNYIGTEHLLLGLLREGEGVAARVLENLGVDSSNIRTQVIRMVGENNEVTASVGGGSSGNSKMPTLEEYGTNLTKLAEEGKLDPVVGRQPQIERVVQILARRTKNNPCLIGEPGVGKTAIAEGLAQRIASGDVPETIEGKTVITLDMGLLVAGTKYRGEFEERLKKLMEEIRQSDDIILFIDEVHTLIGAGAAEGAIDAANILKPALARGELQCIGATTLDEYRKHIEKDPALERRFQPVKVPEPTVEEAIQILHGLRERYEIHHKLRYTDDALVAAAQLSHQYISDRFLPDKAIDLIDEAGSRVRLRHAQVPEEARELEKQLRQITKEKNEAVRGQDFEKAGAHRDREIELRAEIAAVLAKGKEVSKAETEAEEGGPTVTESDIQHIVSTWTGIPVEKVSSDESSRLLKMEQTLHTRVIGQDEAVKAISRAIRRARVGLKNPNRPIASFIFSGPTGVGKSELAKALAAYYFGSEEAMIRLDMSEFMERHTVSKLIGSPPGYVGYSEGGQLTEAVRRRPYTLVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVVVRLKDKEIELQVTERFKERVVDEGFDPSYGARPLRRAIMRLLEDSMAEKMLSRDIKDGDSVIVDVDAEGSVVVLNGKSGGGGGFVAGEAMEEDPVPVL

SEQ ID NO: 11086 - protein, 87 aa, Sequoia sempervirens
MFERFTEKAIKVIMLSQEEARRLGHNFVGTEQILLGLIGEGTGIAAKVLKSMGVNLKEARIEVEKIIGRGGGLLLWRFHSLQEQSVC

SEQ ID NO: 11087 - protein, 901 aa, Brassica napus
MARLLANSTSRSLLGSGRDFLQSDDYRKPRRCVKMMYTSQTSVLSIQSFSGLRASNALDRVARPSHDFFGKVNLQMSSSRRGKASRGVTKAMFERFTEKAIKVIMLSQEEARRLGHNFVGTEQILLGLIGEGTGIAAKVLKSMGINLKDSRVEVEKIIGRGSGFVAVEIPFTPRAKRVLELSLEEARQLGHNYIGSEHLLLGLLREGEGVAARVLENLGVDASNIRTQVIRMVGENNEVTASVGGGSSGNSKMPTLEEYGTNLTKLAEEGKLDPVVGRQPQIERVVQILARRTKNNPCLIGEPGVGKTAIAEGLAQRIASGDVPETIEGKTVITLDMGLLVAGTKYRGEFEERLKKLMEEIRQSDDIILFIDEVHTLIGAGAAEGAIDAANILKPALARGELQCIGATTLDEYRKHIEKDPALERRFQPVKVPEPTVDEAIQILHGLRERYEIHHKLRYTDEALVAAAQLSHQYISDRFLPDKAIDLIDEAGSRVRLRHAQVPEEARELERQLRQITKEKNEAVRGQDFEKAGSHRDREIELRAEIAAVLAKGKEVNKAETEAGEEGGPTVTESDIQHIVSTWTGIPVEKVSSDESSRLLKMEQTLHTRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTLVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVVVRLKDKEIELQVTERFKERVVDEGFDPSYGARPLRRAIMRLLEDSMAEKMLSREIKDGDSVIVDVDA

SEQ ID NO: 11088 - protein, 782 aa, Euonymus alatus
MGINLKDARVEVEKIIGRGSGFVAVEIPFTPRAKRVLELSLEEARQLGHNYIGSEHLLLGLLREGEGVAARVLENLGADPSNIRTQVIRMVGESNENAVGVTPGGGGSNKMPTLEEYGTNLTKLAEEGKLDPVVGRQPQIERVVQILGRRTKNNPCLIGEPGVGKTAIAEGLAQRIASGDVPDTIEGKKVITLDMGLLVAGTKYRGEFEERLKKLMEEIKQSDEIILFIDEVHTLIGAGAAEGAIDAANILKPSLARGELQCIGATTLDEYRKHIEKDPALERRFQPVKVPEPTVDETILILQGLRERYEIHHKLRYTDEALVSAAKLSYQYISDRFLPDKAIDLVDEAGSRVRLRHAQLPEEARELEKELRQITKEKNEAVRSQDFEKAGELRDREMDLKAQISAVVDKGKEMSKAESEAGDVGPIVTEVDIQHIVSSWTGIPVDKVSSDESDRLLKMEETLHKRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRMGFDMDYDDKDSSYNRIKSLVTEELKQYFRPEFLNRLDEMIVFRQLTKLEVKDIADIMLKEVFERLKVREIELQVTERFRDRVVEEGYNPSYGARPLRRAIMRLLEDSMAEKMLAREIKEGDSVIVDVDSDGNVTVLNGSSGAPESLPDSLSVV

SEQ ID NO: 11089 - protein, 952 aa, Arabidopsis thaliana
MAWSIALLTPPFFGPGRHVQAKEYREPRGCVMKMSSLKAPVLRIQATEYREPRGRVKMMSSLQAPLLTIQSFSGLRAPSALDYLGRPSPGFLVKYKLAKSSGREKASRCVPKAMFERFTEKAIKVIMLSQEEARRLGHNFVGTEQILLGLIGEGTGIAAKVLKSMGINLKDSRVEVEKIIGRGSGFVAVEIPFTPRAKRVLELSLEEARQLGHNYIGSEHLLLGLLREGEGVAARVLENLGADPSNIRTQVIRMVGENNEVTASVGGGSSGNSKMPTLEEYGTNLTKLAEEGKLDPVVGRQPQIERVVQILARRTKNNPCLIGEPGVGKTAIAEGLAQRIASGDVPETIEGKTVITLDMGLLVAGTKYRGEFEERLKKLMEEIRQSDEIILFIDEVHTLIGAGAAEGAIDAANILKPALARGELQCIGATTIDEYRKHIEKDPALERRFQPVKVPEPTVEEAIQILQGLRERYEIHHKLRYTDEALVAAAQLSHQYISDRFLPDKAIDLIDEAGSRVRLRHAQLPEEARELEKQLRQITKEKNEAVRSQDFEMAGSHRDREIELKAEIANVLSRGKEVAKAENEAEEGGPTVTESDIQHIVATWTGIPVEKVSSDESSRLLQMEQTLHTRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTLVLFDEIEKAHPDVFNMMLQILEDGRLTDSKGRTVDFKNTLLIMTSNVGSSVIEKGGRRIGFDLDHDEKDSSYNRIKSLVTEELKQYFRPEFLNRLDEMIVFRQLTKLEVKEIADIMLKEVVARLEVKEIELQVTERFKERVVDEGFDPSYGARPLRRAIMRLLEDSMAEKMLSRDIKEGDSVIVDVDAEGSVVVLSGTTGRVGGFAAEEAMEDPIPIL

SEQ ID NO: 11090 - protein, 839 aa, Arabidopsis thaliana
MFERFTEKAIKVIMLSQEEARRLGHNFVGTEQILLGLIGEGTGIAAKVLKSMGINLKDSRVEVEKIIGRGSGFVAVEIPFTPRAKRVLELSLEEARQLGHNYIGSEHLLLGLLREGEGVAARVLENLGADPSNIRTQVIRMVGENNEVTASVGGGSSGNSKMPTLEEYGTNLTKLAEEGKLDPVVGRQPQIERVVQILARRTKNNPCLIGEPGVGKTAIAEGLAQRIASGDVPETIEGKTVITLDMGLLVAGTKYRGEFEERLKKLMEEIRQSDEIILFIDEVHTLIGAGAAEGAIDAANILKPALARGELQCIGATTIDEYRKHIEKDPALERRFQPVKVPEPTVEEAIQILQGLRERYEIHHKLRYTDEALVAAAQLSHQYISDRFLPDKAIDLIDEAGSRVRLRHAQLPEEARELEKQLRQITKEKNEAVRSQDFEMAGSHRDREIELKAEIANVLSRGKEVAKAENEAEEGGPTVTESDIQHIVATWTGIPVEKVSSDESSRLLQMEQTLHTRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTLVLFDEIEKAHPDVFNMMLQILEDGRLTDSKGRTVDFKNTLLIMTSNVGSSVIEKGGRRIGFDLDHDEKDSSYNRIKSLVTEELKQYFRPEFLNRLDEMIVFRQLTKLEVKEIADIMLKEVVARLEVKEIELQVTERFKERVVDEGFDPSYGARPLRRAIMRLLEDSMAEKMLSRDIKEGDSVIVDVDAEGSVVVLSGTTGRVGGFAAEEAMEDPIPIL

SEQ ID NO: 11091 - protein, 836 aa, Ceratodon purpureus
MFERFTEKAIKVIMLAQEEARRLGHNFVGTEQILLGLIGEGTGIAAKVLKSMGVNLKEARVEVEKIIGRGSGFVAVEIPFTPRAKRVLELSLEEARQLGHNYIGTEHLLLGLLREGEGVAARVLENLGADPSNIRTQVIRMVGESTESVGAGVGGGSSSNKMPTLEEYGTNLTKLAEEGKLDPVVGRQPQIERVTQILGRRTKNNPCLIGEPGVGKTAIAEGLAQRIATGDVPETIEGKKVITLDMGLLVAGTKYRGEFEERLKKLMEEIKQADDIILVIDEVHTLIGAGAAEGAIDAANILKPALARGELQCIGATTLDEYRKHIEKDPALERRFQPVLVPEPTVDETIQILKGLRERYEIHHKLRYTDEALVAAAQLSYQYISDRFLPDKAIDLIDEAGSRVRLRHAQLPEEARELDKELRGVTKEKNEAVRGQDFEKAGELRDREMELKAQISTITEKGKEQLKAESEAGDTGPMVEESDIQHIVSAWTGIPVEKVSSDESDRLLKMEDTLHQRVVGQDEAVKAISRAIRRARVGLKNPNRPIASFIFSGPTGVGKSELAKALASYYFGSEEAMVRLDMSEFMERHTVSKLIGSPPGYVGYSEGGQLTEAVRRRPYTVVLFDEIEKAHPDVFNMMLQILEDGRLTDSKGRTVDFKNTLLIMTSNVGSSVIEKGGGGIGFQLDYGEKDSSYNRIKSLVNEELKQYFRPEFLNRLDEIIVFRQLTKLEVKEIADIMLKEVFERLKKKEIDLQVTERFRDRVVDEGYSPSYGARPLRRAIMRLLEDSMAERMLAGEIKEGDSAIIDVDSEGGVTVLNGTTGTSSSTAINETPAGIA

SEQ ID NO: 11092 - protein, 953 aa, Arabidopsis lyrata
MAWCVAVLKAPLFGPGRHVQAEEYRKPRGCVKMMCNFQAPGLRIQAKEYRKPRGCVKMMCSLQAPVLKIQSFSGLRAPSALDYMARPSPGFLVKFKRAISSRREKASRCVPKAMFERFTEKAIKVIMLSQEEARRLGHNFVGTEQILLGLIGEGTGIAAKVLKSMGINLKDSRVEVEKIIGRGSGFVAVEIPFTPRAKRVLELSLEEARQLGHNYIGSEHLLLGLLREGEGVAARVLENLGADPSNIRTQVIRMVGENNEVTASVGGGSSGNSKMPTLEEYGTNLTKLAEEGKLDPVVGRQPQIERVVQILARRTKNNPCLIGEPGVGKTAIAEGLAQRIASGDVPETIEGKTVITLDMGLLVAGTKYRGEFEERLKKLMEEIRQSDEIILFIDEVHTLIGAGAAEGAIDAANILKPALARGELQCIGATTLDEYRKHIEKDPALERRFQPVKVPEPTVEEAIQILHGLRERYEIHHKLRYTDEALVAAAQLSHQYISDRFLPDKAIDLIDEAGSRVRLRHAQVPEEARELEKQLRQITKEKNEAVRGQDFEMAGSHRDREIELRAEIANVLALGKEVAKAENEAEEGGPTVTESDIQHIVATWTGIPVEKVSSDESSRLLQMEQTLHTRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTLVLFDEIEKAHPDVFNMMLQILEDGRLTDSKGRTVDFKNTLLIMTSNVGSSVIEKGGRRIGFDLDHDEKDSSYNRIKSLVTEELKQYFRPEFLNRLDEMIVFRQLTKLEVKEIADIMLKEVVARLEDKEIELQVTERFKERVVDEGFDPSYGARPLRRAIMRLLEDSMAEKMLSRDIKEGDSVIVDVDAEGSVVVLSGNNSGRAGGFTAEEAMEDPIPVL

SEQ ID NO: 11093 - protein, 700 aa, Distylium racemosum
MFERFTEKAIKVIMLAQEEARRLGHNFVGTEQILLGLIGEGTGIAAKVLKSMGINLKEARIEVEKIIGRGGGFVAVEIPFTPRAKRVLELSLEEARQLGHNYIGSEHLLLGLLREGEGVAARVLENLGADPSNIRTQVIRMVGESTEAVGAGVGGSSNSNKMPTLEEYGTNLTRLAEEGKLDPVVGRQPQIERVTQILGRRTKNNPCLIGEPGVGKTAIAEGLAQRIASGDVPETIEGKKVITLDMGLLVAGTKYRGEFEERLKKLMEEVKQSDDIILFIDEVHTLIGAGAAEGAIDAANILKPALARGELQCIGATTLDEYRKHIEKDPALERRFQPVQVPEPTVDETIQILGGLRERYEIHHKLRYTDEALIAAAQLSHQYISDRFLPDKAIDLLDEAGSRVRLRHAQLPEEAKELEKELRQITKEKNEAVRNQDFEKAGELRDREMELRAQITAVTEKGKEKSKAETEVADGGPTVTEADIQQIVAAWTGIPVQKVSTDESDKLLKMEDTLHNRIIGQDEAVVAISRAIRRARVGLKNPNRPIASFIFSGPTGVGKSELAKALATYYFGSEEAMIRLDMSEFMERHTVSKLIGSPPGYVGYSEGGQLTEAVRRRPYTVVLFDEIEKAHPDVFNMMLQILEDGRLTDSKGRTVDFKNTLLIMTSNVGSSVIEKGGRRMGFQFLMMLRRIQVIRELRVL

SEQ ID NO: 11094 - protein, 925 aa, Podocarpus macrophillus
MAKAVAQSSILSANIIDAKLGQIKLSKGSRSGVKMIAKTCFKAINMRGSCLRQATSIDMVRYSQKDFKAAVAASLCLPGVKVKASRGVVKAMFERFTEKAIKVIMLAQEEARRLGHNFVGTEQILLGLIGEGTGYAAKVLKNMGINLKEARAEVEKIVGKGSGFVAVEIPFTPRAKRVLELSLEEARQLGHKHIGSEHLLLGLLREGEGVAARVLENLGADPSSIRTQVIRMVAENADPVTSGVDGSSSTSKMPTLEEYGTNLTRLAEEGKLDPVVGRQPQIERVTQILGRRTKNNPCLIGEPGVGKTAIAEGLAQRIASGDVPETIEGKKVITLDMGLLVAGTKYRGEFEERLKKLMEEVRQSDDIILFIDEVHTLIGAGAAEGAIDAANILKPALARGELQCIGATTLDEYRKHIEKDPALERRFQPVQVPEPTVDEAIQILGGLRERYEIHHKLRYTDEALAAAAQLSHQYISDRFLPDKAIDLIDEAGSRVRLRHAQIPEEAKELEKELRQISKEKNEAVRNQDFEKAGELRDREMELRAQITAVTEKGKEESKAETEVEDGGPTVTEADIHEIVAAWTGIPVQKVSTDESDKLLKMEDTLHHRIIGQDEAVVAISRAIRRARVGLKNPSRPIASFIFSGPTGVGKSELAKALAAYYFGSEEAMIRLDMSEFMERHTVSKLIGSPPGYVGYSEGGQLTEAVRRRPYTVVLFDEIEKAHPDVFNMMLQILEDGRLTDSKGRTVDFKNTLLIMTSNVGSSVIEKGGCRMGFQFMDDDVEEDANYTRIKSLVIEEMKRYFRPEFLNRLDEIIVFRQLTKTEVKEISDIMLKEVFERLKLKEIDLQVTERFRDRVVDEGYSPSYGARPLRRAIMRLLEDCMAEKMLSGEIKEGDSAIVDVDLDGNVTVLSGSSGKSASPSTMIVA

SEQ ID NO: 11095 - protein, 925 aa, Sciadopitys verticillata
MAGTLAQSAILSASIIDTKRGQIKTSKISRAVKITNAYARPLNMTSFSRFPRLTSTGIICCPQKDFRAAVAAALCLPATKKKPSRGVCVAMFERFTEKAIKVIMLGQEEARRLGHNHVGTEQILLGMIGEGTGIAAKVLKSMGINLKEARIEVEKLIGRGNGFVAVEIPFTPRAKRVLELAFEEARQLGHSYIGSEHLLLGLLREGEGVAASVLEKLGADPSNIRTQVIRMVGESAEAVGAGVGGASSSNKMPTLDEYGTNLTRLAEEGKLDPVVGRQPQIERVTQILGRRTKNNPCLIGEPGVGKTAIAEGLAQRIVSGDVPETVEGKKVVTLDMGLLVAGTKYRGEFEERLKKLMDEVKQSDDIILFIDEVHTLIGAGAAEGAIDAANILKPALARGELQCIGATTLDEYRKHIEKDPALERRFQPVQVPEPTVDETIQILGGLRERYEIHHKLRYTDEALVAAAELSHQYISDRFLPDKAIDLIDEAGSRVRLRHAQLPEEARELEKEFRQITKEKNEAVRSQDFEKASELRDREVELKAQIAAVTEKGKEKSKAETEVGDAGPTVTEADIQQIVSAWTGIPVSKVSADESGRLMKMEETLHQRVIGQDEAVKAISRAIRRARVGLKNPNRPIASFIFSGPTGVGKSELAKTLASYYFGSEEAMIRLDMSEYMERHTVAKLIGSPPGYVGYSEGGQLTEAVRRRPYTVVLFDEIEKAHPDVFNMMLQILEDGRLTDSKGRTVDFKNTLLIMTSNVGSSVIERGGKRKNMFMFDFEEDEEDSSYTSIKSLVNEELKSYFRPEFLNRLDEIIVFRQLTKLEVKEISDIMLKEVFERLKQKEIDLQVTERFKDRVVNEGYSPTYGARPLRRAIMRLLEDCMAEKMLSGEIKEGDSAIVDVDSEGKVTVLNGTSGAAEPSTTLTPV

SEQ ID NO: 11096 - protein, 942 aa, Cephalotaxus harringtonia
MAGTLSQFAVLPYRIISASHGQIHSSKRVNRVPKMMGNTQSNSLRIKSYIGLCQPTGLGKVACPTTKFHPAAAVSTPARKSRKARKDKKGVVTCMFERFTEKAIKVIMLSQEEARRLGHNFVGTEQILLGLIGEGTGIAAKVLKSMGVNLKEARVEVEKIIGRGGGFVAVEIPFTPRAKRVLELALEEARQLGHNYIGSEHLLLGLLREGEGVAARVLEKLGADPSNIRTQVIRMVGESTEAVGAGVGGGSSSNKMPTLEEYGTNLTKLAEEGKLDPVVGRQPQIERVTQILGRRTKNNPCLIGEPGVGKTAIAEGLAQRIAAGDVPETIEGKKVITLDMGLLVAGTKYRGEFEERLKKLMDEIRQSDEIILFIDEVHTLIGAGAAEGAIDAANILKPALARGELQCIGATTLDEYRKHIERDPALERRFQPVQVPEPSVDETIQILKGLRERYEIHHKLRYTDEALVSAAKLSYQYISDRFLPDKAIDLVDEAGSRVRLRHAQLPEEARELDKELRQITKEKNEAVRGQDFEKAGELRDREMELKAQITTVTEKGKEKSKAENEAGDAGPIVTEVDIQQIVSSWTGIPVEKVSSDESDKLLRMEDTLHQRVIGQDEAVKAISRAIRRARVGLKNPNRPIASFIFSGPTGVGKSELAKTLATYYFGSEEAMIRLDMSEYMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRHGFLFHFEDDEEDNSYTRIKSLVLEELKSYFRPEFLNRLDETIVFRQLTKSEVKKIAGIMLKEVYERLKIKEIDLQVTPRFVDRVVDEGYSSTYGARSLRRAIMRLLEDSMAEKMLSGEIKEGDSAIVDVNEEGNVTVLNGNRSSGTVAPSTPAVAPSTPAVAVMEKTS

SEQ ID NO: 11097 - protein, 837 aa, Phalaenopsis aphrodite
MAGACVQSVTLPAGLASIGRSRGSRGSRRAARMLCSPRLCPLRFQGYSGLRYSNVLDHNSKSGYGFHSMVGAYISAPKGKAIRGVAVAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLESLGADPSNIRTQVIRMVGESTEAVGAGVGGGSSGNKMPTLEEYGTNLTKLAEEGKLDPVVGRQQQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVKVPEPTVDETIQILKGLRERYEIHHKLRYTDEALIAAAQLSYQYISDRFLPDKAIDLIDEAGSRVRLRHAQLPEDARELDKELRQITKDKNEAVRSQDFEKAGELRDREMELKAQISALIDKGKEISKAESEAGDAGPIVTEVDIQHIVSSWTGIPVEKVSSDESDRLLKMEETLHQRVIGQDEAVKAISRAIRRARVGLKNPNRPIASFIFSGPTGVGKSELAKALAAYYFGSEDAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVSRGEDEGH

SEQ ID NO: 11098 - protein, 911 aa, Zea mays
MQAGMNHCTLLSSALDLGTSNPHALDPHTLDLGTSNLRGQHPTIPTLWIWERAISAHLCWFVLHPHAPNILHQRTYLSPISAPFHLTWKPKSPPQSAFIVDSYIRAIPSNMETSMPTSISVHRRVPPSSAHSVPSTLSTSIKTHDHCEGCRQIPHQTSTLVVCSTPITIAVGFNAFAGHNYVGSEHLLLGLLREGEGVAARVLESLGADPNNIRTQVIRMVGESTEAVGAGVGGGSSGQKMPTLEEYGTNLTKLAEEGKLDPVVGRQDQIERVTQILGRRTKNNPCLIGEPGVGKTAIAEGLAQRIANGDVPETIEGKKVITLDMGLLVAGTKYRGEFEERLKKLMEEIKQNEDIILFIDEVHTLIGAGAAEGAIDAANILKPALARGELQCIGATTLDEYRKHIEKDPALERRFQPVKVPEPTVDETIQILRGLRERYELHHKLRYTDDALIAAAQLSYQYISDRFLPDKAIDLIDEAGSRVRLRHAQLPDEAKELDKELRQITKQKNEAVRGQDFEKAGELRDREMELKAQITAIIDKSKEMIKAETESGEVGPLVTEADIQHIVSSWTGIPVEKVSSDESDRLLKMEETLHTRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDYDEKDTSYNRIKSLVTEELKQYFRPEFLNRLDEMIVFRQLTKLEVKEIADIMLKEVFDRLKAKDINLQVTEKFRDRVVDEGYNPSYGARPLRRAIMRLLEDSLAEKMLAGEVKEGDSAIVDVDSDGKVIVLNGGSGVAEPLEPALST

SEQ ID NO: 11099 - protein, 888 aa, Brassica rapa
MARLLANSTSRSLLGSGRDFQSEDYRKPRRCVKMMYTSQTSVLSIQSFSGLRASNALDRVARPSHDFFGKVNLQMSSSRREKASRGVTKAMFERFTEKAIKVIMLSQEEARRLGHNFVGTEQILLGLIGEGTGIAAKVLKSMGINLKDSRVEVEKIIGRGSGFVAVEIPFTPRAKRVLELSLEEARQLGHNYIGSEHLLLGLLREGEGVAARVLENLGVDASNIRTQVIRMVGENNEVTASVGGGSSGNSKMPTLEEYGTNLTKLAEEGKLDPVVGRQPQIERVVQILARRTKNNPCLIGEPGVGKTAIAEGLAQRIASGDVPETIEGKTVITLDMGLLVAGTKYRGEFEERLKKLMEEIRQSDDIILFIDEVHTLIGAGAAEGAIDAANILKPALARGELQCIGATTLDEYRKHIEKDPALERRFQPVKVPEPTVDEAIQILHGLRERYEIHHKLRYTDEALVAAAQLSHQYISDRFLPDKAIDLIDEAGSRVRLRHAQVPEEARELERQLRQITKEKNEAVRGQDFEKAGSHRDREIELRAEIAAVLAKGKEVNKAETEAGEEGGPTVTESDIQHIVSTWTGIPVEKVSSDESSRLLKMEQTLHTRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTLVLFDEIEKAHPDVFNMMLQILEDGRLTDSKGRTVDFKNTLLIMTSNVGSSVIEKGGRRIGFDLDYDEKDSSYNRIKSLVTEELKQYFRPEFLNRLDEMIVFRQLTKLEVKEIADIMLKEVVVRLKDKEIELQVTERFKERVVDEGFDPSYGARPLRRAIMRLLEDSMAEKMLSREI

SEQ ID NO: 11100 - protein, 836 aa, Physcomitrella patens
MFERFTEKAIKVIMLSQEEARRLGHNFVGTEQILLGLIGEGTGIAAKVLKSMGVNLKEARVEVEKIIGRGSGFVAVEIPFTPRAKRVLELSLEEARQLGHNYIGTEHLLLGLLREGEGVAARVLENLGADPSNIRTQVIRMVGENTEAVGVRSGSGSSGNKMPTLEEYGTNLTKLAEEGKLDPVVGRISQIERVTQILGRRTKNNPCLIGEPGVGKTAVAEGLAQRIASGDVPETIEGKNVVTLDMGLLVAGTKYRGEFEERLKKLMEEIKQADDIILVIDEVHTLIGAGAAEGAIDAANILKPALARGELQCIGATTLDEYRKHIEKDPALERRFQPVLVPEPTVEETIEILRGLRERYEIHHKLRYTDEALIAAAQLSYQYISDRFLPDKAIDLIDEAGSKVRLKHAQLPEEAKELDKELRAVTKEKNEAVRGQDFEKAGELRDREMELKAQISAFIEKDKEKVKAESETGDVGPTVEEADIQQIVSAWTGIPVEKVSSDESDRLLKMEDTLHNRVIGQDEAVKAISRAIRRARVGLKNPNRPIASFIFSGPTGVGKSELAKSLASYYFGSEEAMVRLDMSEFMERHTVSKLIGSPPGYVGYSEGGQLTEAVRRRPYTVVLFDEIEKAHPDVFNMMLQILEDGRLTDSKGRTVDFKNTLLIMTSNVGSSVIEKGGGGIGFQLDYGEKDSSYNRIKSLVNEELKQYFRPEFLNRLDEIIVFRQLTKLEVKEIADIMLKEVFERLKKKEIDLQVTERFRDRVVEEGYSPSYGARPLRRAIMRLLEDSMAERMLSGEIKEGDSAIIDVDGDGNVTVLNGTTGTSSKTDIDVSPAGIA

SEQ ID NO: 11101 - protein, 593 aa, Sequoia sempervirens
MFERFTEKAIKVIMLSQEEARRLGHNFVGTEQILLGLIGEGTGIAAKVLKSMGVNLKEARVEVEKIIGRGSGFVAVEIPFTPRAKRVLELALEEARQLGHNYIGSEHLLLGLLREGEGVAARVLEKLGVDPGNIRTQVIRMVGESSEAVGAGVGGGTSSNKMPTLEEYGTNLTKLAEEGKLDPVVGRQPQIERVTQILGRRTKNNPCLIGEPGVGKTAIAEGLAQRIASGDVPETIEGKKVITLDMGLLVAGTKYRGEFEERLKKLMDEIKQSDEIILFIDEVHTLIGAGAAEGAIDAANILKPALARGELQCIGATTLDEYRKHIEKDPALERRFQPVQVPEPTVDDAIEILKGLRERYEIFHKLRYTDEALESAAKLSHQYISDRFLPDKAIDLIDEAGSRVHLRHSQLPEEAKELEREVRQITKEKNEAVRGQDFEKAGELRDREMELKAQITAITQKGKEKTKAEHEAGDGGVVVTEVDIQQIVSLWTGIPVEKVSSDESDKLLKMEDTLHQRVIGQDEAVKAISRAIRRARVGLKNPNRPIASFIFSGPTGVGKSELAKALAAYYFGSEEAMIRLDMSEYMERHTVPS

SEQ ID NO: 11102 - protein, 836 aa, Ceratodon purpureus
MFERFTEKAIKVIMLAQEEARRLGHNFVGTEQVLLGLIGEGTGIAAKVLKSMGVNLKEARVEVEKIIGRGSGFVAVEIPFTPRAKRVLELSLEEARQLGHNYIGTEHLLLGLLREGEGVAARVLENLGADPSNIRSQVIRMVGENTEAVGVGGGTSSSGNKMPTLEEYGTNLTKLAEEGKLDPVVGRVPQIERVTQILGRRTKNNPCLIGEPGVGKTAVAEGLAQRIASGDVPETIEGKKVITLDMGLLVAGTKYRGEFEERLKKLMEEIKQADDIILVIDEVHTLIGAGAAEGAIDAANILKPALARGELQCIGATTLDEYRKHIEKDPALERRFQPVLVPEPTVDETIEILKGLRERYEIHHKLRYTDEALVAAAQLSYQYISDRFLPDKAIDLIDEAGSRVRLKHAQLPEEARELDKELRAVTKEKNEAVRGQDFEKAGELRDREMELKSQISACIEKGKEHMKAESETGDVGPTVEESDIQQIVAAWTGIPMEKVSSDESDRLLKMEDTLHNRVIGQDEAVKAISRAIRRARVGLKNPNRPIASFIFSGPTGVGKSELAKALASYYFGSEEAMVRLDMSEFMERHTVSKLIGSPPGYVGYSEGGQLTEAVRRRPYTVVLFDEIEKAHPDVFNMMLQILEDGRLTDSKGRTVDFKNTLLIMTSNVGSSVIEKGGGGIGFQLDYGEKDSSYNRIKSLVNEELKQYFRPEFLNRLDEIIVFRQLTKLEVKEIADIMLKEVFERLKKKEIDLQVTERFRDRVVDEGYSPSYGARPLRRAIMRLLEDSMAERMLSGEIKEGDSAIIDVDSEGSVTVLNGSTGMSSNTLIDVTPSGIA

SEQ ID NO: 11103 - protein, 655 aa, Setaria italica
MKRARSSEVFVGGSRLRARRRLAPLLAAAAFAYLLFVSVKLAGFGGAGPAGAVSRLSAAGAGAGEPLRGRVEQPAVPRARARPAAAVSGYGRITGEILRRQESGGGRRRRWGQLGNFTELERTAAEAWALGAKAWEEASAFAGDVDSIASRDAGECPGSLALGGGGEAAAFLPCGLAAGSAVTVVGTPRAARPEYVEALERSGAGNGTVMVAQFAVELRGLRAADGEEPPRILHLNPRLRGDWSGRPVLEMNTCFRMQWGRAQRCDGTPSRDDAQVDGFRKCEKWQRRDIVESKETKTSSWFNRFIGRAKKPEMTWPFPFSEGKMFVLTIQAGVEGYHINVGGRHVASFPHRMGFALEDATGLAVTGGIDVHSVYATALPRAHPSFSLQQVLEMSEKWKARPVPVEPIQLFVGILSATNHFAERMAIRKTWMQFPAIQLGNVVARFFVALSHRKEINAALKKEAEYFGDIVILPFIDRYELVVLKTVAICQYGVQNVTADYIMKCDDDTFVRLDIVLQQITTYNRTLPLYLGNLNLLHRPLRRGKWAVTYEEWPEAVYPPYANGPGYVLSIDIARDIASRHANHSLRLFKMEDVSMGMWVEDYNATAPVQYIHSWRFCQFGCVDNYFTAHYQSPRQMLCLWDKLSAGRAQCCNYR

SEQ ID NO: 11104 - protein, 610 aa, Panicum virgatum
FGSAGPAAAVGRLAAAGAGEPLRRRVEQPAPRARAAAVSGYGRITGEILRRREAGEGRRRRWGQLGNFTELERAAAEAWALGARAWEAASAFTGDVDSIASLDAGEGPAECPGSLALGGGETTVAFLPCGLAAGSAVTVVGTARAARPEYVEALERSGAGNGTVMVAQFAVELRGVRAADGEEPPRILHLNPRLRGDWSGRPVLEMNTCFRMQWGRAQRCDGTPSRDDDQVDGFRKCEKWQRQDIVESKETRTSSWFNRFIGRAKKPEMTWPFPFSEGNMFVLTIQAGVEGYHINMGGRHVASFPHRMGFALEDATGLAVTGGIDVHSVYATALPRSHPSFSLQQVLEMSERWKARPVPEEPIQLFIGILSATNHFAERMAIRKTWMQFPAIQLGSVVARFFVALSHRKEINAALKKEAEYFGDIVILPFIDRYELVVLKTVAICQYGVQNVTADYIMKCDDDTFVRLDIVLQQITTYNRTLPLYLGNLNLLHRPLRSGKWAVTYEEWPEAVYPPYANGPGYVLSIDIARDIASRHANHSLRLFKMEDVSMGMWVEDYNATAPVQYVHSWRFCQFGCVDYYFTAHYQSPRQMLCLWDKLSAGQARCCNYR

SEQ ID NO: 11105 - protein, 630 aa, Sorghum bicolor
MKRARSSEGFLGVCRLRSRRGLAPLLAAAAFAYLLFVSVKLAGLSGAVGTAPAVGRRLATAGAGKLPPLRRRVDKPPARAMGGTSGGGVSGYGRIINEMLQRQEAVWERRKRWGRLGNFTELERLAAKAWALGAVAWEEASAFAGDVDDIAGDGEGAAAKCPGSLTLNAGETEAFLPCGLAAGSAVTVVGMAREARPEYVEALERSGAGNGTVLVAQFAVELRGLRAVDGEEPPRILHLNPRLRGDWSGRSVLEMNTCFRMQWGRAQRCDGTPWPSSDLHLVDGFRKCEGWERQDIVESKETKTSSWFNRFIGREKKPEMTWPFPFSEGKMFVLTIQAGVEGYHINVGGRHVASFPHRMGFTLEDATGLAVTGGIDVHSVYATALPTAHPSFSLQQVLEMSERKTWMQFPAIQSGNAVARFFVALSHRKEINAALKKEAEYFGDIVILPFMDRYELVVLKTVALCQYGVQNVTADYIMKCDDDTFVRLDVVLQQIAAYNRTLPLYLGNLNLYHSPQRSGKWAVTFEEWPEAAYPPYANGPGYVISADIARDIASRHTNHSLRLFKMEDVSMGMWVEDFNASAPVQYVHSWRFCQFGCVDHYLTAHYQSPWHMLCLWEKLSAGRRDCCNYI

SEQ ID NO: 11106 - protein, 662 aa, Hordeum vulgare
MKRARSSEIFLVGRARARRRLAPLLAAAAFAYLVFVSVKLSGLGSWEDAASIPRPETAASRGELLQRDVPERAPRGRRAAAGGAAVTGYGRITGEILRRHEALGGGSRRRWGLRGNFSELERMASEAWALGAKSWEEASAFSGDVDAIISGDGAAVKCPASLELGGGGEGETAAFLPCGLAVGSAVTVVATARAAVAEYVEALERSGSGNGTVMVAQFAVELRGLRASEGEDPPRILHLNPRLRGDWSRRPVLEMNTCFRMQWGKAQRCDGTPSKDDDHVDGFPKCEKWERRDMADSKETKTSSWFNRFIGRAKKPEMTWPYPFLEGKMFVLTIQAGVEGYHINVGGRHVASFPHRMGFTLEDATGLAVTGGIDVHSVYATSLPKAHPSFSLQNVLEMSDKWKARPVPEEPIQLFIGILSATNHFAERMAIRKTWMQFPAIQLGNVVARFFVALSHRKEINAALKKEAEYFGDVVILPFIDRYELVVLKTVAICQYGVQNVTAEYIMKCDDDTFVRLDVVLQQVSTFNRTLPLYLGNLNLLHRPLRSGKWAVTFEEWPELVYPPYANGPGYVISIDIARDIASRHANQSLRLFKMEDVSMGMWVEDYNTTTIAAPVQYIHSWKFCQYGCVDNYFTAHYQSPRQMLCLWDKLSLGRAQCCNYR

SEQ ID NO: 11107 - protein, 658 aa, Oryza sativa
MKRARSSEVFLGGRGRARRRVAPLLAAVAFVYLLFVSFKLSGLAGIADPAAVTRPASGGAGEVVMPRRLEDPAPRARGDGDGVAVAGYGRITGEILRRRWEAGGRGRRRWGRGGNFSELERMADEAWELGGKAWEEACAFTGDVDSILSRDGGGETKCPASINIGGGDGETVAFLPCGLAVGSAVTVVGTARAARAEYVEALERRGEGNGTVMVAQFAVELRGLRAVEGEEPPRILHLNPRLRGDWSHRPVLEMNTCFRMQWGKAHRCDGNPSKDDDQVDGLIKCEKWDRRDSVDSKETKTGSWLNRFIGRAKKPEMRWPYPFSEGKMFVLTIQAGIEGYHVSVGGRHVASFPHRMGFSLEDATGLAVTGGVDVHSIYATSLPKVHPSFSLQQVLEMSDRWKARPVPEEPIQVFIGIISATNHFAERMAIRKSWMQFPAIQLGNVVARFFVALSHRKEINAALKTEADYFGDVVILPFIDRYELVVLKTVAICEFGVQNVTAEYIMKCDDDTFVRLDVVLKQISVYNRTMPLYMGNLNLLHRPLRHGKWAVTYEEWPEFVYPPYANGPGYVISIDIARDIVSRHANHSLRLFKMEDVSMGMWVEDFNTTAPVQYIHSWRFCQFGCVHNYFTAHYQSPWQMLCLWNKLSSGRAHCCNYR

SEQ ID NO: 11108 - protein, 398 aa, Oryza sativa
MAAATTSLLLEATPRLLSLPPRRPVQPRGGIFLLKPPPPPPFPSRRGVAVAVAPPLRASHPDTARRVSVSPAAVEPPPKPRALLDAIKRSLLDSLAALKKPALALLLAGALLAAAGPHHGAALAASGGRVGGSAFSSRSSSPPSSYGYTAPAPRGGYSAAPFYSPSPFVSVGPAVGIGFGGSSFFFVLMGFAAFLYLAGFLSDSSGGSVLTETDKTTVLKLQVGLLGMARSFQKELDQIAEKADTSTPAGLSYVLTETTLALLRHPDCCISAYSSVDVKRSIDDGEKRFNQLSIEERGKFDEETLVNVNSIKRQKAGSQRSSGFSNEYIVITILVAAEGVHKLPSINGSGDLKTALQKLGAIPSRKILAVEVLWTPQNENDTLSERELLEDYPLLRPL

SEQ ID NO: 11109 - protein, 287 aa, Avena sativa
PHHDAALAASGGRVGGSAFSSSRSSSSSRSSYGYTAPSPRGGGGYSSAPFYSPSPFVSVGPAFGIGFGGSGFLLTLVGFAAFLYLGGFLTDSSGGGSVLTDTQKTTVLKLQVGLLGLARSFQKELDQIAEKADTSTPAGLSYVLTETTLSLLRHPDCCISAYSTVDVKRSIDDGEKRFNQLSIEERGKFDEETLVNVNSIKRQKAGNQRSTGFSNEYIVITILVAAEGVHKIPTINSSSDLKTALQTLGGLPSSKILAVEVLWTPQNENDTLSERELLEDYPLLRPL

SEQ ID NO: 11110 - protein, 392 aa, Triticum aestivum
MAAASLLEPARFLSPHHPRSLRPPPRRGPHHLRRSPLPAHARFPRLRAHPPAPIPPCPVAAEPAARPPPPHPLLDALKRSLLDSLAALRKPALALLLAGALLAAAAPHHAALAASGGRVGGSAFSSRSSRSSPSPSYGYTAPAPRMGGGYSSAPFYSPSPFVSVGPAFGIGFGGSGFLLTLVGFAAFLYLGGFLTDSSGGGSVLTDTQKTTVLKLQVGLLGMARSFQKELDQIAEKADTSTPAGLSFVLTETTLALLRHPDCCISAYSTVDVKRSMDDGEKRFNQLSIEERGKFDEETLVNVNSIKRQKAGTQRSSGFSNEYIVITILVAAEGVYKLPTINSSSDLKTALQMLGGVPSSKIMAVEVLWTPQNENDTLSERELLEDYPLLRPL

SEQ ID NO: 11111 - protein, 239 aa, Secale cereale
PFYSPSPFVSVGPAFGVGFGGSGFLLTLVGFAAFLYLGGFLTDSSGGGSVLTDTQKTTVLKLQVGLLGMARSFQKELDQIAEKADTSTPAGLSFVLAETTLALLRHPDCCISAYSTVDVKRSMDDGEKRFNQLSIEERGKFDEETLVNVNSIKRQKAGTQRSSGFSNEYIVITILVAAEGVYKLPTINSSSDLKTALQMLGGVPSSKIMAVEVLWTPQNENDTLSERELLEDYPLLRPL

SEQ ID NO: 11112 - protein, 200 aa, Pennisetum glaucum
YLAGFLSDSPGNGSVLTETQKTTVLKLQVGLLGMARSFQKELDQIAEKADTSTPAGLSYVLTETTLALLRHPDCCISAYSSVDVKRSMDDGEKRFNQLSIEERGKFDEETLVNVNSIKRNKAGGQRSSGFSNEYIVITILVAAEGVYKLPVINSSNDLKTALQNLGGIPSSKILAVEVLWTPQNENDTLSERELLEDYRF

SEQ ID NO: 11113 - protein, 282 aa, Amorphophallus konjac
MRRWPHRGAGWGAGPSRPPRPRSPPPGATRCPPGLPSLSRRPITMPRRHSSAAGGAVYVGFGAGSGFFLLMAGFAAVVLLSGFLSDRSDDGSVLTATQKTSVLKLQVGLLGLARTFQKDLDQIAETADTSTPEGLSYILTETTLALLRHPDCCISGYSSVDIKRSLEDGEKRFNQLSIEERGKFDEETLVNVNSIKRRSSGGSRSNAFSNEYIVVTILVAAEGVHKIPVINGSADLKEALQKLGSIPSSRIMAVEVLWTPQNENDSLSERELLEDYPLLRPL

SEQ ID NO: 11114 - protein, 401 aa, Cucumis sativus
LLEPHPLKWNKTFRVHLPSSPSPSTSGRYHLCRPFIVPRNLKIHDSSSVKYPVRCFFSEKGRSSTTSISNSSSVELVNGDKPKSPMEVIGNSIINALKALQKPAIAAVLLGLLLMYDPNSALAASGGRVGGNAFSSRSSSSSRSYSTPRMSSGFSYSAPYTSPSMFGGGGIYVGPAVGVGLGAGSSFVFILAGFAAFLLVSGFLSDRSDTSVLTASDKTSVLKLQVGLLGMGRGLQRDLNRIAESADTSTPEGLCYVLTETILALLRHPDYCISGYSSIDVKRSIEEGEKRFNKLSIEERGKFDEETLVNVNSIKRQSTSSQRTSGFSNEYIVITILVAAEGVHKLPTINGSGDLKEALQKLASIPSSKILAVEVLWTPQNENDTLSERELLEDYPLLRPL

SEQ ID NO: 11115 - protein, 388 aa, Curcuma longa
MGSASLLETVSVLREPPKRPRPPLYLLRWHPLLRLPQPRFPHYRARKHVGFSLRCALVPPSGAEGRRDKKEGLLEAAWSTVLEAMERIKKPAAALILLGVLLTADPHGALAASGGRMGGRAFSSSPSRSHSSSSWSYSAPPSSSFFYSAPYYAPSPFGGGFYVGSAFGAGSGFFLLMMGFAAVILLSGFLSDRDSDGSVLTATQKTSVIKLQVGLLGMARSFQRDLDNIAQAADTSTPEGLNYVLTETTLALLRHPDCCISAYSSVDIKRSIEDGERRFNQLSIEERGKFDEETLVNVNSIRRQKTSNLTFKGFSNEYIVVTILVAAEGVYKLPVINSSSDLKEALQKLGSIPSSKTLAVEVLWTPQNENDTLSERELLEDYPLLRPL

SEQ ID NO: 11116 - protein, 347 aa, Cucumis melo
MLLSEKGRSSTTTISNSCSVELVNGDKPKSPMEVIGNSIINALKTLRKPAIAAVLLGLLLMYDPNSALAASGGRVGGNAFSSRSSSSSRSYSTPRMSSGFSYSAPYTSPSMFGGGGIYVGPAVGVGVGAGSSFFFILAGFAAFLLVSGFLSDRSDSSVLTASEKTSVLKLQVGLLGMGRGLQRDLNRIAESADTSTPEGLCYVLTETILALLRHPDYCISGYSSMDVKRSIEEGEKRFNKLSIEERGKFDEETLVNVNSIKRQSTSSQRTSGFSNEYIVITILVAAEGVHKLPTINGSGDLKEALQKLASIPSSKILAVEVLWTPQNENDTLSERELLEDYPLLRPL

SEQ ID NO: 11117 - protein, 1791 aa, Panicum virgatum
MSLRRNRRAAAAAAAAAAEGGGGGYPEPAAYNIIPIHDVVMHGEHPSLRFPEVRAAVEALAHAADLPAPPLARAWDTFRADLFDWLGATFGFQLHNVRNQREHLVLLLANAQLRAGGTLPPDHPADVLHHSIARNIRKKLLKNYKSWCSYLGKRPHVYVPSAGRRVQGVGPDTRRDLLYTALYLLIWGEAANLRFMPECLCYIFHYMALDLNHVIDQSVDVETGRLSIPAVHGEDAFLEKIVTPIYNVLKAEVEFSRNGTKPHSAWRNYDDVNEYFWSRRVFKRLQWPLSPVRSFFIQPGNPGRIGKTGFVEQRSFWNVYRSFDRVWVMLILFFQAAMIVAWDGRTPWDSLRFRDIQVRVLSVFITWAALRIVQAVLDAGTQYSLVRRETTLLAVRMVLKVLVAVGWTITFIVLYVRMWDQRWRDRRWSFAANSRVLNYLEAAAVFVIPQVLAVVLFIVPWIRNFLEKTNWRILYVLTWWFQTRTFVGRGVREGLIDNIKYTTFWVCLLTAKFVFSYFLQIKPMVGPTKTILSLHDIPRNWFEFMPHTERIAVILLWLPVVLIYLMDIQIWYAVFSSLTGALIGLFSHLGEIRSVEQLRLRFQFFASAMQFNLMPEEHLDAVRGGLRSKLYDAINRLKLRYGFGRPYRKIEANEVEAKRFALIWNEIIQTFREEDIISDNEVELLELPPVVWKIRVVRWPCFLLNNELLLALSQAKELVADDRTHWTRICNNEYRRCAVIEAYDSIRHLLLEIIEERTAERIIVSQLFLAFDAEMDNGKFSEEYKLELLPEIHSSVITLVELLLKEKKDQTKIVNTLQTLYVFAIHDFPKKKKDMEQLRQAKLAPSKAEESSLPFEDVIKCPSNDDVSFYKQVRRLHTILTSRDSMNNVPKNPEARRRITFFSNSLFMNMPRAPKVEKMMAFSVLTPYYNEDVMYNKDQLRRENEDGVSILFYLQKIYEDDWWNFLERMRREGMNDDDEIWTLKYQELRLWASYRGQTLARTVRGMMYYHRGLKMLAFLDTASEVDITEGTKHLASFGSIRHENDVYPMNGGLQQRRQRRLDRGTSTVSQLFKGQEDGAALMKYTYVVACQIYGNQKIARDQRAEDILSLMKKNEALRVAYVDEVHHQGYTQYYSVLVKFDQSLQREVEIYRIRLPGPLKLGEGKPENQNHAIIFTRGDAVQTIDMNQDNYFEEALKMRNLLEQYNYYHGSRKPTLLGVREHVFTGSVSSLAWFMSAQETSFVTLGQRVLANPLKVRMHYGHPDVFDRLWFLTRGGISKASRVINISEDIFAGFNCTLRGGNVSHHEYIQVGKGRDVGLNQISMFEAKVSSGNGEQTLSRDIYRLGHRLDFFRMLSVFYTTVGFYFNTMLVVLTVYTFVWGRLYLALSGLEAGIQGSANSTNNKALGTVLNQQFIIQIGLFTALPMIIENSLEQGFLPAIWDFFTMQMNFSSLFYTFSMGTKSHYYGRTILHGGAKYRATGRGFVVQHKSFAENYRLYARSHFIKAIELGIILTVYASHSVIAKNTLVYIIMNISSWFLVVSWIMAPFAFNPSGFDWLKTVYDFDDFMNWIWYPGGLFSKAEQSWEVWWFEEQDHLRTTGLWGKILEILLDLRYFFLQYGVVYQLKIANNSRSIAVYLLSWICVAVIFGVFVLMSYARDKYAAKQHLYYRVVQTAVIILVVFVLIIFLKFTKFEIVDIFTSLLAFLPTGWGLISIAQVIRPFIESTVVWNSVISVARLYEILLGVFVMVPVALLSWLPGFQEMQTRVLFNEGFSRGLQISRILTGKKANTA

SEQ ID NO: 11118 - protein, 70 aa, Setaria italica
MEHCYTASPQQSEVSTSSCIRFFASKNARYLEAPAESFIEKYPCLHFLKSRQPGQQRNWRHNEHPKQYLI

SEQ ID NO: 11119 - protein, 1789 aa, Setaria italica
MSLRRNRRSAAAAAAAAVGGAGYPEPAAYNIIPIQDVVMHGEHPSLRFPEVRAAVEALAHAADLPPPPLARDWDAFRADLFDWLGATFGFQLHNVRNQREHLMLLLANAQLRAGGTLPTDHPADVLHHSVARGIRKKLLKNYKSWCSYLGKRPHVYVPSGGRRVQGVGPDTRRDLLYTALYLLIWGEAANLRFMPECLCYIFHYMALDLNHVIDQSVDVETGRPSIPAVHGEDAFLEKVVTPIYNVLKAEVEFSRNGTKPHSAWRNYDDVNEYFWSRRVFRRLQWPLSPTRNFFIPPGNSGRIGKTGFVEQRSFWNVYRSFDRVWVMLILFFQAAMIVAWDGRKPWDSLRYRDIQVRVLSVFITWAALRIVQAVLDAGTQYSLVRRETTLLAVRMVLKVLVAVGWTITFTVLYVRMWDQRWRDRRWSFAAETRVLNYLEAAAVFIIPQVLALVLFIVPWIRNLLEKTNWRILYVLTWWFQTRTFVGRGVREGLVDNIKYSTFWVCLLTAKFVFSYFLQIKPMVAPTKTILSLHDIRRNWFEFMPHTERIAVILLWIPVVLIYLMDIQIWYAVFSSLTGALIGLFSHLGEIRSVEQLRLRFQFFASAMQFNLMPEEHLDAVRGGLRSKLYDAINRLKLRYGFGRPYRKIEGNEVEAKRFALIWNEIIQTFREEDIVSDKEVELLELPPVVWRIRVVRWPCFLLNNELLLALSQAKELVADDRAHWTRICNNEYRRCAVIEAYDSIRHLLLEIIEERTVEHVIVSQLFLAFDDAMKDGNFSEQYKLELLPEIHSYLITLVELLLQERKDQTKIVNTLQTLYVFAIHDFPKKKKGMEQLRQERLAPSSPQESSLLFEDVIKCPSNDDISFYKQVRRLHTILTSRDSMNNVPKNPEAQRRITFFSNSLFMNMPRAPTVEKMMAFSVLTPYYNEDVMYNRDQLRRENEDGVSILFYLQKIYEDDWGNFLERMRREGMTDDDEIWTVKYQELRLWASYRGQTLARTVRGMMYYHRALKMLAFLDTASEVDITEGTKHLASFGSVRHENDMYPMNGGLQRRPQRRLDRGTSTVSQLFKGQEDGAALMKYTYVLACQIYGNQKIARDQRAEDILNLMKKNEALRVAYVDEVHHQGYTQYYSVLVKFDQGLQREVEIYRIRLPGPLKLGEGKPENQNHAIIFTRGDAVQTIDMNQDNYFEEALKMRNLLEQYDYYHGSRKPTLLGVREHVFTGSVSSLAWFMSAQETSFVTLGQRVLANPLKVRMHYGHPDVFDRLWFLTRGGLSKASRVINISEDIFAGFNCTLRGGNVSHHEYIQVGKGRDVGLNQISMFEAKVSSGNGEQTLSRDVYRLGHRLDFFRMLSVFYTTVGFYFNTMLVVLTVYTFVWGRLYLALSGLEAGIQGSANSTNNKALGTVLNQQFIIQIGLFTALPMIIENSLEQGFLPAIWDFFTMQMNFSSLFYTFSMGTKSHYYGRTILHGGAKYRATGRGFVVQHKSFAENYRLYARSHFIKAIELGIILTVYAAHSVIARNTLVYIVMNISSWFLVVSWIMAPFAFNPLGFDWLKTVYDFDDFMNWIWYPGSLFSKPDQSWEVWWFEEQDHLRTTGLWGKILEILLDLRYFFFQYGVVYQLKIANDSRSIAVYLLSWICVAVIFGVFVLMSYTRDKYAAKQHLYYRVVQTAVIILAVLVLILFLKFTKFEIVDIFTSLLAFIPTGWGLISIAQVIRPFIESTVVWNSVISVARLYEILLGVFVMAPVALLSWLPGFQEMQTRVLFNEGFSRGLQISRILTGKKANTA

SEQ ID NO: 11120 - protein, 407 aa, Sorghum bicolor
MAALCAAGTSTATAFASGRLSATSTARARGASASTSLPSSSFVGAFPRAVAARRRRRAAPARAGVKVRAEAAKKQSVLIVNTNSGGHAVIGFYFAKELLAAGHAVTVLTVGDEGSDKMKKPPFSRFSELTSAGGKTVWGDPADVGAAVGGALFDVVLDNNGKDLDAVKPVADWAKSAGVGQFLFISSAGIYKPTEEPPHVEGDAVKESAGHVAVEKYIAEQFGSSWASFRPQYMIGSGNNKDCEEWFFDRIVRNRPVPIPGNGMQLTNIAHVRDLSRMLSLAVEKPGAASGKIFNCVSDRAVTLSGMAKLCAAAAGADAVEIVLYDPAAAGVDAKKAFPFRNMHFYAEPRAAKAALGWTSSTNLPEDLKERYAEYAASGRGEKPMNFDLDDKILAAVGKAAPASVAV

SEQ ID NO: 11121 - protein, 407 aa, Sorghum bicolor
MAALCAAGTSTATAFASGRLSATSTARARGASASTSLPSSSFVGAFPRAVAARRRRRPAPARAGVKVRAEAAKKQSVLIVNTNSGGHAVIGFYFAKELLAAGHAVTVLTVGDEGSDKMKKPPFSRFSELTSAGGKTVWGDPADVGAAVGGASFDVVLDNNGKDLDAVKPVADWAKSAGVGQFLFISSAGIYKPTEEPPHVEGDAVKESAGHVAVEKYIAEQFGSSWASFRPQYMIGSGNNKDCEEWFFDRIVRNRPVPIPGNGMQLTNIAHVRDLSRMLSLAVEKPGAASGKIFNCVSDRAVTLSGMAKLCAAAAGADAVEIVLYDPAAAGVDAKKAFPFRNMHFYAEPRAAKAALGWTSSTNLPEDLKERYAEYAASGRGEKPMNFDLDDKILAAVGKAAPASVAV

SEQ ID NO: 11122 - protein, 397 aa, Setaria italica
MALSAAAGATTATAFASGRRLSVSSPCPSASASLPSFLAGAFPCAVAARRRAAPAARAAVSVRAEAKKSVLIVNTNSGGHAVIGFYFAKELLAAGHAVTVLTVGDEGSDKMKKPPFSRFSELTGAGGKTVWGDPADVGAAVSGASFDVVLDNNGKDLDAVKPVADWAKASGVGQFLFISSAGIYKPTDEPPHVEGDAVKESAGHVGVEKYIAEQFSSWASFRPQYMIGSGNNKDCEEWFFDRIVRGRPVPIPGNGMQLTNIAHVRDLSSMLALAVENPGAAAGKIFNCVSDRAVTLDGMARLCAAAAGAAVEIVHYDPAAVGVDAKKAFPFRNMHFYAEPRAAKEALGWASTTNLPEDLKERYAEYAASGRGDKDMAFDLDDKILGAVGIVPASATV

SEQ ID NO: 11123 - protein, 476 aa, Panicum virgatum
MTGYVVAVSNHYSIASTVNRCCCATTLQWLAAMATKLGSSFLLSSLTAPPKSPRSRVHHSSPHPPSSLIFSSRPPMAFAAAAASTATALASGRLSASSAQQRRPSSRASFSPGASPRAVAARRRAAPAARAAVSVRAEAGKKRVLVVNTNSGGHAVIGFYFAKELLAAGHAVTVLTVGDEASDKMKKPPFSRFSELTSAGGKTVWGDPADVGAAVGGASFDVVLDNNGKDLDAVKPVVDWAKSSGVGQFLFISSAGIYRPTEEPPHVEGDAVKESAGHVGVEKYLAEQFAGGWASFRPQYMIGSGNNKDCEEWFFDRIVRGRPVPIPGNGMQLTNITHVRDLASMLALAVGSPGAAAGRVFNCVSDRAVTLDGMARLCAAAAGAAAVEIVHYDPAAAGVDAKKAFPFRNMHFYAEPRAAKEALGWASTTNLPEDLKERYAEYAASGRGGKAMAFDIDDKILAAVGKAPPCRDRTSK

SEQ ID NO: 11124 - protein, 383 aa, Panicum virgatum
MAFAASTATALASGRLSASSARPRRPSSRPSFSLRAAPAARAAVSARAEAKKSELVVNTNSGGHAVFGFYFAKELLAAGHAVTVLTVGDEASDKMKKPPFSRFSELTSAGGKTVWGDPADVGAAVGGASFDVVLDNNGKDLDAVKPVVDWAKSSGAGQFLFISSSGIYRPTDEPPQVEGDAVKESAGHVGVERYISEQFAGSWASFRPQYLIGSGNNKDCEEWFFDRIVRGRPVPIPGNGMQLTNITHVRDLASMLALAVGRPGAAAGRVFNCVSDRAVTLDGMARLCAAAAGAAAVEIVHYDPAAAGVDAKKAFPFRNMHFYAEPRAAKEALGWASTTNLPEDLKERYAEYAGSGRGDKPMAFDLDDKILAAVGKAPAGAIV

SEQ ID NO: 11125 - protein, 187 aa, Sorghum bicolor
MALAPAPLQCFLTGSSRPVCTATPPKHARRPSRISCKASGDDKDKVPSGGNDLGVKLGKLAMVALAAGVLALGPVDGALAAKSGGRVGGQAFRSAPRSSGPRINNSRTNIYINPPVAPPLGGYGYGSPFFGGYGYGWSPFSFFAPGPSVAVGVGGGFDTLVLFLVLGAVVGAVRRFLNRNNDDYDDY

SEQ ID NO: 11126 - protein, 183 aa, Panicum virgatum
MALAPTPLQCFLTGRPVCTATLPRLARRPSRISCKATGDEKDKLTSGGDGLGLKLGKLAMVALAAGVLALGPVDGAMAAKSGGRVGGQAFRSAPRSSGPRINNSRTNIYINPPVAPPLGGYGYGSPFFGGYGWSPFTFFAPGPSVAVGVGGGFDTLVLFLVLGFVVGAVRRFLNRNDDDYDDY

SEQ ID NO: 11127 - protein, 184 aa, Panicum virgatum
MALAPTPLQCFLTGRPVCTATLPRLARRPSRISCKAAGDEKDKVTSGGDDGLGVKLGKLAMVALAAGVLALGPIDGAMAAKSGGRVGGQAFRSAPRSSGPRINNSRTNIYINPPVAPPLGGYGYGSPFFGGYGWSPFTFFAPGPSVAVGVGGGFDTLVLFLVLGFVVGAVRRFLNRNDDDYDDY

SEQ ID NO: 11128 - protein, 184 aa, Setaria italica
MALAPASLQCFLTGRPVCSATLPKLARRPSRISCKAAGDEKVPLGGDGLGVKLGKLAMVTLAAGVLALGPVDGAMAAKSGGRVGGQAFRSAPRSSGPRINNSRTNIYVNPPVAPPLGGYGYGGYGSPFFGGYGWSPFTFFAPGPSVAVGVGGGFDTLVLFLVLGAVVGAIRRFLNRNNDDYDDY

SEQ ID NO: 11129 - protein, 182 aa, Pennisetum glaucum
MALAPASLQGFLTGRPVCTATLPKLARRPSRISCKAAGDEKVPSGGDGLGVKLGKLAMVALAAGVLVLGPVDGAMAAKSGGRVGGQAFRSAPRSSGPRINNSRTNIYINPAPPLGGYGYGGYGSPFFGGYGWSPFTFFAPGPSVAVGVSTRSSSSWCWAPSSEPSGGFLRGTTMITTTTDCR

SEQ ID NO: 11130 - protein, 186 aa, Cynodon dactylon
MAMAPASFQCFLSGRPVCTPMLPRLTRRPSRISCKATSDEKDKLPSGGNDLGVKLGKLAMVALAAGVLALGPVDGAMAAKSGGRVGGQAFRSAPRSSGPRINNSRTNIYINPPVAPPLGGYGYGGYGSPFFGGWGWSPFTFFAPGPSVAVGVGGGFDTLVLFMVLGAVVGAIRGFLNRNNDDYDDY

SEQ ID NO: 11131 - protein, 519 aa, Saccharum officinarum
MAAAALAMAEQVVSDLRAKCETPPSMLREVAAEMAREMGAGLEKEGGSRVKMLLSYVDKLPTGGEEGLFYGLDLGGTNFRVLKVELGGNEKHVVDRDSREVGIPPHLMSGKSSELFGFIASELAKFVNDEEKCTNISNGKKRELGFTFSFPVKQRSVASGTLVKWTKAFSINDAVGEDVVAELQTAMGKQGLDMHVAALINDAVGTLAGARYYDKDVVAGVIFGTGTNAAYVEKANAIPKWKGELPNSGDMVINMEWGNFCSVHLPITEYDQELDKESLNPGEQIYEKLTSGMYLGEIVRRVLLKISLQSAIFGNIDHTKLETPFLLRTPHISAMHHDETPDLKIVAEKLEESLEITGASLEARKLVVEICDIVATRAARLAAAGLAGILMKLGRDCSVKDQRSVIAIDGGLFEHYTKFRQCLETTLGELLGDEVSKAVAVKHADDGSGIGAALIAASQSQYKNDLVAVKHADDKHADDGSRVKHEDADDKHENDGKGVKHADDGSEIGAALIAASQSQ

SEQ ID NO: 11132 - protein, 515 aa, Sorghum bicolor
MAAAALAMAEQVVADLRAKCEAPPPMLREVAAEMAREMGAGLEKEGGSRVKMLLSYVDKLPTGGEEGLFYGLDLGGTNFRVLKVELGGNEKHVVDRDSREVIIPPHLMSGSSSELFGFIASELAKFVVDDEKFINVLNGKKRELGFTFSFPVKQRSVASGTLVKWTKAFSINDAVGEDVVAKLQTAMEKQGLDMHVAALINDAVGTLAGARYYDKDVVAGVIFGTGTNAAYVEKANAIPKWEGELPNSGDMVINMEWGNFCSAYLPITEYDQELDKESLNPGEQIYEKLTSGMYLGEIVRRVLLKISLQSAIFGNIDHTKLETPFLLRTPHISAMHHDETPDLKIVAKKLEENLEITGASLEARKLVVEICDIVATRAARLAAAGLAGILMKLGRDCSVEDQRSVIAIDGGLFEHYTKFRQCLETTLGELLGDEASKAVAVKHADDGSGIGAALIAASQSLYKNDLVAVKHADDKHADDKHEDADDKHEDDGKGVKHADDGSEIGAALIAASQSQ

SEQ ID NO: 11133 - protein, 515 aa, Sorghum bicolor
MATAALAMAEQVVADLRAKCEAPPPMLREVAAEMAREMGAGLEKEGGSRVKMLLSYVDKLPTGGEEGLFYGLDLGGTNFRVLKVELGGNEKHVVDRDSREVIIPPHLMSGSSSELFGFIASELAKFVVDDEKFINVLNGKKRELGFTFSFPVKQRSVASGTLVKWTKAFSINDAVGEDVVAKLQTAMEKQGLDMHVAALINDAVGTLAGARYYDKDVVAGVIFGTGTNAAYVEKANAIPKWEGELPNSGDMVINMEWGNFCSAYLPITEYDQELDKESLNPGEQIYEKLTSGMYLGEIVRRVLLKISLQSAIFGNIDHTKLETPFLLRTPHISAMHHDETPDLKIVAKKLEENLEITGASLEARKLVVEICDIVATRAARLAAAGLAGILMKLGRDCSVEDQRSVIAIDGGLFEHYTKFRQCLETTLGELLGDEASKAVAVKHADDGSGIGAALIAASQSLYKNDLVAVKHADDKHADDKHEDADDKHEDDGKGVKHADDGSEIGAALIAASQSQ

SEQ ID NO: 11134 - protein, 467 aa, Panicum virgatum
MEAAAAVAMAEQVAADLREKCETPPALLREVASAMAHEMGAGLEKEGGSRVKMLLSYVDKLPTGREEGSFYGLDLGGTNFRVLRVQLGGNEKHVVNRESREVSIPPQLMSGSSSELFGFIASELAKFVADEENSANISNGKKRELGFTFSFPVKQRSVASGTLVKWTKAFSIDDAVGEDVVAELQTAMEKQGLDMHVAALINDAVGTLAGARYYDKDVVAGVIFGTGTNAAYVEKANAIPKWEGELPNSGDMVINMEWGNFCSSHLPITEYDQELDEESLNPGEQIYEKLMSGMYLGEIVRRVLLKISLHSSIFGNIDHAKLKTHFLLRTPHISAMHHDETPDLKIVAEILEENLEITGTSLETRKLVVEICDIVARRAARLAAAGLAGILKKLGRVCNAQEQRSVIAIDGGLFEHYTRFRECLESTLGELLGEEASKSVAVKHADDGSGIGAALIAASQSQYRNVV

SEQ ID NO: 11135 - protein, 468 aa, Setaria italica
MAAAEAVAMAEQVVADLREKCETPPELLREVASAMAHEMGAGLEKDGGSRVNMLLSYVDKLPTGREEGLFYGLDLGGTNFRVLRVQLGGIEKHVVNRESREVSIPPQLMSGSSSELFGFIASELAKFVADEEKCANVLSNGKKRELGFTFSFPVKQRSVASGTLVKWTKAFSIDDAVGEDVVAELQTAMEKQGLDMHVAALINDAVGTLAGARYYDRDVVAGVIFGTGTNAAYVEKANSIPKWEGELPNSGDMVINMEWGNFCSSHLPVTEYDRELDKESLNPGEQIYEKLMSGMYLGEIVRRVLLKMSLQSSIFGNIDHTKLKTHFLLRTPHISAMHHDETPDLKIVAEKLEENLEITGTSLETRKLVVEICDIVARRAARLAAAGLAGILKKLGRDGNAQEQRSVIAIDGGLFEHYTKFRECLEITLGELLAEYASKSVAVKHADDGSGIGAALIAASQSQYRNVE

SEQ ID NO: 11136 - protein, 467 aa, Panicum virgatum
MEAAAAVAMAEQVVADLREKCETPAALLREVASSMAHEMGAGLEKEGGSRVKMLLSYVDKLPTGREEGLFYGLDLGGTNFRVLRVQLGGNEKHVVNRESREVSIPPQLMSGSSSDLFGFIASELAKFVADEEKCDNISNGKKRELGFTFSFPVKQRSVASGTLVKWTKAFSIDDAVGEDVVAELQTAMEKQGLDMHVAALINDAVGTLAGARYYDKDVVAGVIFGTGTNAAYVEKANVIPKWEGELPNSGDMVINMEWGNFCSSHLPVTEYDQELDEESLNPGEQIYEKLMSGMYLGEIVRRVLLKISLHSSIFGNIDHTKLKTHFVLRTPHISAMHHDETPDLKIVAEKLEENLEITSTSLETRKLVVEVCDIVARRAARLAAAGLAGILKRLGRDCNAQEQRSVIAIDGGLFEHYTKFHECLESTLGELLGEEASKSVAVKHADDGSGIGAALIAASQSQYRNVE

SEQ ID NO: 11137 - protein, 468 aa, Pennisetum glaucum
MATAEAVAMAEQVVADLRERCETPPELLREVASEMAHEMSAGLEKEGGSRVKMLLSYVDKLPTGREEGLFYGLDLGGTNFRVLRVQLGGNEKHVVNPPKSKEISIPQKLMSGSSSELFGFIASELAQFVADEKCDNVLSNGKKRELGFTFSFPVKQRSVASGTLVKWTKAFSIDDAVGEDVVVELQTAMEKQGLDMHVAALINDAVGTLAGARYNDKDVVAGVIFGTGTNAAYVEKANTIPKWEGELPISGDMVINMEWGNFYSTHLPVTEYDEELDKESLNPGEQIYEKLMSGMYLGEIVRRVLLKISLQSSIFGNIDHTKLKTHFLLRTPHISAMHHDETPDLKIVAEKLEENLEITGTSLETRKLVVEICDIVARRATRLAAAGLLGILRKLGRDGNAQEQRSVIAIDGGLFEHYTKFRECLEITLGELLGEEASKSVAVMHSGDGSGIGAALIAASQSQYRNVE

SEQ ID NO: 11138 - protein, 252 aa, Trifolium pratense
SIQHHSLIKRHYYPSETAPPSTLSSSLFLKPTTTNITLSHSSTSNSSITFSLSQTTSSTPSSTSQNSSFELLQKHLSDKNFRQADEETRRLLIVLAGEAAQKRGYVFFSEVQFISETDLQTIDQLWRDHSNNKFGYSVQKKLFGKAKKDFTKFFIKVGWMKKLDTEMEQYNYRSFPTEFIWELNDDTPEGHLPLTNALRGTQLLSNIFNHPAFDSVPEEVEVSYAEGNGALKGLKDSSKPLAQKIFKSDYSF

SEQ ID NO: 11139 - protein, 256 aa, Cicer arietinum
MATNSLHSIQHHSLSKRHYYPSETVPSTLSSSLFLKPTTINTSITISHSSSTTFSSLSQTTSSTPSSTSQIISFELLQQLLKAKNFQQADEETRRLIIVLAGEAAQKRGYVFFSEVQFISETDLKTIDQLWREHSDNKFGYSVQKRIFGKVKKDFTKFFIKVGWMKKLDTEMEQHNYRSFPTEFIWELNDDTPEGHLPLTNALRGTQLLNNIFTHPAFDEVQEGEVSIGEENGALKGLKDSSKPLVQKIFKTDYSF

SEQ ID NO: 11140 - protein, 398 aa, Trigonella foenum-graecum
MAATLQTPLYATISSSSAASSSSSIRTRSSFSSLRSTSPPTLLFNFKNSFSPIRSSSTDTAITELDAVSAFSEIVPDTVIFDDFQKFPPTAATVSSSLILGICGLPDTIFRNAVEMALADSECYGLEDPNARLSCFATKALVNVGSDMTKLVPGRVSTEVDARLAYDTHGIIRKVHDLLKLYNDSNVPPERLLFKIPSTWQGIEAARLLESEGIQTHLTFVYSFAQAAAAAQAGASVIQIFVGRVRDWARNHSGDKEIESAQLNGEDPGLALVTKAYNYIHKYGHKSKLMAAAVRNKQDLFSLLGVDYIIAPLKVLQSLNESVASPDEKYSFVRRLSPQSAGRYVFSDEELVKWDQMSLTNAMGPAAVQLLTSGLDGYADQAKRVEDLFGKIWPPPNV

SEQ ID NO: 11141 - protein, 389 aa, Cicer arietinum
MALTLQTPLYAAVSSIPTRTSFSLRSTPPPTLLINYRNSFPRIHASSNIDTAITELDAVSAFSEIVPDTVIFDDFQKFPPTAATVSSSLLLGICGLPDTIFRNAVEMALADAECYGLEDPNTRLSCFATKALVNVGSDMAKLVPGRVSTEVDARLAYDTHGIIRKVHDLLKLYHDSNVPPQRLLFKIPSTWQGIEAARLLESEGIQTHLTFVYSFAQAAAAAQAGASVIQIFVGRVRDWARNHSDDQEIESAKLNGEDPGLALAAKAYNYIHKYGHKSKLMAAAVRNKQDLFSLLGVDYIIAPLKVLQSLKESVASPDEKYSFVRRLSPQSARSYMFSDEELIKWDQMSLANAMGPAAVQLLTAGLDGYVDQAKRVEDLFGKIWPPPNV

SEQ ID NO: 11142 - protein, 397 aa, Cajanus cajan
MSLTLQTPPPAALSSAASSSSSIHRTTRSTFSFSLRSTPSLTLHSLPQTRASASSINTASTTELDAVSAFSEIVPDTVIFDDFEKFPPTAATVSSSLLLGICGLPDTIFRNAVEMALADSECYGLENPNARLSCFVNKAFANVGSDLAKLVPGRVSTEVDARLAYDTHAIIRKVHDLLKLYNDSNVPPHRLLFKIPSTWQGIEAARLLESEGIQTHLTFVYSFAQAAAAAQAGASVIQIFVGRIRDWARNHSGDTEIESAQLRGEDPGLALVTKAYNYIHKYGHKSKLMAAAVRNKQDLFSLLGIDYIIAPLKVLQSLKESVASPDEKYSFDRRLSPQSAVKHVFSDEELVKWDQDSLANAMGPAAVQLLAAGLDGHADQAKRVEDLFGKIWPPPNV

SEQ ID NO: 11143 - protein, 400 aa, Phaseolus vulgaris
MSLTLQTPSSTTLSPATSIHSTTTRSTFSFSPRSTLSPKTLHFNYHRSLPRTRASASSINIASTTELDAVSAFSEIVPDTVVFDDFEKFPPTAATVSSSLLLGICGLPDTIFRNAVEMALADSECYGIQNPNARLSCFVSKAFANVGSDLAKLVPGRVSTEVDARLAYDTHAIIRKVHDLLKLYNISNVPPQRLLFKIPSTWQGIEAARLLESEGIQTHLTFVYSFAQAAAAAQAGASVIQIFVGRTRDWARNHSGDKEIESALLRGEDPGLALVTKAYNYIHKYGHKSKLMAAAVRNKQDLFSLLGVDYIIAPLKILQTLKESVASPDEKYSFVRRLSPQSAAQYKFSDEELVKWDQHSLANAMGPAAVQLLAAGLDGNADQAKRVEDLFGKIWPPPNV

SEQ ID NO: 11144 - protein, 394 aa, Lotus japonicus
MPVTLQSPPSAAAFSSAAASSSIHRRIHSTPPPTLPFKSQRSFPLIRASSSSINTASITELDAVSAFSEIVPDTVIFDDFQKFPPTAATVSSSLLLGICGLPDTVFRNAVDMALADSECNGLQNPEARLSCFVNKALVNVGTDLAKLVPGRVSTEVDARLAYDTHDIIRKVHDLLKLYNDNNVPPQRLLFKIPSTWQGIEAARLLESEGIQTHLTFVYSFAQAAAAAQAGASVIQIFVGRIRDWARNHSDDKEIESSKLRGEDPGLTLVTKAYNYIHKYGHKSKLMAAAVRNKQDLFSLLGVDYIIAPLKVLQSLNESVAFPDEKYSFVRRLSPESASRYLFSDEELIKWDQTSLTEAMGPAAVQLLAAGLDGYADQATRVEEYFRKIWPPPNV

SEQ ID NO: 11145 - protein, 397 aa, Glycine max
MSITLRTPPSTTLSSAASSIHRTRSTTFSFSLCSPPTLRFNSHSSLSLTRASASSITTASTTELDAVSSFSEIVPDTVVFDDFEKFPPTAATVSSSLLLGICGLPDTIFRNAVEMALADSECYGLENPNARLSCFVNKAFANVGSDMAKLVPGRVSTEVDARFAYDTPAIIRKVHDLLKLYNDSNVPPKRLLFKIPSTWQGIEAARLLESEGIQTHLTFVYSFAQAAAAAQAGASVIQIFVGRIRDWARNHSGDTEIESAQLRGEDPGLALVTKAYNYIHKYGHKSKLMAAAVRNKQDLFSLLGVDYIIAPLKVLQSLKESIASPDEKYSFVRRLSAQSAAKYTFSDEELVKWDEDSLTKAMGPAAVQLLAAGLDGHADQAKRVEELFEKIWPPPNV

SEQ ID NO: 11146 - protein, 398 aa, Glycine max
MSLTLQTPPSTTLSSASPIHRTITRYTTFSFSLRPPTTLHFNPHRSLPLIRASNSSINAASTTELDAVSAFSEIVPDTVVFDDFEKFPPTAATVSSSLLLGICGLPDTIFRNAVEMALADSECYGLENPNARLSCFVNKAFANIGSDMAKLVPGRVSTEVDARLAYDTHAIIRKVHDLLKLYNDSNVPPQRLLFKIPSTWQGIEAARLLESEGIQTHLTFVYSFAQAAAAAQAGASVIQIFVGRIRDWARNHSGDTEIESAQLRGEDPGLALVTKAYNYIHKYGHKSKLMAAAVRNKQDLFSLLGVDYIIAPLKVLQSLKESVASPDEKYSFVRRLSPQSAAKYTFSDEELVRWDEDSLSKAMGPAAVQLLAAGLDGHADQAKRVEELFGKIWPPPNV

SEQ ID NO: 11147 - protein, 395 aa, Lupinus angustifolius
MSFTLKITPSVSTPLSSSSIHTTKSTFSLHSTLLFNSQIHHNSLHHVQIRASSTDTASTTELEAVSAFSQIVPDTVIFDDFQKFPPTAATVSSSLLLGICGLPDTIFRNAVEMALADSECYGLENSDTRLSCFFNKALVNVGGDMTKLVPGRVSTEVDARLAYDTHAIIRKVHDLLRLYNDINVPPQRLLFKIPSTWQGIEAARLLESEGIQTHLTFVYSFAQAAAAAEAGASVIQIFVGRIRDWARNHSDDPEIESAQLRGEDPGLALVMKAYNYIHKYGYKSKLMAAAVRNKQDLFSLLGVDYIIAPLKVLQSLKESVASPDEKYSFVRRLSPQSAAKYVFSDEELVKWNQTSLTEAMGPAAVQLLASGLDGYASQANRVEELFGKIWPPPNV

SEQ ID NO: 11148 - protein, 197 aa, Unknown
  Sequence found in Organisms: Sorghum bicolor, Triticum aestivum
METEFQDGKQEVIEAWYMDDSEEDQRLPHHRDPKEFIPLDKLSELGIISWRLNPDNWENDENLKKIREARGYSYMDICDVCPEKLPNYEIKIKNFFEEHLHTDEEIRYCLEGSGYFDVRDENDQWIRVAVKKGGMIVLPAGMYHRFTLDNENYIKAMRLFVGEPVWTPYNRPHDHLPARKEYLDKLLKPEGQAVEAR

SEQ ID NO: 11149 - protein, 197 aa, Saccharum officinarum
METEFQDGKQEVIEAWYMDDSQEDQRLPHHRDPKEFIPLEKLSELGIISWRLNPDNWENDENLKKIREARGYSYMDICDVCPEKLPNYETKIKNFFEEHLHTDEEIRYCLEGSGYFDVRDENDQWIRVAVKKGGMIVLPAGMYHRFTLDNDNYIKAMRLFVGEPVWTPYNRPHDHLPARKEYLDKLLKPEGQAVEAR

SEQ ID NO: 11150 - protein, 199 aa, Pennisetum glaucum
METEFQDGKQEVIEAWYMDDSQEDQRLPHHREPKEFIPLDKLSELGIISWRLNPDNWEKDENLKKIREARGYSYMDICDVCPEKLPNYEVKIKNFFEEHLHTDEEIRYCLEGSGYFDVRDENDKWIRVAVKKGGMIVLPAGMYHRFTLDTDNYIKAMRLFVGEPVWTPYNRPHDHLPARQEYLDKLVKAEGVNQAVEAR

SEQ ID NO: 11151 - protein, 217 aa, Panicum virgatum
METEFQDGKQEVIEAWYMDDSQEDQRLPHHREPKEFIPLEKLSELGIVSWRLNPDNWENDENLKKIREARGYSYMDICDVCPEKLPNYETKIKNFFEEHLHTDEEIRYCLEGSGYFDVRDENDQWIRVAVKKGGMIVLPAGMYHRFTLDTDNYIKAMRLFVGDPVWTPYNRPHDHLPEGRSIWTSLSRQKVEIKLLKLAEATLNLPVGLFRCVLCTI

SEQ ID NO: 11152 - protein, 199 aa, Setaria italica
METEFQDGKQEVIEAWYMDDSQEDQRLPHHREPKEFIPLEKLSELGIISWRLNPDNWEKDENLKKIREARGYSYMDICDVCPEKLPNYEAKIKNFFEEHLHTDEEIRYCLEGSGYFDVRDENDKWIRVAVKKGGMIVLPAGMYHRFTLDTDNYIKAMRLFVGEPVWTPYNRPHDHLPARQEYLDKLVKAEGVNQAVEAR

SEQ ID NO: 11153 - protein, 198 aa, Pennisetum glaucum
MEDQFQDGKEEVIQAWYMDDSEEDQRLPHHREPKEFIPLDKLSELGILSWRLNPDDWENDENLKKIREARGYSYVDICDVCPEKLPNYEAKIKNFFEEHLHTDEEIRYCLEGSGYFDVRDQNDQWIRIAVKKGGMIVLPAGMYHRFTLDTDNYIKAMRLFVGEPVWTPYNRPHDHLPARKEYVDRIINRGGNQAVEAR

SEQ ID NO: 11154 - protein, 361 aa, Sorghum bicolor
MAPQAWVVAENGEDLQRPREFVPLSELEDVGVLYWHLDPKKSESEEELAKIRKDRGYSYMDLIEICPDKLENYEEKVKNFFREHMHPDEEIRYCLEGSGYFDVRDKDDKWIRIWIKEGDMIILPAGIYHRFTLDSAKYTKLMRLFIGVPVWTAFNRPQEDHPARQEYVKNDGKQEVIEAWYMDDSEEDQRLPHHRDPKEFIPLDKLSELGIISWRLNPDNWENDENLKKIREARGYSYMDICDVCPEKLPNYEIKIKNFFEEHLHTDEEIRYCLEGSGYFDVRDENDQWIRVAVKKGGMIVLPAGMYHRFTLDNENYIKAMRLFVGEPVWTPYNRPHDHLPARKEYLDKLLKPEGQAVEAR

SEQ ID NO: 11155 - protein, 182 aa, Panicum virgatum
MDDSQEDQRLPHHREPKEFIPLEKLSELGIVSWRLNPDNWENDENLKKIREARGYSYMDICDVCPEKLPNYETKIKNFFEEHLHTDEEIRYCLEGSGYFDVRDENDQWIRVAVKKGGMIVLPAGMYHRFTLDTDNYIKAMRLFVGDPVWTPYNRPHDHLPERKEYLDKLVQAEGGNQAIEAR

SEQ ID NO: 11156 - protein, 198 aa, Cenchrus ciliaris
MEDQFQDGKEEVIQAWYMDDSAEDQRLPHHREPKEFIPLDKLSELGILSWRLNADDWENDENLKKIREARGYSYVDICDVCPEKLPNYEDKIKNFFEEHLHTDEEIRYCLEGSGYFDVRDQNDQWIRIAVKKGGMIVLPAGMYHRFTLDTDNYIKAMRLFVGEPVWTPYNRPHDHLPARKEYVDRIINRGGNQAVEAR

SEQ ID NO: 11157 - protein, 199 aa, Cynodon dactylon
METEFQDGKAEVIEAWYMDDSQDDQRLPHHREPKEFIPLEKLSELGIVSWRLNPDNWENDENLKKIREARNYSYMDICDVCPEKLPNYETKIKNFFEEHLHTDEEIRYCLEGSGYFDVRDQNDQWIRVAVKKGGMIVLPSGMYHRFTLDSNNYIKAMRLFVGEPVWTPYNRPHDHLPERKEYLDKLLKTESGNQPVEAS

SEQ ID NO: 11158 - protein, 198 aa, Setaria italica
MEDQFQDGKEEVIQAWYMDESEEDQRLPHHREPKEFIPLDKLSELGILSWRLNADDWENDENLKQIREARGYSYVDICDVCPEKLPNYEAKIKNFFEEHLHTDEEIRYCLEGSGYFDVRDQNDQWIRIAVKKGGMIVLPAGMYHRFTLDTDNYIKAMRLFVGEPVWTPYNRPHDHLPARKEYVDRIINRGGNQAVEAR

SEQ ID NO: 11159 - protein, 198 aa, Brachypodium distachyon
METEFQDGKEEVIQGWYMDDSEEDQRLPHHREPKEFIPLDKLSELGVISWRLNADDWEKDENLKKIREARGYSYVDICDVCPEKLPNYEAKLKNFFEEHLHTDEEIRYCLEGSGYFDVRDQNEQWIRIAVKKGGMIVLPAGMYHRFTLDSDNYIKAMRLFVGEPVWTPYNRPHDHLPARKEYVDKIINRGGNQTVEAR

SEQ ID NO: 11160 - protein, 198 aa, Festuca arundinacea
MENEFQDGKEEVIEAWYMDDSEEDQRLPHHREPKEFIPLNKLSELGVVSWRLNADDWEKDENLKKIREARGYSYVDICDVCPEKLPNYEAKIKNFFEEHLHTDEEIRYCLEGSGYFDVRDENEQWIRVAVKKGGMIVLPAGMYHRFTLDSDNYIKAMRLFVGEPVWTPYNRPHDHLPARKEYVDKIINRGGNQTVEAR

SEQ ID NO: 11161 - protein, 198 aa, Lolium multiflorum
MENEFQDGKEEVIEAWYMDDSEEDQRLPHHREPKEFIPLNKLSELGVVSWRLNADDWEKDENLKKIREARGYSYVDICDVCPEKLPNYEVKIKNFFEEHLHTDEEIRYCLEGSGYFDVRDENEQWIRVAVKKGGMIVLPAGMYHRFTLDSDNYIKAMRLFVGEPVWTPYNRPHDHLPARKEYVDKIINRGGNQTVEAR

SEQ ID NO: 11162 - protein, 173 aa, Secale cereale
MENEFQDGKEEVIQAWYMDDSEEDQRLPHHREPKEFIPLAKLSELGVVSWNLNADNWEKDENLKKIREARGYSYVDICDVCPEKLPNYEAKLKNFFEEHLHTDEEIRYCLEGSGYFDVRDQNEQWIRIAVKKGGMIVLPAGMYHRFTLDSDNYIKAMRLFVGEPIWTPYNRPH

SEQ ID NO: 11163 - protein, 173 aa, Secale cereale
MENEFQDGKEEVIQAWYMDDSEEDQRLPHHREPKEFIPLAKLSELGVVSWNLNADNWEKDENLKKIREARGYSYVDICDVCPEKLPNYEAKLKNFFEEHLHTDEEIRYCLEGSGYFDVRDQNEQWIRIAVKKGGMIVLPAGMYHRFTLDSDNYIKAMRALCGRAYLDAIQPSP

SEQ ID NO: 11164 - protein, 66 aa, Secale cereale
RESRAGRGRLQEAAAMENEFQDGKEEVIQAWYMDDSEEDQRLPHHREPKEFIPLAKLSELGVVAGT

SEQ ID NO: 11165 - protein, 67 aa, Secale cereale
MENEFQDGKEEVIQAWYMDDSEEDQRLPHHREPKEFIPLAKLSELGVVSWNLNADNWEKDENLKKNP

SEQ ID NO: 11166 - protein, 198 aa, Festuca arundinacea
MENEFQDGKEEVIEAWYMDDSEEDQRLPHHREPKEFIPLNKLSELGVVSWRLNADDWEKDENLKKIREARGYSYVDICDVCPEKLPNYEVKIKNFFEEHLHTDEEIRYCLEGSGYFDVRDENEQWIRVAVKKGGMIVLPAGMYHRFTLDSNNYIKAMRLFVGEPVWTPYNRPHDHLPARKEYVDKIINRGGNQTVEAR

SEQ ID NO: 11167 - protein, 198 aa, Oryza sativa
MENQFQDGKEEVIEAWYMDDSEEDQRLPHHREPKEFIPLSKLSELGILSWRLNADDWENDENLKKIREARGYSYMDICDVCPEKLPNYEAKLKNFFEEHLHTDEEIRYCLEGSGYFDVRDQNDQWIRVAVKKGGMIVLPAGMYHRFTLDSDNYIKAMRLFVGEPVWTPYNRPHDHLPARKEYVEKIINRGGTQAVEAR

SEQ ID NO: 11168 - protein, 198 aa, Brachypodium distachyon
MEHEFQDGKEEVIQAWYMDDSEEDQRLPHHREPKEFIPLDKLSELGVVSWRLNADDWEKDENLKKIREARGYSYVDICDVCPEKLPNYEAKLKNFFEEHLHTDEEIRYCLEGSGYFDVRDQDEQWIRIAVKKGGMIVLPAGMYHRFTLDSDNYIKAMRLFVGEPVWTPYNRPHDHLPARKEYFSKIINRGGNQTVEAR

SEQ ID NO: 11169 - protein, 198 aa, Brachypodium distachyon
MEHEFQDGKEEVIQAWYMDDSEEDQRLPHHREPKEFIPLDKLSELGVVSWRLNADDWEKDENLKKIREARGYSYVDICDVCPEKLPNYEAKLKNFFEEHLHTDEEIRYCLEGSGYFDVRDQDEQWIRIAVKKGGMIVLPAGMYHRFTLDSDNYIKAMRLFVGEPVWTPYNRPHDHLPARKEYVDKIINRGGNQTVEAR

SEQ ID NO: 11170 - protein, 198 aa, Cynodon dactylon
MENEFQDGKEEVIQAWYMDDSEEDQRLPHHLEPKEFIPLDKLSELGILSWRLNADDWENDERLKKIREARGYSYMDICDVCPEKLPNYDAKLKNFFEEHLHTDEEIRYCLEGSGYFDVRDQNDQWIRIAVKKGGMIVLPAGMYHRFTLDTDNYIKAMRLFVGEPVWTPYNRPHDHLPARKEYVEKIINRGGSQAVEAR

SEQ ID NO: 11171 - protein, 198 aa, Unknown
  Sequence found in Organisms: Pseudoroegneria spicata, Triticum aestivum
MENEFQDGKEEVIQAWYMDDSEEDQRLPHHREPKEFIPLAKLSELGVVSWNLNADNWEKDENLKKIREARGYSYVDICDVCPEKLPNYEAKLKNFFEEHLHTDEEIRYCLEGSGYFDVRDQNEQWIRIAVKKGGMIVLPAGMYHRFTLDSDNYIKAMRLFVGEPIWTPYNRPHDHLPARKEYVDKIINRGGNQTVEAR

SEQ ID NO: 11172 - protein, 198 aa, Secale cereale
MENEFQDGKEEVIQAWYMDDSEEDQRLPHHREPKEFIPLAKLSELGVVSWNLNADNWEKDENLKKIREARGYSYVDICDVCPEKLPNYEAKLKNFFEEHLHTDEEIRYCLEGSGYFDVRDQNEQWIRIAVKKGGMIVLPAGMYHRFTLDSDNYIKAMRLFVGEPIWTPYNRPHDHLPARKEYVDKVINRGGNQTVEAR

SEQ ID NO: 11173 - protein, 198 aa, Saccharum officinarum
MEGQFQDGKEEVIQAWYMDDSEEDQRLPHHREPKEFIPLDKLLELGILSWRLNADDWENDENLKKIREARGYSYMDICDVCPEKLPNYEAKIKNFFEEHLHTDEEIRYCLEGSGYFDVRDQNDQWIRVAVKKGGMIVLPAGMYHRFTLDADNYIKAMRLFVGEPVWTPYNRPHDHLPARKEYVEKIINRGGSQAVEAR

SEQ ID NO: 11174 - protein, 97 aa, Secale cereale
RHGERVPGWQGGGIQAWYMDDSEEDQRLPHHREPKEFIPLAKLSELGVVSWNLNADNWEKDENLKKIREARGVLLCGHLRRMSGEVAKLRGQAEEFL

SEQ ID NO: 11175 - protein, 198 aa, Festuca arundinacea
MENEFQDGKEEVIEAWYMDDSEEDQRLPHHREPKEFIPLNKLSELGVVSWRLNADDWEKDENLKKIREARGYSYVDICDVCPEKLPNYEVKIKNFFEEHLHTDEEIRYCLEGSGYFDLRDENEQWIRVAVKKGGMIVLPAGMYHRFTLDSNNYIKAMRLFVGEPVWTPYNRPHDHLPARKEYVDKIINRGGNQTVEAR

SEQ ID NO: 11176 - protein, 198 aa, Zea mays
MEGQFQVGKEEVIQAWYMDDSEEDQRLPHHREPKEFIPLDKLSELGILSWRLNADDWENDENLKKIREARGYSYMDICDVCPEKLPNYEAKIKNFFEEHLHTDEEIRYCLEGSGYFDVRDQDDQWIRVAVKKGGMIVLPAGMYHRFTLDSDNYIKAMRLFVGEPVWTPYNRPHDHLPARKEYVEKIINRGGNQAVEAR

SEQ ID NO: 11177 - protein, 198 aa, Sorghum bicolor
MEGQFQDGKEEVIQAWYMDDSEEDQRLPHHREPKEFIPLDKLSELGILSWRLNADDWENDEKLKKIREARGYSYMDICDVCPEKLPNYEAKIKNFFEEHLRTDEEIRYCLEGSGYFDVRDENDQWIRVAVKKGGMIVLPAGMYHRFTLDTDNYIKAMRLFVGEPVWTPYNRPHDHLPARKEYVEKIINRGGNQAVEAR

SEQ ID NO: 11178 - protein, 198 aa, Secale cereale
MENEFQDGKEEVIQAWYMDDSEDDQRLPHHREPKEFIPLAKLSELGVVSWNLNADNWEKDENLKKIREARGYSYVDICDVCPEKLPNYEAKLKNFFEEHLHTDEEIRYCLEGSGYFDVRDQNEQWIRIAVKKGGMIVLPAGMYHRFTLDSDNYIKAMRLFVGEPIWTPYNRPHDHLPARKEYVDKVINRGGNQTVEAR

SEQ ID NO: 11179 - protein, 198 aa, Triticum aestivum
MENEFQDGKEEVIQAWYMDDSEEDQRLPHHREPKEFIPLAKLSELGVVSWNLNADDWEKDENLKKIREARGYSYVDICDVCPEKLPNYEAKLKNFFEEHLHTDEEIRYCLEGSGYFDVRDQNEQWIRIAVKKGGMIVLPAGMYHRFTLDSDNYIKAMRLFVGEPIWTPYNRPHDHLPARKEYVDKIINRGGNQTVEAR

SEQ ID NO: 11180 - protein, 198 aa, Avena sativa
MENEFQDGKEEVIQAWYMDDSEEDQRLPHHREPKEFIPLNKLSELGVVSWRLNADDWEKDENLKKIREARGYSYVDICDVCPEKLPNYEVKIKNFFEEHLHTDEEIRYCLEGSGYFDLRDENEQWIRVAVKKGGMIVLPAGMYHRFTLDSDNYIKAMRLFVGEPVWTPYNRPHDHLPARKEYVDRVINRGGNQTVEAR

SEQ ID NO: 11181 - protein, 198 aa, Avena sativa
MENEFQDGKEEVIQAWYMDDSEEDQRLPHHREPKEFISLNKLSELGVVSWRLNADDWEKDENLKKIREARGYSYVDICDVCPEKLPNYEVKIKNFFEEHLHTDEEIRYCLEGSGYFDLRDENEQWIRVAVKKGGMIVLPAGMYHRFTLDSDNYIKAMRLFVGEPVWTPYNRPHDHLPARKEYVDRVINRGGNQTVEAR

SEQ ID NO: 11182 - protein, 181 aa, Panicum virgatum
MDDSEEDQRLPHHREPKEFIPLDKLSELGILSWRLNADDWENDENLKKIRQARGYSYMDICDVCPEKLPNYEAKIKNFFEEHLHTDEEIRYCLEGSGYFDVRDQNDQWIRIAVKKGGMIVLPAGMYHRFTLDTDNYIKAMRLFVGEPVWTPYNRPHDHLPARKEYVERIINRGGNQAVEAR

SEQ ID NO: 11183 - protein, 67 aa, Secale cereale
MENEFQDGKEEVIQAWYMDDSEDDQRLPHHREPKEFIPLAKLSELGVVSWNLNADNWEKDENLKKNP

SEQ ID NO: 11184 - protein, 140 aa, Cenchrus ciliaris
MRTSRKSVKQEATPTWDICDVCPEKLPNYEVKIKNFFEEHLHTDEEIRYCLEGSGYFDVRDENDKWIRVAVKKGGMIVLPAGMYHRFTLDTDNYIKAMRLFVGEPVWTPYNRPHDHLPARQEYLDKLIKAEGVNQAVEAR

SEQ ID NO: 11185 - protein, 198 aa, Leymus cinereus x Leymus triticoides
MENEFQDGKEEVIQAWYMDDSEEDQRLPHHREPKEFIPLAKLSELGVVGWNLNADDWEKDKNLKKIREARGYSYVDICDTCPEKLPNYEAKLKNFFEEHLHTDEEIRYCLEGSGYFDVRDQNEQWIRIAVKKGGMIVLPAGMYHRFTLDSDNYIKAMRLFVGEPIWTPYNRPHDHLPARKEYVDKIINRGGNQTVEAH

SEQ ID NO: 11186 - protein, 198 aa, Avena sativa
MENEFQDGKEEVIQAWYMDDSEEDQRLPHHREPKEFIPLNKLKELGVASWRLNADDWEKDENLKKIREARGYSYVDICDVCPEKLPNYEVKIKNFFEEHLHTDEEIRYCLEGSGYFDLRDEKEQWIRVAVKKGGMIVLPAGMYHRFTLDSDNYIKAMRLFVGEPVWTPYNRPHDHLPARKEYVDRVINRGGSQTVEAR

SEQ ID NO: 11187 - protein, 199 aa, Ananas comosus
MEHEFQEGKEEVIQAWYMDDSDEDQRLPHHREPKEFIPLDKLAELGLLSWRLDADKYETDENLKKIREARGYSYVDICDVCPEKLPNYEAKLKSFFEEHLHTDEEIRYCLEGSGYFDVRDQDDRWIRVAVKKGGMIVLPAGIYHRFTLDTNNYIKAMRLFVGEPIWTPYNRPHDHLPARKEYLDALTKKEGAKQAVEAL

SEQ ID NO: 11188 - protein, 96 aa, Secale cereale
MENEFQDGKEEVIQAWYMDDSEEDQRLPHHREPKEFIPLAKLSELGVVSWNLNADNWEKDENLKKIREARGILLCGHLRRMSGEVAKLRGQAEEFL

SEQ ID NO: 11189 - protein, 186 aa, Cenchrus ciliaris
IQAWYMDDSEEDQRLPHHREPKEFIPLDKLSELGILSWRLNPDDWENDENLKKIREARGYSYVDICDVCPEKLPNYEAKIKNFFEEHLHTDEEIRYCLEGSGYFDVRDQNDQWIRIAVKKGGMIVLPAGMYHRFTLDTDNYIKAMRLFVGEPVWTPYNRPHDHLPARKEYVDRIINRGGNQAVEAR

SEQ ID NO: 11190 - protein, 202 aa, Eragrostis curvula
  misc_feature (138)..(138): Xaa can be any naturally occurring amino acid
  misc_feature (163)..(163): Xaa can be any naturally occurring amino acid
  misc_feature (166)..(166): Xaa can be any naturally occurring amino acid
  misc_feature (173)..(173): Xaa can be any naturally occurring amino acid
  misc_feature (179)..(179): Xaa can be any naturally occurring amino acid
  misc_feature (181)..(181): Xaa can be any naturally occurring amino acid
  misc_feature (188)..(188): Xaa can be any naturally occurring amino acid
  misc_feature (194)..(194): Xaa can be any naturally occurring amino acid
  misc_feature (198)..(198): Xaa can be any naturally occurring amino acid
  misc_feature (200)..(201): Xaa can be any naturally occurring amino acid
METDFQDGKAQVIEAWYMDDSQEDQRLPHHREPKEFIPLEKLSELGIVSWRLNPDNWENDDNLKKIREARGYSYMDICDVCPEKLPNYETKIKNFFEEHLHTDEEIRYCLEGSGYFDVRDQNDQWIRVAVKKGGMIVXPAGMYHRFTLDSNNYIKAMRLFVGXPVXTRTTVPXIICQRXRXIWTNFSXRKLETXPLKXVXXA

SEQ ID NO: 11191 - protein, 199 aa, Musa acuminata
METAFQDGKEEVIQAWYMDDSEEDQRLPHHREPKEFVSLDKLAELGIVSWRLNPDDYENDEDLKKIREARGYSYTDICDVCPEKLPNYEAKLKSFFEEHLHTDEEIRYCLEGSGYFDVRDKNECWIRIAVKKGGMIVLPAGIYHRFTLDTNNYIKAMRLFVGEPVWTPYNRPHDHLPARQEYLNSFVINEAGDRAVEAR

SEQ ID NO: 11192 - protein, 521 aa, Brachypodium distachyon
MAGGGVGALGVKKERAAEYKGRMTWAVAMACLVAAVGGAIFGYDIGISGGVTSMDPFLEKFFPVVFRRKNSGHQNNYCKYDNQGLSAFTSSLYLAGLVSSLVASPVTRNYGRRASIVCGGVSFLIGAVLNVAAVNLAMLILGRIMLGVGIGFGNQGVPLYLSEMAPAHLRGGLNMMFQLATTLGIFTANMINYGTQNLKPWGWRLSLGLAAAPALLMTVGGLLLPETPNSLIERGRAQEGRRVLERIRGTADVDAEFTDMAEASELANTIEHPFRNILEPRNRPQLVMAVCMPAFQILTGINSILFYAPVLFQTMGFGADASLYSSVITGAVLFFSTLISIATVDRLGRRKLLISGGIQMIVCQVIVAVILGVKFGTDKQLTRSYSVAVVVVICLFVMAFGWSWGPLGWTVPSEIFPLETRSAGQSITVAVNLFFTFVIAQAFLSLLCAFKFGIFLFFAGWIAVMTVFVYVFLPETKGVPIEEMVLLWRKHWFWKKVMPDMPLHEEDGWGGAGDGARAHHK

SEQ ID NO: 11193 - protein, 520 aa, Setaria italica
MAGGGVAALGVNTERAAQYKGRMTLAVAMTCLVAAVGGAIFGYDIGISGGVTSMDPFLKKFFPAVYHRKNSGSQNNYCKYDNQGLAAFTSSLYLAGLVSSLAASPVTRNYGRKASIVCGGISFLVGATLNVAAVNLAMLILGRIMLGVGIGFGNQAVPLYLSEMAPAHLRGGLNMMFQLATTLGIFTANLINYGTQNIKPWGWRLSLGLAAAPAMLMTLGGLLLPETPNSLIERGRVEEGRRVLERIRGTADVDAEFTDMVEASELANTIEHPFRNILERRNRPQLVMAVCMPAFQILTGINSILFYAPVLFQSMGFGGNASLYSSVLTGAVLFSSTLISIGTVDRLGRRKLLISGGIQMIVCQVIVAVILGVKFGADKQLSRSYSIAVVVVICLFVLAFGWSWGPLGWTVPSEIFPLETRSAGQSITVAVNLLFTFAIAQAFLSLLCAFKFGIFLFFAGWITVMTVFVYVFLPETKGVPIEEMVLLWRKHWFWKKVMPDMPLEDGWGAAGGHAANNSHK

SEQ ID NO: 11194 - protein, 520 aa, Setaria italica
MAGGGVAALGVNTERAAQYKGRMTLAVAMTCLVAAVGGAIFGYDIGISGGVTSMDPFLKKFFPAVYHRKNSGSQNNYCKYDNQGLAAFTSSLYLAGLVSSLAASPVTRNYGRKASIVCGGISFFVGATLNVAAVNLAMLILGRIMLGVGIGFGNQAVPLYLSEMAPAHLRGGLNMMFQLATTLGIFTANLINYGTQNIKPWGWRLSLGLAAAPAMLMTLGGLLLPETPNSLIERGRVEEGRRVLERIRGTADVDAEFTDMVEASELANTIEHPFRNILERRNRPQLVMAVCMPAFQILTGINSILFYAPVLFQSMGFGGNASLYSSVLTGAVLFSSTLISIGTVDRLGRRKLLISGGIQMIVCQVIVAVILGVKFGADKQLSRSYSIAVVVVICLFVLAFGWSWGPLGWTVPSEIFPLETRSAGQSITVAVNLLFTFAIAQAFLSLLCAFKFGIFLFFAGWITVMTVFVYVFLPETKGVPIEEMVLLWRKHWFWKKVMPDMPLEDGWGAAGGHAGNNSHK

SEQ ID NO: 11195 - protein, 518 aa, Sorghum bicolor
MAGGGMAALGVKTERAAQYKGRMTLAVAMTCLVAAVGGAIFGYDIGISGGVTSMDPFLEKFFPVVFHRKNSGGKNNYCKYDNQGLAAFTSSLYLAGLVASLVASPVTRNYGRKASIVCGGVSFLIGAALNVAAVNLAMLILGRIMLGVGIGFGNQAVPLYLSEMAPAHLRGGLNMMFQLATTLGIFTANLINYGTQNIKPWGWRLSLGLAAAPALLMTLAGLFLPETPNSLIERGRVEEGRRVLERIRGTADVDAEFTDMVEASELANTIEHPFRNILEPRNRPQLVMAVCMPAFQILTGINSILFYAPVLFQSMGFGSNASLYSSVLTGAVLFSSTLISIGTVDRLGRRKLLISGGIQMIVCQVIVAVILGAKFGADKQLSRSYSIAVVVVICLFVLAFGWSWGPLGWTVPSEIFPLETRSAGQSITVAVNLLFTFAIAQAFLSLLCAFKFGIFLFFAGWITVMTVFVCVFLPETKGVPIEEMVLLWRKHWFWKKVMPADMPLEDGWGAAPATNNHK

SEQ ID NO: 11196 - protein, 518 aa, Saccharum officinarum
MAGGGMAALGVKTERAAQYKGRMTLAVAMTCLVAAVGGAIFGYDIGISGGVTSMDPFLEKFFPVVFHRKNSGGKNNYCKYDNQGLAAFTSSLYLAGLVASLVASPVTRNYGRKASIVCGGVSFLIGAALNVAAVNLAMLILGRIMLGVGIGFGNQAVPLYLSEMAPAHLRGGLNIMFQLATTLGIFTANLINYGTQNIKPWGWRLSLGLAAAPALLMTLAGLFLPETPNSLIERGRVEEGRRVLERIRGTADVDAEFTDMVEASELANTIEHPFRNILEPRNRPQLVMAVCMPAFQILTGINSILFYAPVLFQSMGFGGNASLYSSVLTGAVLFSSTLISIGTVDRLGRRKLLISGGIQMIVCQVIVAVILGAKFGADKQLSRSYSIAVVVVICLFVLAFGWSWGPLGWTVPSEIFPLETRSAGQSITVAVNLLFTFAIAQAFLSLLCAFKFGIFLFFAGWITVMTVFVCVFLPETKGVPIEEMVLLWRKHWFWKKVMPVDMPLEDGWGAAPASNNHK

SEQ ID NO: 11197 - protein, 520 aa, Hordeum vulgare
MAGGGVAALGVKKERAAEYKGRMTLAVAMACLVAAVGGSIFGYDIGISGGVTSMDPFLEKFFPVVFRRKNSGHQNNYCKYDNQGLSAFTSSLYLAGLVSSLVASPVTRNYGRRASIVCGGISFLIGAILNVAAVNLEMLILGRIMLGVGIGFGNQGVPLYLSEMAPAHLRGGLNMMFQLATTLGIFTANMVNYGTQNLKPWGWRLSLGLAAAPALLMTVGGLLLPETPNSLIERGRAEEGRRVLERIRGTADVDAEFMDMSEASELANTIKNPFRNILEPRNRPQLVMAVCMPAFQILTGINSILFYAPVLFQTMGFGASAALYSSVITGAVLFLSTLISIATVDRLGRRKLLISGGIQMIVCQVIVAVILGVKFGTDKQLSRSYSIVVVVVICLFVMAFGWSWGPLGWTVPSEIFPLETRSAGQSITVAVNLFFTFVIAQAFLSMLCAFKFGIFLFFAGWITVMTVFVYIFLPETKGVPIEEMVLLWRKHWFWKKVMPDMPLEDGWGEGDGGRADNKGH

SEQ ID NO: 11198 - protein, 521 aa, Triticum aestivum
MAGGGMAALGVKKERAAEYKGRMTLAVAMACLVAAVGGSIFGYDIGISGGVTSMDPFLEKFFPVVFRRKNSGHQNNYCKYDNQGLSAFTSSLYLAGLVSSLVASPVTRNYGRRASIVCGGISFLIGAILNVAAVNLEMLILGRIMLGVGIGFGNQGVPLYLSEMAPAHLRGGLNMMFQLATTLGIFTANMVNYGTQNLKPWGWRLSLGLAAAPALLMTVGGLLLPETPNSLIERGRAEEGRRVLERIRGTADVDAEFMDMSEASELANTIKNPFRNILEPRNRPQLVMAVCMPAFQILTGINSILFYAPVLFQTMGFGASASLYSSVITGAVLFLSTLISIATVDRLGRRKLLISGGIQMIVCQVIVAVILGVKFGTDKQLSRSYSIVVVVVICLFVMAFGWSWGPLGWTVPSEIFPLETRSAGQSITVAVNLFFTFVIAQAFLSMLCAFKFGIFLFFAAWITVMTVFVYVFLPETKGVPIEEMVLLWRKHWFWKKVMPDMPLEDGWGEGDGGRADNKAHQ

SEQ ID NO: 11199 - protein, 520 aa, Secale cereale
MAGGGMAALGVKKERAAEYKGRMTLAVAMACLVAAVGGSIFGYDIGISGGVTSMDPFLEKFFPVVFRRKNSGHQNNYCKYDNQGLSAFTSSLYLAGLVSSLVASPVTRNYGRRASIVCGGISFLIGAILNVAAVNLEMLILGRIMLGIGIGFGNQGVPLYLSEMAPAHLRGGLNMMFQLATTLGIFTANMVNYGTQNLKPWGWRLSLGLAAAPALLMTVGGLLLPETPNSLIERGRAEEGRRVLERIRGTADVDAEFMDMSEASELANTIKNPFRNILEPRNRPQLVMAVCMPAFQILTGINSILFYAPVLFQTMGFGASASLYSSVITGAVLFLSTLISIATVDRLGRRKLLISGGIQMIVCQVIVAVILGVKFGTDKQLSRSYSIVVVVVICLFVMAFGWSWGPLGWTVPSEIFPLETRSAGQSITVAVNLFFTFIIAQAFLSMLCAFKFGIFLFFAAWITVMTVFVYVFLPETKGVPIEEMVLLWRKHWFWKKVMPDMPLEDGWGGGDGARADSKGH

SEQ ID NO: 11200 - protein, 523 aa, Zea mays
MAGGGVAALGVKTERAAQYKGRMTLAVATTCLVAAVGGAIFGYDIGISGGVTSMDPFLEKFFPVVFHRKNSGGKNNYCKYDNQGLAAFTSSLYLAGLVASLVASPVTRNYGRKASIVCGGVSFLIGAALNVAAVNLAMLILGRIMLGVGIGFGNQAVPLYLSEMAPAHLRGGLNMMFQLATTLGIFTANLINYGTQNIKPWGWRLSLGLAAVPALLMTLGGLFLPETPNSLIERGRVEEGRRVLERIRGTADVDAEFTDMVEASELANTVEHPFRNILQPRNRPQLVMAVCMPAFQILTGINSILFYAPVLFQSMGFGGNASLYSSVLTGAVLFSSTLISIGIVDRLGRRKLLISGGIQMIVCQVIVAVILGVKFGAEKQLARSYSVAVVVVICLFVLAFGWSWGPLGWTVPSEIFPLETRSAGQSITVAVNLLFTFAIAQAFLSLLCAFKFGIFLFFAGWITVMTVFVYVFLPETKGVPIEEMVLLWRKHWFWKKVMPDMPLEDGWGAAEGHAAPASNNHKG

SEQ ID NO: 11201 - protein, 172 aa, Secale cereale
MAGGGMAALGVKKERAAEYKGRMTLAVAMACLVAAVGGSIFGYDIGISGGVTSMDPFLEKFFPVVFRRKNSGHQNNYCKYDNQGLSAFTSSLYLAGLVSSLVASPVTRNYGRRASIVCGGISFLIGAILNVAAVNLEMLILGRIMLGIGIGFGNQGVPLYLSEMAPAHLRAG

SEQ ID NO: 11202 - protein, 469 aa, Panicum virgatum
MDPFLEKFFPAVFHKKNSGSKNNYCKYDNQGLAAFTSSLYLAGLVASLAASPVTRNYGRKASIVCGGVSFLAGATLNVAAVNLPMLILGRILLGVGIGFGNQAVPLYLSEMAPAHLRGGLNMMFQLATTLGIFTANLINYGTQNIKPWGWRLSLGLAAVPALLMTLGGLLLPETPNSLIERGRAEEGRRVLERIRGTADVDAEYTDMVEASELANTIEHPFRNILERRNRPQLVMAVCMPAFQILTGINSILFYAPVLFQSMGFGGNASLYSSVLTGAVLFSSTLISIGTVDRLGRRKLLISGGIQMIVCQVIVAVILGVKFGADKQLSRSYSIAVVVVICLFVLAFGWSWGPLGWTVPSEIFPLETRSAGQSITVAVNLLFTFAVAQAFLSLLCAFKFGIFLFFAGWITVMTVFVYIFLPETKGVPIEEMVLLWRKHWFWKKVMPDMPLEDGWGAAEGNAAPADKNHK

SEQ ID NO: 11203 - protein, 537 aa, Hordeum vulgare
MAGSMAPLGVKKERAAQYKGHMTFAVAMACIVAAVGGSIFGYDIGISGVNTMDPFLERFFPAVFRRKNLVTLNNYCKYDNQALSAFTSILYLSGQVSTLAAAPVTRNYGRRASIICGGISFLIGAALNAAAANLTTLILGRVMLGVGIGFGNQAVPLYLSEMAPAHLRGGLNMMFQLATTLGIFSANMINYGTQKIKPWGWRLSLGLVAAPALLMTVGGLLLPETPNSLIERGHVEEGRRVLELIRGTTDVDAEFTDMTEASELANTIKHPFRNILERRNRPQLVMAVCMPAFQILTGINSILFYAPVLFQSMGFGASWSLYSSMLTGAVLLFSTLISIATVDRLGRRKLLISGGIQMIVCQLIVAAILGVKFGSDKHLSRGCSVAVVFVICLFMLAFGWSWGPLGWTVPSEIFPLETRSAGQSITVAVNLFFTFVIAQAFLSLLCVFKYAIFIFFAGWIAIMTAFVYVFLPETKGVPIEEMVLLWSKHRFWKNIMPAMPTMPLEDGWGPGDDRGDSAVAADCSIHKSQVKIIVDEQ

SEQ ID NO: 11204 - protein, 377 aa, Cucumis sativus
MAGGSFAPAGVAKERAEQYKGRVTPYVVIACLVAAIGGSIFGYDIGISGGVTSMNPFLKKFFPTVYRNKMRAHENNYCKYNNQGLAAFTSSLYLAGLVSSLVASPITRNYGRRASIVCGGISFLVGATLNAAAVNIEMLILGRIMLGVGIGFGNQAVPLYLSEMAPTHLRGGLNMMFQLATTLGIFTANMINYGTQKIDPWGWRLSLGLAAFPALLMTVGGLLLPETPNSLMERGAKEKGRKTLEKIRGTNDVNAEYEDIQEASEFANSIKHPFRNIFQKRNRPQLVMAFFMPTFQILTGINSILFYAPVLFQSMGFGGDAALYSSALTGAVLASSTLISIATVDRLGRRVLLISGGIQMITSGGGRHYPGGKIWKQ

SEQ ID NO: 11205 - protein, 521 aa, Musa acuminata
MAGGGVVHGPVGVAKERAQQYKGRVTPFVVMACLVAAVGGSIFGYDIGISGGVTSMDPFLKKFFPVVYRKKNSQSHNNYCEYDNQGLAAFTSSLYLAGLVASLAASPVTRKHGRRASIVCGGISFLVGATLNSAAVNLPMLILGRIMLGIGIGFGNQAVPLYLSEMAPAHLRGGLNMMFQLATTLGIFSANMINYGTEKIKPWGWRLSLGLAAAPAILMTIGGALLPETPNSLVEQGRAEEGRRVLEKIRGTNDVDAELQDIVEASELANSIEHPFRNILERRNRPQLIMAILMPTFQILTGINSILFYAPVLFQSMGFGGNAALYSSVMTGAVLASSTLVSIATVDRWGRRPLLIGGGLQMIVCQVAVAVILGVKFGGDKQLSKDFSIVVVVVICLFVAAFGWSWGPLGWTVPSEIFPLETRSAGQSITVSVNLLFTFAIAQSFLSLLCSFKFGIFLFFAGWITIMTVFVYVFLPETKGVPIEEMILLWRKHWFWKRVMPPIEVADEGGPAEAELPDTRL

SEQ ID NO: 11206 - protein, 512 aa, Citrullus lanatus
MAGGSFAPAGVAKERAEQYKGRVTPFVVIACLVAAVGGSIFGYDIGISGGVTSMNPFLKKFFPTVYRNKMRAHENNYCKYNNQGLAAFTSSLYLAGLVSSLVASPITRNYGRRASIVCGGISFLVGATLNAAAVNIEMLILGRIMLGVGIGFGNQAVPLYLSEMAPTHLRGGLNMMFQLATTLGIFTANMINYGTQKIDPWGWRLSLGLAAFPALLMTVGGLLLPETPNSLMERGAKEKGRKILEKIRGTNDVNAEYEDILEASEFANSIKHPFRNIFKRRNRPQLVMAFFMPTFQILTGINSILFYAPVLFQSMGFGGDAALYSSALTGAVLAFSTLISIATVDRLGRRVLLISGGLQMITCQVVVAIILGVKFGNNEELSKGFSILVVIVICLFVLAFGWSWGPLGWTIPSEIFPLETRSAGQSITVAVNLLFTFVIAQSFLSLLCALKYGIFLFFAGWIIVMTVFVYVFLPETKGVPIEEMILMWRKHWFWKNVMPSNADDDQSNANAI

SEQ ID NO: 11207 - protein, 658 aa, Zea mays
MRRPSGAGVPSRRRRAIQVLVAVSLAYAVAVLLLESPLVSTSLPGAGASAAASRKLHLDGAWEGAGRAAPARPAKHPHRETLSADAGRGRARRLAGIVSGLELRHLNSTRSGSLRKVAAEAAESGARVFSDLEALATALTFSGDSSGEEEEKSKCPHSIVLSGDEFRERGRAVELPCGLTLGSYITVAATPHEAHPERDPKITLLREGEEPIMVSQFMMELQGLKTVDGEDPPRILHFNPRLRGDWSGKPVIEQNTCYRMQWGTPLRCDGWRSRADEETVDGLAKCEKWIRDDEGRSEESKTSWWLNRLIGRTKTVSVDWPYPFVENHLFVLTLTAGLEGYHVNVDGRHVTSFPYRTGFVLEDATGLSLNGDLDVQSVFAGTLPTTHPSFSPQKHLELLPSWQAPPLPDEPVEIFIGILSAGNHFAERMAARKTWMSAAQKSSNVVARFFVALHGRNEVNVELKKEAEFFGDIVIVPFMDSYDLVVLKTIAICEYGVHVVSARYIMKCDDDTFVRLDSVMAEVKKIQNGESLYIGNMNYHHKPLRDGKWAVTYEEWPEEDYPIYANGPGYVISSDIAGSILSEFLKHKLRLFKMEDVSMGMWVERFNNTRLVKYVHSIKFCQFGCIDDYYTAHYQSPRQMLCLWDKLQAGKAQCCNMR

SEQ ID NO: 11208 - protein, 656 aa, Zea mays
MRRPSGAGAPCRSRAIQVLVAVSFAYALAVLLLESPFVSTSLLGAGASAAASRKLHLAGAWEGVRRAVPARPAKHPHRETLSSDAGRGRARRLAGIVSGLELCHLNSTRSGSLRKVAAEAAESGARVFSDLEALATALASSRDSSGEEEKSKCPHSIVLSGDEFRERGRAVELPCGLTLGSYITVVATPHEAHPERDPKITLLREGEEPIMVSQFMMELQGLKTVDGEDPPRILHFNPRLRGDWSGKPVIEQNTCYRMQWGTPLRCEGWRSRADEETVDGLVKCEKWIRDDEGRSEESKTSWWLNRLIGRTKTVSVDWSYPFVEDRLFVLTLTAGFEGYHVNVDGRHVTSFPYRTGFVLEDATGLSLDGDLDVQSVFAGTLPTTHPSFSPQKHLEMLPSWQAPPLPDEPVEIFIGILSAGNHFAERMAVRKTWMSAAQKLPNVVARFFVALHGRNEINAELKKEAEFFGDIVIVPFMDSYDLVVLKTIAICEYGVHVVYARYIMKCDDDTFVRLDSVIAEVKKIQNGESLYIGNMNYRHKPLRDGKWAVTYEEWPEEDYPIYANGPGYVISSDIADSILSEFLNLKLRLFKMEDVSMGMWVERFNSTRLVKYVHSVKFCQFGCIDDYYTAHYQSPRQMLCLWDKLQAGKAQCCNMR

SEQ ID NO: 11209 - protein, 652 aa, Setaria italica
MRRSPGPGAPCRRRAIQGFVALFLAYALVVLLLESPLVSTSLPGAAGASAAASRKLHLDGAWEGGRAAPARPSKHPHRETLSADGGRRRSGIVSGLELRHLNSTRSGSLRKVAAEAAELGARVFSDLQTLATTLPSLEDSSDEEEKSKCPHSIVLSGDEFRERGRAVELPCGLTLGSHITVAATPHEAHPERDPKITLLKDGEEPIMVSQFMMELQGLKTVDGEDPPRILHFNPRLRGDWSGKPVIEQNTCYRMQWGTPLRCEGWRSRADEETVDGLVKCEKWIRDDERRLEESKTSWWLNRLIGRTKTVSVDWPYPFVEDRLFVLTLTAGLEGYHVNVDGRHVTSFPYRTGFVLEDATGLSLNGDLDVQSVFAGTLPTTHPSFSPQKHLEMLPSWQAPPLPDEPVEIFIGILSAGNHFAERMAARKTWMSAAHKSLNVVARFFVALHGRNEVNAELKKEAEFFGDIVIVPFMDSYDLVVLKTIAICEYGVRVVSARYIMKCDDDTFVRLESVITEVRKIRNGESLYIGNMNYHHKPLRNGKWAVTYEEWPEEDYPIYANGPGYVISSDIADSILSEFVNHKLRLFKMEDVSMGMWVERFNNTRLVKYVHSVKFCQFGCIDDYYTAHYQSPRQMLCLWDKLQAGKAQCCNMR

SEQ ID NO: 11210 - protein, 656 aa, Panicum virgatum
MRRPPGAGAPCRRRAIQGFVALFLAYALFVLLLESPLVSTSLPGAGASAAAASRKLHLDGAWEGGRAAPARPSKHPHRETLSADGGRGRARRLSWFVSGLELRHLNSTRSGSLRKVAAEAAESGARVFADLHTLATNLTFSQDSPDEEERSMCPHSIALSGDEFRERGRTVELPCGLTLGSYITVAATPHEAHPERDPKITLLKEGEEPIMVSQFMMELQGLKTVDGEDPPRILHFNPRLRGDWSGKPVIEQNTCYRMQWGTPLRCEGWRSRADEETVDGLVKCEKWIRDDEGRSEESKTSWWLNRLIGRTKTVSIDWPYPFVEDHLFVLTLTAGLEGYHVNVDGRHVTSFPYRTGFVLEDATGLSLNGDLDVQSVFAGSLPTTHPSFSPQKHLEMLPSWQAPPLPDEPVEIFIGILSAGNHFAERMAVRKTWMSASQKSSNVVARFFVALHGRNEINVELKKEAEFFGDIVIMPFMDSYDLVVLKTIAICEYGVHVVSARYIMKCDDDTFVRLESVMAEVKKIRNGESLYIGNMNYHHKPLRDGKWAVTYEEWPEEDYPIYANGPGYVISSDIADAILSEFLNHKLRLFKMEDVSMGMWVERFNSTRPVKYVHSIKFCQFGCIDDYYTAHYQSPRQMLCLWDKLQAGKAQCCNMR

SEQ ID NO: 11211 - protein, 641 aa, Panicum virgatum
MRRPPGAGAPCRRRAIQGFVALFLAYALFVLLLESPLVSTSLPGAGASAGVAEAPPRRRHPHRETLSADGGRGRARWLSGFVSGLELRHLNSTRSGSLRKVAAEAAESGARVFADLQTLATNLTSSRDSPDEEQRNKCPHSIVLSGDEFRERGRTVELPCGLTLGSYITVAATPHEAHPERDPKITLLKEGEEPIMVSQFMMELQGLKTVDGEDPPRILHFNPRLRGDWSGKPVIEQNTCYRMQWGTPLRCEGWRSRADEETVDGLVKCEKWIRDDEGRSEESKTSWWLNRLIGRTKTVSIDWPYPFVEDHLFVLTLTAGLEGYHVNVDGRHVTSFPYRTGFVLEDATGLSLNGDLDVQSVFAGSLPTTHPSFSPQKHLEMLPSWQAPPLPDEPVEIFIGILSAGNHFAERMAARKTWMSAAQKSSNVVARFFVALHGRNEINVELKKEAEFFGDIVIVPFMDSYDLVVLKTIAICKYGVHVVSARYIMKCDDDTFVRLELVMAEVKKIRNGESLYIGNMNYHHKPLRDGKWAVTYEEWPEEDYPIYANGPGYVISSDIADAVLSEFLNHKLRLFKMEDVSMGMWVERFNSTRPVKYVHSIKFCQFGCIDDYYTAHYQSPRQMLCLWDKLLAGKAQCCNMR

SEQ ID NO: 11212 - protein, 431 aa, Pennisetum glaucum
GAAGASAAASRKLHLDGAWEGARAAPARPSKHPHRETLSADGGRRLSGIVSGLELRHLNSTRSGSLRKVAAEAAELGARVFSDLQTLATTLPSFEDSSDEEEKSKCPHSIVLSGDEFRERGRAVELPCGLTLGSHITVAATPHEAHPERDPKITLLKDGEEPIMVSQFMMELQGLKTVDGEDPPRILHFNPRLRGDWSGKPVIEQNTCYRMQWGTPLRCEGWRSRADEETVDGLVKCEKWIRDDEGRSEESKTSWWLNRLIGRTKTVSVDWPYPFVEDRLFVLTLTAGLEGYHVNVDGRHVASFPYRTGFVLEDATGLSLNGDLDVQSVFVGTLPTTHPSFSPQKHLEMLPIWQAPPLPDEPVEIFIGILSAGNHFAERMAARKTWMSAAHKSSNVVARFFVALHGRNEVNAELKKEAEFFWGHCYCAIHG

SEQ ID NO: 11213 - protein, 655 aa, Oryza sativa
MRRPPAAGATCRRFAIRGFVAVFLVYVLAALALESPLLVVPTPVPGAGAATAASRPLHLDGSGERGRGSAPARPLKRPHRETLSAAGRSSRRLPGIVSGLDLRRLNATRSGSLRKVAAEAAAAGARVFSELQTLAGTVTELDATGEEERSRCPHSIVLTGDEFRVKGRTVELPCGLTLGSYITVAATPRAAHADRDPKITLVREGDEPIMVSQFMMELQGLKTVDGEDPPRILHFNPRLRGDWSGKPVIEQNTCYRMQWGTSLRCEGWRSRADEETVDGMVKCEKWIRDDEERSEQSKTSWWLNRLIGRTKKVSVDWPYPFVEDCMFVLTLTAGLEGYHVNVDGRHVTSFPYRTGFVLEDATGLSLNGDLDVQSVFAGTLPTAHPSFSPQKHLEMLPIWQAPPLPDEPIEIFIGILSAGNHFAERMAVRKTWMSAAQKSSNVVARFFVALNSRKEVNAELKKEAEFFGDIVIVPFMDSYDLVVLKTVAICEYGVRVVSARYIMKCDDDNFVRLESVKDELKKIPRGKSLYVGNMNYHHKPLRTGKWAVTYEEWPEEDYPTYANGPGYVISSDIAASIVSEFTAHKLRLFKMEDVSMGMWVERFNNTRHVQYVHSIKFCQFGCIDDYYTAHYQSPRQMLCLWDKLQSGKAQCCNMR

SEQ ID NO: 11214 - protein, 642 aa, Brachypodium distachyon
MRRPPAAAAGASSCRRRAVQGFVALAFLAYALLVLSLGSRGAAHASLPGGKGSASSRPLHLDGDGERGAPARPSKRAHRETLEAAPGIVSGLDLRRLNSSRSGSLRKVAAEAAAAGARVFSELQALAGTLSASSDEEERSKCPHSIVLTGDEFRARGRAVELPCGLTLGSYITVAATPNAAHPERDPKITLLKEGDEPIMVSQFMMELQGLKTVDGEDPPRILHFNPRLRGDWSGKPVIEQNTCYRMQWGTPLRCEGWMSRADEETVDGMAKCEKWIQDEGSKESMTSWWLNRLIGRTKKVSVDWPYPFVEDRLFVLTLTAGLEGYHVNVDGRHVTSFPYRIGFVLEDATGLSLNGNLDVQSVFAGTLPTTHPSFAPQKHLEMLPVWQAPPLPDGPVEIFVGILSAGNHFAERMAVRKTWMSAAQKSSNVVARFFVALNGRKEVNMELKKEAEFFGDIVIVPFMDSYDLVVLKTVAICEYGVRISARYIMKCDDDTFVRLESVMAEVKRIPSSKSLYIGNMNYRHYPLRNGKWAVTYEEWPEEDYPTYANGPGYVISSDIADSIVSEFTNHKLRLFKMEDVSMGMWVERFNKTRPVEYVHSVKFCQFGCIDDYYTAHYQSPRQMLCLWDKLQAGRPRCCNMR

SEQ ID NO: 11215 - protein, 480 aa, Glycine max
MASTTMLLLVVFMILCISHPSFQMVLVPLTHTLSKAQFNSTHHLLKSTSTRSAKRFRRQLSLPLSPGSDYTLSFNLGPQAQAQPITLYMDTGSDLVWFPCAPFKCILCEGKPNEPNASPPTNITQSVAVSCKSPACSAAHNLAPPSDLCAAARCPLESIETSDCANFKCPPFYYAYGDGSLIARLYRDTLSLSSLFLRNFTFGCAHTTLAEPTGVAGFGRGLLSLPAQLATLSPQLGNRFSYCLVSHSFDSERVRKPSPLILGRYEEKEKEKIGGGVAEFVYTSMLENPKHPYFYTVSLIGIAVGKRTIPAPEMLRRVNNRGDGGVVVDSGTTFTMLPAGFYNSVVDEFDRRVGRDNKRARKIEEKTGLAPCYYLNSVADVPALTLRFAGGKNSSVVLPRKNYFYEFSDGSDGAKGKRKVGCLMLMNGGDEADLSGGPGATLGNYQQQGFEVEYDLEEKRVGFARRQCALLWERLNRDKN

SEQ ID NO: 11216 - protein, 476 aa, Phaseolus vulgaris
MTSTMLLLVLLMILCISHPSFQMLLLPLTHTLSQAQFNSTHHLLKSTSTRSAARFRRQLSLPLSPGSDYTLSFNLGPHAQPITLYMDTGSDLVWFPCAPFKCILCEGKPNEPNASPPTNITRSVAVSCKSLACSAAHNLASSSDLCAMARCPLESIETSDCANFKCPPFYYAYGDGSLVARLYRDTLSLSSLSLRNFTFGCAHTALAEPTGVAGFGRGLLSLPAQLATLSPQLGNRFSYCLVSHSFDSDRVRKPSPLILGRYEEKEKEKISGGGMVEFVYTSMLENPKHPYFYTVGLIGISVGKRTIPAPEMLRRVNNRGDGGVVVDSGTTFTMLPEEFYNSVVDEFDRRVGRVNKRARKVEEKTGLAPCYYLNAVAEVPVVTLRFAGGNSSVVLPRKNYFYEFLDGSGERKGKRRVGCLMLMNGGDEGELSGPGATLGNYQQQGFEVVYELEEKRVGFAKRHCASLWERLNRDKN

SEQ ID NO: 11217 - protein, 477 aa, Cajanus cajan
MWLLLLFTMLSFPHPSCQMLLLPLTHTLSQAQAQAQAQFNATHHLLKSTSTRSAARFRRQLSLPLSPGSDYTLSFNLGRQAQPITLYMDTGSDLVWFPCAPFKCILCEGKPNEPNASPPTNITRSVAVSCKSPACAAAHNAASTSDLCTMARCPLESIETSDCASFKCPPFYYAYGDGSLIARLYHDTLSLSSLFLTNFTFGCAHTTLAEPTGVAGFGRGLLSLPAQLATLSPQLGNRFSYCLVSHSFDSERVRKPSPLILGRYHEKDKNIRGGDEVVEFVYTPMLENPKHPYFYCVGLTGISVGKRIIPAPEILRRVNARGDGGVVVDSGTTFTMLPAGFYNSVVAEFERRVGRVNSRARGVEERTGLAPCYYLKAGAEVPRVTLRFAGANSSVVLPRKNYFYEFLEGGDGARRRVGCLMMMNGGDESELSGGPGATLGNYQQQGFEVEYDLEAKRVGFAKRQCASLWERLNRDKN

SEQ ID NO: 11218 - protein, 432 aa, Glycine max
MEKLNLALVSSPKPLMLGHVPAIDATSRDVFRRKHFSFGRVLIAPHRCRFRVSALSSSHRNPKSVQEKLIVKHFASISSSNTQEATSTGVNPQLSPSSTIGSPLFWIGVGVGLSALFSVVASRLKKYAMQQAFKTMMGQMNSQNNQFGNAAFSPGSPFPFPMPTAAGPTAPASSATTQSRAPSASSASQSTITVDIPAAKVEVAPTTNVKDEVEVKNEPKKIAFVDVSPEETVQESPFESFKDDESSSVKEARVPDEVSQNGAPSNQGFGDFPGSQSTKKSVLSVDALEKMMEDPTVQKMVYPYLPEEMRNPTTFKWMLQNPQYRQQLEEMLNNMGGSTEWDSRMMDTLKNFDLNSPEVKQQFDQIGLSPEEVISKIMANPEVAMAFQNPRVQAAIMDCSQNPMNITKYQNDKEVMDVFNKISELFPGVGSP

SEQ ID NO: 11219 - protein, 430 aa, Phaseolus vulgaris
MENLNLALVSSSKPLMLGHVPARDATDRDVLRRKPFSLGRVLIAPHRFRYRVSALSSSHHSPKSVQDKLIVKHFASISSSNTQETTSIGVNPQLSPPPSSTIGSPLFWIGVGVGLSALFSMVASRLKKYAMQQAFKTMMGQMNSPNNDFGNAAFSPGSPFPFSMPSAAGPTATAQYGAPSTSSGSQSTVTVDIPATKVEATRTTDIKDEVEVQNKPKKIAFVDVSPEETVQKSPFESVKDNESSSVKEEARVPDEVSQNGAPFNQGFGGFPGSQSTKKSALSVDALEKMMEDPTVQKMVYPHLPEEMRNPDTFKWMLQNPQYRQQLEAMLSNMGGSTEWDNRMMDTLKNFDLNSPEVKQQFDQIGLSPEEVISKIMANPEVAMAFQNPRVQAAIMDCSQNPMNITKYQNDKEVMNVFNKISELFPGMGSP

SEQ ID NO: 11220 - protein, 434 aa, Vigna unguiculata
MENLNLALVSSSKPLMLGRVPARDAADRDVLRRKPFSFGRVLIAPHRCRYRVSALSSSHHGPKSVQEKVVVNHFASVSSSKTQETTSVGVNPQLSPPPSSTIGSPLFWIGVGVGFSALFSMVASRLKKYAMQQAFKTMMGQMNSQNNQFGNAAFSPGSPFPFSMPSAAGPTVPAGSATAQSRAPSTSSRSQSTITVDIPATKVEATGTADIKDQVEVQNEPKKIAFVDVTPEETVLKSPFESVKDDESSSVKEKARVPDEVSQNGVPFNQGFGGFPGSQSTKKSVLSVDALEKMMEDPTVQKMVYPYLREEMRNPDTFKWMLQNPQYRQQLEEMLSNMGGTEWDSQMMDTLKNFDLNSPQVKQQFDQIGLSPEEVVSKIMANPDVAMAFQNPRVQAAIMDCSQNPMNITKYQNDKEIMDVFNKISELFPGVGSP

SEQ ID NO: 11221 - protein, 435 aa, Cajanus cajan
MEKLNLALVSSPKPLMLGHASAKDASARDVFGRKPFSFGRALVAPHRCRFRVSALSSSHHGAKSVQEKLIVKRFASVSSSRGQETTSIGVNPQLAPPPSSTIGSPLFWIGVGVGFSALFSMVASRLKKYAMQQAFKTMMGQMNSQNNQFNNAAFSPGSPFPFSTPSASGPTTPASSAATQYQVPPAYNASQSTVTVDIPATKVEPSPTTNIKDEEEVKNEPKKIAFVDVSPEETAQKSPFENFKDVDESSSVKEARVPDEVSQNGAPSNQGFGNFSGSQSTRKSVLSVEALEEMLEDPTVQKMIFPYLPEEMRNPATFKWMLKNPQYRQQLEEMLNNMSGNTEWDSRMMDTLKNFDLNSPEVKQQFDQIGLSPEEVISKIMANPDVAMAFQNPRVQAAIMDCSQNPMNITKYQNDKEVMDVFNKISELFPGVGSP

SEQ ID NO: 11222 - protein, 433 aa, Cicer arietinum
MENLNLALVSSPKPLLLGHSSSRNVFTRRKPFTFGKFFVSANSSSSHVTRAAPKSHQNPKSVQGKLIVHNFASISSSNSQETTSVGVSPQLSPPPSSTVGSPLFWIGVGVGFSALFSIVASRLKKYAMQQAFKTMMGQMNTQNNPFDSAAFSPGSPFPFPMPSSSGPAAPASSAGTQSQSTSARTASQSTVTVDIPATKVEAAPSTNAKDEVEVKNEPKKIGFVDVSPEESVQKSPFESFKDVDESSSFKEARAPAEAFQNGAPSNQGFGNSPGSQSGGKSVLSVEALEKMMEDPTVQKMVYPYLPEEMRNPSTFKWMLQNPQYRQQLEEMLNNMGGSTEWDSRMMDTLKNFDLNSPDVKQQFDQIGLSPEEVISKIMANPEVAMAFQNPRVQAAIMDCSSNPLNIAKYQNDKEVMDVFNKISELFPGVSGPP

SEQ ID NO: 11223 - protein, 209 aa, Cajanus cajan
MINKVAVLPVLLLFIIAALASDPDPVMDFCIAKPADNSFTCKNASTATVEDFTYSGIKVPGNFKQTGFSSMAVNSNVFPGLNTLGVSFVRADFGVGGVNVPHFHPRATEVAFVLEGRVYSGFVDTKNKVFAKVLEKGEVMVFPRGLVHFQMNVGDGPATILGSFDSQNPGLMRIPNAVFGSDIKEELLEKAFGLSSKELSKLKKRFSPS

SEQ ID NO: 11224 - protein, 209 aa, Lupinus angustifolius
MFNKVAFLLVLLHFIIITIASDPDPINDFCIPKSEDNSFSCKNSSTATVEDFIFSGIKLPGNFKKTGFSSMGVNSNVFPGLNTLGVSFVRADFDVGGVNVPHFHPRATEVAFVVEGKIYSGFVDTKNKVFAKVLEKGEVMVFPRGLVHFQMNVGDGPATIFGSFDSQNPGLMRIPNAVFGSEIKEELLEKAFGLSSKELSKLKKRFSLS

SEQ ID NO: 11225 - protein, 211 aa, Phaseolus vulgaris
MLILQKIAVLLVSLLFTTGVLASDPDPLMDFCIAKSAESSLTCKNSSTATVEDFTYSGIKFPGNFKQTGFSSKGVNSNVFPGLNTLGVSFVRADFGVGGVNVPHFHPRATEVGFVLEGKIYSGFVDSNNKVFAKVLEKGEVMVFPRGLVHFQMNVGDGPATILGSFDSQNPGLMRIPNAVFGSDIKEELLEKAFGLSSNELSKLKKRFSSI

SEQ ID NO: 11226 - protein, 208 aa, Lotus japonicus
MKKVAVMLILLFFIIAAFASDPDPVMDYCIAKSPDNKSFTCKNSSKATVEDFTFSGIKLPGNFKETGFSGMAVNSNVFPGLNTLGMSFVRADFDVGGVNVPHFHPRATEVAFVLEGKIYSGFVDTKNKVFAKVLEKGEVMVFPRGLVHFQMNVGDGPATILGSFDSQNPGAQKIPNAIFGSDIKEELLEKAFGLSSKELSKLKKRFSS

SEQ ID NO: 11227 - protein, 209 aa, Cicer arietinum
MINKVIILLVIMLFTISAFCSDPDPVMDFCIAKSTDNSFTCKNSSTATVEDFTFSGIKVPGNFKETGFASMGVNSNIFPGLNTLGMSFVRADFDVGGVNVPHFHPRATEVAFVLEGKIYSGFVDTKNKIFAKVLEKGEVMVFPRGLVHFQMNVGDVPATILGSFDSQNPGLMKIPNVVFGSEIKDELLEKAFGFTSKELSKLKKRFSPS

SEQ ID NO: 11228 - protein, 377 aa, Lupinus angustifolius
MIHQSLFKHSSISFSTPFPTPPKRYRFHVHFPSTIRCNASDSSLSPPSVTVTESEHKSGSYPGGLGPYTGRDPNVKKPEWLRQKAPQGERFQQIKGSLSHLKLNTVCEEAQCPNIGECWNGGGDGIATATIMLLGDTCTRGCRFCAIKTSKNPPPPDPMEPINTAMAIASWGVDYIVLTSVDRDDIPDGGSGHFAQTVKAMKDLKPEIMVECLTSDFRGDLKAVETLAHSGLDVFAHNVETVKRLQRIVRDPRAGYEQSLSVLNHAKRSKAGMITKTSIMLGLGETDDEVKEAMADLRAIDVDILTFGQYLQPTPLHLTVKEYVTPEKFAFWKEYGESIGFRYIASGPLVRSSYRAGELFVKTMVREKVKNDGDTLV

SEQ ID NO: 11229 - protein, 210 aa, Medicago truncatula
MINNKVTILLVLMCFIIAVFCSDPDPVMDYCIAKSEDNKFSCKNSSTATVEDFTFSGIKLPGNFKDTGFSSMGVNSNVFPGLNTLGVSFVRADFDAGGVNVPHFHPRATEVAIVLEGKIYSGFVDTKNKIFAKVLEKGEVMVFPRGLVHFQMNVGDVPATIFGSFDSQNPGLMKIPNVVFGSEIKDELLEKAFGLNSKELSKLKKRFSPS

SEQ ID NO: 11230 - protein, 223 aa, Phaseolus vulgaris
MLILQKIVTFPSKTIINKIAVLLVSLLFTTGVLASDPDPLMDFCIAKSAESSLTCKNSSTATVEDFTYSGIKFPGNFKQTGFSSKGVNSNVFPGLNTLGVSFVRADFGVGGVNVPHFHPRATEVGFVLEGKIYSGFVDSNNKVFAKVLEKGEVMVFPRGLVHFQMNVGDGPATILGSFDSQNPGLMRIPNAVFGSDIKEELLEKAFGLSSKELSKLKKRFSSI

SEQ ID NO: 11231 - protein, 182 aa, Arachis hypogaea
MLKEVSVLLLLLVFIIAAMASDPDPVMDFCVAKSPENVFECKNSSAATIEDFTFSGIKFPGNFKKTGFSSVAVNSNVFPGLNTLGVSFVRADFDVGGINVPHYHPRATEVAFVLEGKIYSGFVDTKNKVFAKVLEKGEVMVFPRGMLHFQLNVGDGPATILGSFDSQNPGLMRIPNAVLVLI

SEQ ID NO: 11232 - protein, 177 aa, Glycine max
MINKVAVLLVVLLFIIAALASDPDPVIDFCIAKSPDNSFSCKNSSTATVEDFTYSGIKSPGNFKQTGFSSMAVNSNVFPGFNTLSVSFVATEVAFALEGKIYSGFVDTKNKVFAKVLEKGEVMVFPRGLVHFQMNVGDGPATILGIFGSDIKEELLEKAFGLSSKELSKLKKRFSPS

SEQ ID NO: 11233 - protein, 926 aa, Solanum phureja
MPGNKYTGNQAVASTRLERLLRERELRKSSKVSHFPNESTDNNRGNELSDNDFRQGEADNGGVSYVEQYLEGAALAYNEGWERPDGKPTRQRLLVVANRLPVSAVRRGEESWSLEISGGGLVSALLGVKEFEARWIGWAGVNVPDEAGQRALTKALAEKRCIPVFLDEEIVHQYYNGYCNNILWPLFHYLGLPQEDRLATTRSFQSQFAAYKKANQMFADVVNEHYEEGDVVWCHDYHLMFLPKCLKDYNSQMKVGWFLHTPFPSSEIHRTLPSRSELLRAVLAADLVGFHTYDYARHFVSACTRILGLEGTPEGVEDQGRLTRVAAFPIGIDSERFIRALEVAQVQEHIKELKERFAGRKVMLGVDRLDMIKGIPQKILAFEKFLEENPYWRDKVVLLQIAVPTRTDVPEYQKLTSQVHEIVGRINGRFGTLTAVPIHHLDRSLDFHALCALYAVTDVALVTSLRDGMNLVSYEFVACQELKKGVLILSEFAGAAQSLGAGAILVNPWNITEVAASIGQALNMSAEEREKRHRHNFLHVTTHTAQEWAETFVSELNDTVIEAQQRIRKVPPRLNISDAIERYSFSNNRLLILGFNSTLTESVDTPGRRGGDQIKEMELKLHPELKESLLAICNDPKTTVVVLSGSDRNVLDDNFSEYNMWLAAENGMFLRSTNGVWMTTMPEHLNMDWVDSVKHVFEYFTERTPRSHFEQRETSLVWNYKYADVEFGRLQARDMLQHLWTGPISNASVDVVQGLRSVEVRAVGVTKGAAIDRILGEIVHSKAIATPIDYVLCIGHFLGKDEDVYTFFEPELPSDCIGMPRSKVSDAPKVPGERRSVPKLPSSRTSSKSSQNRNRPVSNSDKKTSNGRRPSPENVSWNVLDLKKENYFSCAVGRTRTNARYLLNTPDDVVAFLRELAEAPISNGTS

SEQ ID NO: 11234 - protein, 956 aa, Nicotiana benthamiana
MPGNKYNGNQTVATTRLERLLRERELRKTSRTSHQTSDSTDSNRGNELSDHDFRQGEADNAGVSYVEQYLEGVARAYSEGWERPDGRPARQRLLVVANRLPVSAVRRGEESWSLEISGGGLVSALLGVKEFEARWIGWAGVNVPDEAGQRALTKALAEKRCIPVFLDEEIVHQYYNGYCNNILWPLFHYLGLPQEDRLATTRSFQSQFAAYKKANQMFADVVTEHYEEGDVVWCHDYHLMFLPKCLKEYNSQMKVGWFLHTPFPSSEIHRTLPSRSELLRAVLAADLVGFHTYDYARHFVSACTRILGLEGTPEGVEDQGRLTRVAAFPIGIDSERFIRALELPQVQEHIKELKDRFAGRKVMLGVDRLDMIKGIPQKILAFEKFLEENPYWRDKVVLLQIAVPTRTDVPEYQKLTSQVHEIVGRINGRFGTLTAVPIHHLDRSLDFHALCALYAVTDVALVTSLRDGMNLVSYEFVACQESKKGVLILSEFAGAAQSLGAGAILVNPWNITEVAASIGQALNMSAEEREKRHRHNFLHVTTHTAQEWAETFVSELNDTVIEAQQRIRKVPPRLNISDAIDRYLLSNNRLLILGFNSALTESVDTPGRRGGDQIREMELKLHPELKEPLTAICNDPKTTVVVLSGSDRNVLDDNFSEYNMWLAAENGMFLRSTNGVWMTTMPEHLNMDWVDSVKHVFEYFTERTPRSHFEQRETSLVWNYKYADVEFGRLQARDMLQHLWTGPISNASVDVVQGLRSVEVRAVGVTKGAAIDRILGEIVHSKAIATPIDYVLCIGHFLGKDEDVYTFFEPELPSDCIGIPRGKVSDALKVPGERRSAPKVPSSRTSSKSSQNRNRPVSNSEKKTSNGGGRSRTGSKSSQNRNRPVSNSEKKTSNGGGRRTSPENVSWNVLDLKKENYFSCAVGRTRTNARYLLSTPDDVVAFLKELAEESISNAPL

SEQ ID NO: 11235 - protein, 950 aa, Nicotiana benthamiana
MPGNKYNGNQTVATTRLERLLRERELRKTSRTSHQTSDSRLLRERELRKTSRTSHQTSDSTDSNRGNELSDHDFRQGEADNAGVSYVEQYLEGVARAYSEGWERPDGRPTRQRLLVVANRLPVSAVRRGEESWSLEISGGGLVSALLGVKEFEARWIGWAGVNVPDEAGQRALTKALAEKRCIPVFLDEEVVHQYYNGYCNNILWPLFHYLGLPQEDRLATTRSFQSQFAAYKKANQMFADVVTEHYEEGDVVWCHDYHLMFLPKCLKEYNSQMKVGWFLHTPFPSSEIHRTLPSRSELLRAVLAADLVGFHTYDYARHFVSACTRILGLEGTPEGVEDQGRLTRVAAFPIGIDSERFIRALELPQVQEHIKELKDRFAGRKVMLGVDRLDMIKGIPQKILAFEKFLEENPYWRDKVVLLQIAVPTRTDVPEYQKLTSQVHEIVGRINGRFGTLTAVPIHHLDRSLDFHALCALYAVTDVALVTSLRDGMNLVSYEFVACQESKKGVLILSEFAGAAQSLGAGAILVNPWNITEVAASIGQALNMSAEEREKRHRHNFLHVTTHTAQEWAETFVSELNDTVIEAQQRIRKVPPRLNISDAIDRYLLSNNRLLILGFNSALTESVDTPGRRGGDQIREMELKLHPELKEPLTAICNDPKTTVVVLSGSDRNVLDDNFSEYNMWLAAENGMFLRSTNGVWMTTMPEHLNMDWVDSVKHVFEYFTERTPRLKLVTLPQALCDENPKANNVEFGRLQARDMLQHLWTGPISNASVDVVQGLRSVEVRAVGVTKGAAIDRILGEIVHSKAIATPIDYVLCIGHFLGKDEDVYTFFEPELPSDCIGIPRGKVSDALKVPGERRSAPKVPSSRTSSKSSQNRNRPVSNSEKKTSNGGGRRTSPENVSWNVLDLKKENYFSCAVGRTRTNARYLLSTPDDVVAFLKELAEESISNAPL

SEQ ID NO: 11236 - protein, 611 aa, Panax ginseng
MPRNKYNGNSSIPSSRIERLLRERELRKNSKASYSNEASDGNRSSELSELELRSRDGDGLAVSYVEQYLEGALAAHALTDGLDRPDGGPFRQRLLVVANRLPVSAVRRGEETWSLEISAGGLVSALLGVKEVEAKWIGWAGVNVPDEAGQNALTKALAEKRCIPVFLDEEIVHQYYNGYCNNILWPLFHYLGLPQEDRLATTRSFQSQFAAYEKANQMFADVVNKHYEEGDVVWCHDYHLMFLPKCLKEYNSKMKVGWFLHTLFPSSEIHRTLPSRSELLRAVLAADLVGFHTYDYARHFVSACTRILGLEGTPDGVEDQGRLTRVAAFPIGIDSERFIRALEVPQVQEHIKELKERFSGRKVMLGVDRLDMIKGIPQKILAFEKFLEENAYWRDKVVLLQIAVPTRTDVPEYQKLTSQVHEIVGRINGRFGTLTAVPIHHLDRSLDFYALCALYAVTDVALVTSLRDGMNLVSYEFVACQDSKKGVLILSEFAGAAQSLGAGALLVNPWNITEVASSIGQALNMTADEREKRHRHNFQHVTTHTAQEWAETFVSELNDTVVEAQQRIREVPPVLPVKDAIKHYLQSNNRLLILGFNATLTEPVDTPGRRG

SEQ ID NO: 11237 - protein, 928 aa, Manihot esculenta
MPGNQYNGNSTPYPSRTQRLLRERELKKSSRASHSNEVTDNHGGTEPCEHDLRLRERDNSNNSYIDQYVEGAIAATRQLAEGCEKQDGRPLRQRLLVVANRLPVSAVRRGEDSWSLEISAGGLVSALLGVKEFEARWIGWAGVNVPDEIGQKALTKALAEKRCIPVFLDEEIVHQYYNGYCNNMLWPLFHYLGLPQEDRLATTRSFQSQFAAYKKANQMFADVVNKHYEEGDVVWCHDYHLMFLPKCLKEYNSNMKVGWFLHTPFPSSEIHRTLPSRSELLRSVLAADLVGFHTYDYARHFVSACTRILGLEGTPEGVEDQGRLTRVAAFPIGIDSDRFIRALEAPQVQEHIKDLKERFAGRKVMLGVDRLDMIKGIPQKILAFEKFLEENSHWRDKVVLLQIAVPTRTDVPEYQKLTSQVHEIVGRINGRFGTLTAVPIHHLDRSLDFHALCALYAVTDVALVTSLRDGMNLVSYEFVACQDAKKGVLILSEFAGAAQSLGAGAILVNPWNITEVADSIRQALTMSCEEREKRHHHNFAHVTTHTAQEWAETFVSELNDTVIEAQLRTRQVPPILPEEDAIKRYLQSNNRLLILGFNATLTEPVDTPGRRVDQIKEMELKLHPELKETLVALCSDPKTTIVVLSGSDSNVLDKNFGEFDMWLAAEHGMFLRFTKGEWMTTMPEHLNMEWVDSVKHVFEYFTERTPRSHFELRETSLVWNYKYADVEFGRLQARDMLQHLWTGPISNASVDVVQGGRSVEVRAVGVTKGAAIDRILGEIVHSKSMTTPIDYVLCIGHFLGKDEDVYTFFEPVLPSDGIGIARAKQTDGLKSPGERRPSLKLPASKSGSKSSQGKTQRPSPNPDKKLNNHSCGSGRRQSPEKISWNVLDLKGDNYFSCSVGRTRTNARYLLHSSDDVVSFLKKLARASS

SEQ ID NO: 11238 - protein, 947 aa, Panax ginseng
MPRNKYNGNSSIPSSRIERLLRERELRKNSKASYSNEASDGNRSSELSELELRSHDGDGLAVSYVEQYLEGALAAHALTDGLDRPDGGPFRQRLLVVANRLPVSAVRRGEETWSLEISAGGLVSALLGVKEVEAKWIGWAGVNVPDEAGQNALTKALAEKRCIPVFLDEEIVHQYYNGYCNNILWPLFHYLGLPQEDRLATTRSFQSQFAAYEKANQMFADVVNKHYEEGDVVWCHDYHLMFLPKCLKEYNSKMKVGWFLHTPFPSSEIHRTLPSRSELLRAVLAADLVGFHTYDYARHFVSACTRILGLEGTPEGVEDQGRLTRVAAFPIGIDSDRFIRALEVPQVQEHIKELKERFSGRKVMLGVDRLDMIKGIPQKILAFEKFLEENAYWRDKVVLLQIAVPTRTDVPEYQKLTSQVHEIVGRINGRFGTLTAVPIHHLDRSLDFYALCALYAVTDVALVTSLRDGMNLVSYEFVACQDSKKGVLILSEFAGAAQSLGAGALLVNPWNITEVASSIGQALNMTADEREKRHRHNFQHVTTHTAQEWAETFVSELNDTVVEAQQRIREKPPILPVKDAIKHYLQSNNRLLILGFNATLTEPVDTPGRRGGDQIREMELKLHPDLKEPLMELCRDPKTTIVVLSGSDRTVLDDNFCEYNMWLAAENGMFLRVTSGEWMTTMPEHLNMDWVDSVKHVFEYFTERTPRSHFELRETSLVWNYKYTDVEFGRLQARDMLQHLWTGPISNASVDVVQGSRSVEVRAVGVTKGAAIDRILGEIVHSKSISTPIDYVLCVGHFLGKDEDVYSFFEPEPSEAMGIPRAKISDPLKLPGERRAGLKLQNSRSGSKPSQRTQRPLPNPEKKNTHNNVHANGRRQSSEKISWNVLDLKGENYFSCTVGRTRSNARYLLGTSDDVVSFLKELAAAASSSQGIYHGLASFDASRSSAE

SEQ ID NO: 11239 - protein, 926 aa, Manihot esculenta
MPGNQYNSNSTPYPSRTQRLLRERELKKSSRSSHSNEATDNHRGIEPCEHDLRLREGDDSNNCYIEQDLEGAIAATKTLAEGCEYQDARPLRQRLLVVANRLPVSAVRRGEDSWSLEISAGGLVTALLGVKEFEARWIGWAGVNVPDEIGQKALTRALAEKRCIPVFLDEEIVHQYYNGYCNNILWPLFHYLGLPQEDRLATTRSFQSQFAAYKKANQMFADVVNKHYEEGDVVWCHDYHLMFLPKCLKEYNSNMKVGWFLHTPFPSSEIHRTLPSRSELLRSVLAADLVGFHTYDYARHFVSACTRILGLEGTPEGVEDQGRLTRVAAFPIGIDSDRFIRALEVPQVQDHIKELKERFSGRKVMLGVDRLDMIKGIPQKILAFEKFLEENSHWRDKVVLLQIAVPTRTDVPEYQKLTSQVHEIVGRINGRFGTLTAVPIHHLDRSLDFHALCALYAVTDVALVTSLRDGMNLVSYEFVACQDSKKGVLILSEFAGAAQSLGAGAILVNPWNITEVADSIRQALTMSCEEREKRHRHNFAHVKTHTAQEWAETFVSELNDTVIEAQLRTRQVPPILPEEDAIERYLQSNNRLLILGFNATLTEPVDTPGRRGDQIKEMELKLHPELKETLVALCSDPKTTIVVLSGSERNVLDENFGEFDMWLAAEHGMFLRLTKAEWMTTMPDHLNMEWVDSVKHVFEYFTERTPRSHFELRETSLVWNYKYADVEFGRLQARDMLQHLWTGPISNASVDVIQGSRSVEVRPVGVTKGAAIDRILGEIVHSKSMTTPIDFVLCVGHFLGKDEDVYTFFEPVLPSDGVGIARTKQTDGLKSPGEKRPPPKLPAKSGSKSSQGKSRPSPNLDKKMTNNSCASGRRQSPEKISWNVLDLKGDNYFSCAVGRTRTNARYLLQSSDDVVSFLKKLANASP

SEQ ID NO: 11240 - protein, 925 aa, Eucalyptus grandis
MPGNKYNGNTVHFPGRVERLLRERELRKSSRATHSNETTEAELEHGLRFRDGENSGISNVEQFLEGAAAARAFTEGFERPDGRSSRQRLLVVANRLPVSAVRRGEDSWSLEMSSGGLVTALLGVKGFEARWIGWAGVNVPDEIGQRALTDALAQKKCIPVFLDEEIVHQYYNGYCNNILWPLFHYLGLPQEDRLATTRSFQSQFFAYQKANQMFADVVNKHYEEGDVVWCHDYHLMFLPKCLKEYNSQMKVGWFLHTPFPSSEIHRTLPSRSELLRAVLAADLVGFHTYDYARHFVSACTRILGLEGTPEGVEDQGRLTRVAAFPIGIDADRFIRALDTQPVQDHIKELKERFAGRKVMLGVDRLDMIKGIPQKILAFEKFLEENSNWHDKVVLLQIAVPTRTDVPEYQKLTSQVHEIVGRINGRFGTLTAVPIHHLDRSLDFHKLCALYAVTDVALVTSLRDGMNLVSYEFVACQDSKKGVLILSEFAGAAQSLGAGAILVNPWNITEVAVSIAQALNMPAEEREKRHRHNYAHVTTHTAQEWAEMFVSELNDTVVEAQLRTKQVPPLLPVQDAIGRYLLSNNRLLILGFNATLTEPVDTPGRRGDQIKEMDLKLHPELKEPLTALCSDSRTTVVVLSGSDRIVLDDNFAEYNMWLAAENGMFLRLTKGDWMTTMPEHLNMEWVDSVKHVFEYFTERTPRSHFEHRETSLVWNYKYADVEFGRLQARDMLQHLWTGPISNASVDVVQGSRSVEVRAVGVTKGAAIDRILGEIVHSKSMTTPIDYVLCIGHFLGKDEDVYTFFEPELPCDALGIPRTKATDGLKSPGEKRSSLKLQASKSGSKASAVKTQRPLPNPEKRTNNHASGSGRRSSPDKISWNVLDLKGENYFSCAVGRTRTNARYMLTSSDDVVSFLKELASASLFEE

SEQ ID NO: 11241 - protein, 931 aa, Prunus mume
MPGDKYNSNSSHIPNRLERLLRERELRKNIRASHLNEAHDNNRVTQPFEPDLQLREDENSKVAYVEQFLEGAAAARALTDGCEKQEGQPLRQRQRLLVVANRLPVSAVRRGEDSWSLDISAGGLVSALLGVKEFEARWIGWAGVNVPDEIGQKALTKALAEKRCIPVFLDEEIVHQYYNGYCNNILWPLFHYLGLPQEDRLATTRSFQSQFAAYKKANQMFADVVNEHYLEGDVVWCHDYHLMFLPKCLKDYNSKMKVGWFLHTPFPSSEIHRTLPSRSELLRSVLAADLVGFHTYDYARHFVSACTRILGLEGTPEGVEDQGRLTRVAAFPIGIDSERFIRALEVPQVQEHIRELKERFAGRKVMLGVDRLDMIKGIPQKILAFEKFLEENPSWRDKVVLLQIAVPTRTDVPEYQKLTSQVHEIVGRINGRFGTLTAVPIHHLDRSLDFQALCALYAVTDVALVTSLRDGMNLVSYEFVACQDAKKGVLILSEFAGAAQSLGAGAILVNPWNITEVANSIAQALNMDSEEREKRHKHNFIHVTTHTAQEWAETFVSELNDTVVEAQIRTRQVPPPLPNKEAIERYSKASNRLIILGFNATLTEPVHTPERRGDQIKEMELKLHPELKEPLSALCNDPQTTIVVLSGSATEVLDDNFGELDMWLAAENGMFLRLTKGKWMTTMPEHLNMEWVESVKHVFEYFTERTPRSHLDDRATSLVWNYKYADVDFGRLQARDMLQHLWTGPISNASVDVVQGSRSVEVRPVGVTKGAAIDRILGEIVHSKSMTTPIDYVLCIGHFLGKDEDVYTFFEPDLPPEPMGLPRKMTDGQKLPSERRSSLKVPSNKNASKSAQSKTQRPLPNGEKKNANHSNGNPRWPSPEKTSWNVLDLKRENYYSCTVGRTRTNARYLLQSSDDVVSFLKELAGASSASS

SEQ ID NO: 11242 - protein, 922 aa, Populus trichocarpa
MPGNQYNGNSTLNSGRVGRLLKIREQRRSIRSAYSNEVTDNHRGTEACENDLRTREGDSLNNSFIEQYLEGAIAEGYEKLDVRPLRQRLLVVANRLPVSAVRRGEDSWSLEISAGGLVTALLGVKEFEAKWIGWAGVNVPDEVGQKALTEALAEKRCIPVFLDEEIVHQYYNGYCNNILWPLFHYLGLPQEDRLATTRSFQSQFAAYKKANQMFADVVNQHYEEGDVVWCHDYHLMYLPKCLKEYNNNMKVGWFLHTPFPSSEIHRTLPSRSDLLRSVLAADLVGFHTYDYARHFVSACTRILGLEGTPEGVEDQGRLTRVAAFPIGIDSDRFIRALELPQVQEHIKELKERFAGRKVMLGVDRLDMIKGIPQKILAFEKFLEENSAWRDKVVLLQIAVPTRTDVPEYQKLTSQVHEIVGRINGRFGTLTAVPIHHLDRSLDFHALCALYAVTDVALVTSLRDGMNLVSYEFVACQDSKKGVLILSEFAGAAQSLGAGAILVNPWNITEVADSIRQALTMSPEEREKRHRHNFVHVTTHTAQEWAETFVSELDDTVIEAQLRTKQVPPALPEEDAISRYLQSTNRLLILGFNATLTEPADTPGRRADQIKEMELKLHPELKEALTALCSDRKTTIVVLSGSDRKTLDDNFGEYDMWLAAEHGMFLRLTKGEWMTTMPEHLNMEWVDSVKHVFEYFTERTPRSHFERCETSLVWNYKYADVEFGRLQARDMLQHLWTGPISNASVDVVQGNRSVEVRAVGVTKGAAIDRILGEIVHSKSMTTPIDYVLCIGHFLGKDEDVYTFFEPELPSDSLAVARTKQNDGLKSPIDRRPSMKLPAIRSVSKSSQGKAQRPLLNPEKRTANHGCGSGRRPSAEKISWNVLDLKGDNYFSCAVGRTRTNARYLLGSSDDVVSFLMKLANAST

SEQ ID NO: 11243 - protein, 928 aa, Cucumis sativus
MPGNKYNGNSNDSSDRIPGRLERLLRERKLRKSSKDSYSNEVNDYSKESELIENDHRLKEEETVGIPCKFSEASVASRTFGEGCDKQDGKPPRQRLLVVANRLPVSAVRRGEDSWSLEISAGGLVSALLGVKEFEARWIGWAGVNVPDEVGQKALTEALAEKRCIPVFLDEEIVHQYYNGYCNNILWPLFHYLGLPQEDRLATTRSFQSQFAAYKKANQMFADVVNKHYEEGDVVWCHDYHLMFLPKCLKEHNRKMKVGWFLHTPFPSSEIHRTLPSRSELLRSVLAADLVGFHTYDYARHFVSACTRILGLEGTPEGVEDQGKLTRVAAFPIGIDSERFIRALKIPEVQVHIEELKERFKGRKVMLGVDRLDMIKGIPQKILAFEKFLEENPYWRDKVVLLQIAVPTRTDVPEYQKLTSQVHEIVGRINGRFGTLTTVPIHHLDRSLDFHALCALYAVTDVALVTSLRDGMNLVSYEFVACQDAKKGVLILSEFAGAAQSLGAGALLVNPWNITEVAKSIDRALNMEAEEREKRHRHNFLHVTTHTAQEWAETFVSELNDTVVEAELRIRQCPPPLPFDNAIKHYEQSTNRLLILGFNSTLTEPVDTPERRGDQIREMDLKLHPDLKEPLTAICNDPNTTVVILSGSDRTVLDDNFGEYDMWLAAENGMFLRFTRGDWMTTMPEHLNMEWVDSVKHVFEYFTERTPRSHYELRETSLVWNYKYADVEFGRLQARDMLQHLWTGPISNASVDVVQGSRSVEVRAVGVTKGSAIDRILGEIVHSKSMTTPIDYVLCVGHFLGKDEDVYTFFEPELPSDTIGMPRAKGTDGLKLTGERKPSIKVPLNRNGSKSPHNKGRSSSEKKTSNHNCANGRKPSPEKIQWNVLDLKAENYFSCAVGRARTNARYLLGSSDEVVAFLKELADANAFS

SEQ ID NO: 11244 - protein, 924 aa, Prunus persica
MPGDKYNSNSSHIPNRVERLLRERELRKNSRASHLNEAQPFEPDLQLREDENSKVAYVEQFLEGAAAARALTDGCEKQEGRPLRQRQRLLVVANRLPVSAVRRGEDSWSLDISAGGLVSALLGVKEFEARWIGWAGVNVPDEIGQKALTKALAEKRCIPVFLDEEIVHQYYNGYCNNILWPLFHYLGLPQEDRLATTRSFQSQFAAYKKANQMFADVVNEHYLEGDVVWCHDYHLMFLPKCLKDYNSKMKVGWFLHTPFPSSEIHRTLPSRSELLRSVLAADLVGFHTYDYARHFVSACTRILGLEGTPEGVEDQGRLTRVAAFPIGIDSERFIRALEVPQVQEHIRELKERFAGRKVMLGVDRLDMIKGIPQKILAFEKFLEENPSWRDKVVLLQIAVPTRTDVPEYQKLTSQVHEIVGRINGRFGTLTAVPIHHLDRSLDFHALCALYAVTDVALVTSLRDGMNLVSYEFVACQDAKKGVLILSEFAGAAQSLGAGAILVNPWNITEVANSIAQALNMASEEREKRHKHNFIHVTTHTAQEWAETFVSELNDTVVEAQIRTRQVPPPLPNKEAIERYSKASNRLIILGFNATLTEPVDTPERRGDQIKEMELKLHPELKEPLSALCNDPQTTIVVLSGSATEVLDDNFGELDMWLAAENGMFLRLTKGKWMTTMPEHLNMEWVESVKHVFEYFTERTPRSHLDDRATSLVWNYKYADVDFGRLQARDMLQHLWTGPISNASVDVVQGSRSVEVRPVGVTKGAAIDRILGEIVHSKSMTTPIDYVLCIGHFLGKDEDVYTFFEPDLPPEPMGLPRKMTDGQKLPSERRSSLKVPSNKNASKSAQSKTQRLLLNGEKKNANHSNGNPRWPSPEKISWNVLDLKRENYYSCTVGRTRTNARYLLQSSDDVVSFLTELAGASSASS

SEQ ID NO: 11245 - protein, 922 aa, Fragaria vesca
MPGNKYNSNSAHIPNRVERLLRVRELRKNNRASSQLNEANDNNSEKEEESSRNSYFEKYLDGAAAVRALNEGPENQEARPLRQRLLVVANRLPVSAVRRGEDSWSLEISAGGLVSALLGVKEFEARWIGWAGVNVPDDIGQQALTKALAEKRCIPVFLDEEIVHQYYNGYCNNILWPLFHYLGLPQEDRLATTRSFQSQFSAYKKANQMFADVVNAHYEEGDVVWCHDYHLMFLPKCLKEYNSKMKVGWFLHTPFPSSEIHRTLPSRSELLRSVLAADLVGFHTYDYARHFVSACTRILGLEGTPEGVEDQGRLTRVAAFPIGIDSDRFIRALEVPQVQEHIRELKERFAGRKVMLGVDRLDMIKGIPQKILAFEKFLEENPIWRDKVVLLQIAVPTRTDVPEYQKLTSQVHEIVGRINGRFGSLTAVPIHHLDRSLDFHALCALYAVTDVVLVTSLRDGMNLVSYEYVACQDAKRGVLILSEFAGAAQSLGAGAILVNPWNITEVANSIAQALNMSSEEREKRHRHNFLHVTTHTAQEWAETFVSELNDTVVEAQLRTRQVPPPLPNREAIQRYLRANNRLLILGFNATLTEPVDTPERRGDQIKEMELKLHPDLIEPLTALCNDPNTTIVVLSGSDRNVLDDNFGELDMWLAAENGMFLRATKGQWMTTMPEHLNMEWVESVKHVFEYFTERTPRSHFELRETSLVWNYKYADVDFGRLQARDMLQHLWTGPISNASVDVVQGSRSVEVRAVGVTKGAAIDRILGEIVHSKSMTSPIDYVLCMGHFLGKDEDVYTFFEPDLSTDNNGLPRSKITDGLRSSGERRSSPKLLANKSGSKSSQNKTQRPLPNPEKKAAVNHKSGNVRSPSPDKISWNVLDLKKENYYSCSVGRTRTNARYLLQSSDDVVSFLKELADASSDFE

SEQ ID NO: 11246 - protein, 928 aa, Citrullus lanatus
MPGNKYNGNSNDISDRIPGRVERLLRERKLRKSCKDSYSNEVNDYIKESELIENDLRLKEEETVGTPCKFSEASVASRAFAEGCDKQDGKPPRQRLLVVANRLPVSAVRRGEDSWSLEISAGGLVSALLGVKEFEARWIGWAGVNVPDEVGQKALTEALAEKRCIPVFLDEEIVHQYYNGYCNNILWPLFHYLGLPQEDRLATTRSFQSQFAAYKKANQMFADVVNKHYEEGDVVWCHDYHLMFLPKCLKEHNRKMKVGWFLHTPFPSSEIHRTLPSRSELLRSVLAADLVGFHTYDYARHFVSACTRILGLEGTPEGVEDQGKLTRVAAFPIGIDSDRFIRALKIPEVQEHIEELKERFKGRKVMLGVDRLDMIKGIPQKILAFEKFLEENPYWRDKVVLLQIAVPTRTDVPEYQKLTSQVHEIVGRINGRFGTLTTVPIHHLDRSLDFHALCALYAVTDVALVTSLRDGMNLVSYEFVACQDAKKGVLILSEFAGAAQSLGAGALLVNPWNITEVAKSIDRALNMGAEEREKRHRHNFLHVTTHTAQEWAETFVSELNDTVVEAELRIRQCPPLLPFDNAIKHYVQSTNRLLILGFNSTLTEPVDTPERRGDQIREMDLKLHPELKEPLTAICNDPNTTVVILSGSDRTVLDDNFGEYDMWLAAENGMFLRFTRGDWMTTMPEHLNMEWVDSVKHVFEYFTERTPRSHFELRETSLVWNYKYADVEFGRLQARDMLQHLWTGPISNASVDVVQGSRSVEVRAVGVTKGSAIDRILGEIVHSKSMTTPIDYVLCVGHFLGKDEDVYTFFEPELPSDTIGMARTKGTDGLKLTGERRPSINVPLNRNGSKSPHNKGRSSSEKKTSNHNCANGRKPSPEKIQWNVLDLKAENYFSCAVGRSRTNARYLLGSSDDVVTFLKKLVGANAFS

SEQ ID NO: 11247 - protein, 948 aa, Theobroma cacao
MPENKYNGNSTHIPTRLERLLRERERLLREKELREQRKSSRASHSNEVIDNHRGVEESENGPRFREGDHSGVALVEQYLEEAAAARALVEGCERPDGRPERQRLLVVANRLPVSAVRRGEDSWSLDISAGGLVTALLGVKEFEARWIGWAGVNVPDEIGQKALTKALAEKRCIPVFLDEEIVHQYYNGYCNNILWPLFHYLGLPQEDRLATTRSFQSQFAAYKKANQMFADVVNTHYEEGDVVWCHDYHLMYLPECLKKYNTKMKVGWFLHTPFPSSEIHRTLPSRSELLRSVLAADLVGFHTYDYARHFVSACTRILGLEGTPEGVEDQGRLTRVAAFPIGIDSDRFIRALELPQVQEHIKELKERFAGRKVMLGVDRLDMIKGIPQKILAFEKFLEENSTWRDKVVLLQIAVPTRTDVPEYQKLTSQVHEIVGRINGRFGTLTAVPIHHLDRSLDFPKLCALYAVTDVALVTSLRDGMNLVSYEFVACQDAKKGVLILSEFAGAAQSLGAGAILVNPWNITEVAASIGQALNMHPEEREKRHRHNFHHVTTHTAQEWAETFVSELNDTVVEAQLRTSKVPPELPQNDAMECYLQSSNRLLILGFNATLTEPVDTPGSRGDQIKEMELKLHPEIKVPLTALCNDPKTTVVVLSGSDSRVLDKNFGEYDMWLAGENGMFLRHTKGDWMTTMPELLNMEWVDSVKHVFEYFTERTPRSHFDFRDTSLVWNYKYADVEFGRIQARDMLQHLWTGPISNASVDVVQGSRSVEVRAVGVTKGAAIDRILGEIVHSKSMTTPIDYVLCVGHFLGKDEDVYTFFEPELPSDVTSITRTKPTDGPRLPAERRAALKLPASRSGAKSSQTKTQRPQPAPDRRTGNNHSSGSLRRPSPEKISWSVLDLKGDNYFSCAVGRTRTCARYLLGSSDDVVSFLNRLANASSSCNSFSGLHE

SEQ ID NO: 11248 - protein, 948 aa, Theobroma cacao
MPENKYNGNSTHIPTRLERLLRERERLLREKELREQRKSSRASHSNEVIDNHRGVEESENGPRFREGDHSGVALVEQYLEEAAAARALVEGCERPDGRPERQRLLVVANRLPVSAVRRGEDSWSLDISAGGLVTALLGVKEFEARWIGWAGVNVPDEIGQKALTKALAEKRCIPVFLDEEIVHQYYNGYCNNILWPLFHYLGLPQEDRLATTRSFQSQFAAYKKANQMFADVVNTHYEEGDVVWCHDYHLMYLPECLKKYNTKMKVGWFLHTPFPSSEIHRTLPSRSELLRSVLAADLVGFHTYDYARHFVSACTRILGLEGTPEGVEDQGRLTRVAAFPIGIDSDRFIRALELPQVQEHIKELKERFAGRKVMLGVDRLDMIKGIPQKILAFEKFLEENSTWHEKVVLLQIAVPTRTDVPEYQKLTSQVHEIVGRINGRFGTLTAVPIHHLDRSLDFHALCALYAVTDVALVTSLRDGMNLVSYEFVACQDAKKGVLILSEFAGAAQSLGAGAILVNPWNITEVAASIGQALNMHPEEREKRHRHNFHHVTTHTAQEWAETFVSELNDTVVEAQLRTSKVPPELPQNDAMECYLQSSNRLLILGFNATLTEPVDTPGSRGDQIKEMELKLHPEIKVPLTALCNDPKTTVVVLSGSDSRVLDKNFGEYDMWLAGENGMFLRHTKGDWMTTMPELLNMEWVDSVKHVFEYFTERTPRSHFDFRDTSLVWNYKYADVEFGRIQARDMLQHLWTGPISNASVDVVQGSRSVEVRAVGVTKGAAIDRILGEIVHSKSMTTPIDYVLCVGHFLGKDEDVYTFFEPELPSDVTSITSTKPTDGPRLPAERRAALKLPASRSGAKSSQTKTQRPQPAPDRRTGNNHSSGSLRRPSPEKISWSVLDLKGDNYFSCAVGRTRTCARYLLGSSDDVVSFLNRLANASSSCNSFSGLHE

SEQ ID NO: 11249 - protein, 922 aa, Populus trichocarpa
MPGNQDNGNSIHNSGRVGRLLKLRELRRNIRSAYSNELTDNHRGTEPCEYDLRAREGDSLNNSFIEQFLEGAIAQGCEKPDARPLRQRLLVVANRLPVSAVRRGEDSWSLEMSAGGLVSALLGVKEFEARWIGWAGVNVPDEVGQKSLTKALAEKRCIPVFLDEEIVHQYYNGYCNNILWPLFHYLGLPQEDRLATTRSFQSQFAAYKKANQMFADVVHQHYEEGDVVWCHDYHLMFLPKCLKEYNNNMKVGWFLHTPFPSSEIHRTLPSRSDLLRSVLAADLVGFHTYDYARHFVSACTRILGLEGTPEGVEDQGRLTRVAAFPIGIDSDRFIRALELPQVQDHIKELKERFAGRKVMLGVDRLDMIKGIPQKILAFEKFLEENSHWRDKVVLLQIAVPTRTDVPEYQKLTSQVHEIVGRINGRFGTLTAVPIHHLDRSLDFHALCALYAVTDVALVTSLRDGMNLVSYEFVACQDSKKGVLILSEFAGAAQSLGAGAILVNPWNITEVADSIRQALTMLPEEREKRHRHNFVHVTTHTAQEWAETFVSELNDTVIEAQLRTRQVPPSLPEDNAIRCYLQSTNRLLILGFNATLTEPADTPGRRADQIKEMELKLHPELKEALTALCSDRKTTIVVLSGSDRKALDKNFGEYDMWLAAEHGMFLRLTKGDWMTAMPEHLNMEWVDSVKHVFEYFTERTPRSHFELRETLLVWNYKYADVEFGRLQARDMLQHLWTGPISNASVDVVQGSRSVEVRSVGVTKGAAIDRILGEIVHSKSMTTPIDYVLCIGHFLGKDEDVYTFFEPELPSDALVAARTKQNDGLKLPNERRPPMKLPASRSGPKSSQGKAQRALINPEKGTPNHSCGNSRRPSAEKTSWNVLDLKGDNYFSCAVGRTRTNARYLLGSSDDVVSFLRRLANAST

SEQ ID NO: 11250 - protein, 914 aa, Flaveria ramosissima
MPGNKYNNNANSSSVPSSRIERLLRERELRKNSRASYSNEITTNDGYEFSDNLLEQYLEGSASAAREGWEKPDGGLFTQRLLVVANRLPVSAVRRGEESWSLEVSAGGLVSALLGVKEVEAKWIGWAGVNVPDEPGQRALTKALAEKRCIPVFLDEEVVHQYYNGYCNNILWPLFHYLGLPQEDRLATTRSFQSQFAAYKKANQMFADVVNEHYEEGDVVWCHDYHLMFLPKCLKDHNSNMKVGWFLHTPFPSSEIHRTLPSRSELLRAVLAADLVGFHTYDYARHFVSACTRILGLEGTPEGVEDQGRLTRVAAFPIGIDSDRFIRALENPQVQEHMKELKERFSGRKVMLGVDRLDMIKGIPQKILAFEKFLEENQYWRDKVVLLQIAVPTRTDVPEYQKLTSQVHEIVGRINGRFGTLTTVPIHHLDRSLDFQALCALYAVTDIAIVTSLRDGMNLVSYEFVACQDAKRGVLILSEFAGAAQSLGAGAILVNPWNITEVAASIGQALNMSAEEREKRHRHNFLHVTTHTAQEWAETFVSELNDTVVEAQQRIRQVPPPLPVEEAIERYLQSSNRLIILGFSATLTEPVDTPDRRGGDQIREMDLKLHPEIKEPLTKLCNDPNTTVVVLSGSDRTVLDDNFGEYNMWLAAENGMFLRSTKGTWMTTMPEHSNMEWVDSVKHVFEYFTERTPRSHFELRETSLVWNYKYADVEFGRLQARDMLQHLWTGPISNASVDVVQGSRSVEVRAAGVTKGITIVRILGEIVHSKSISSPIDYVLCIGHFLGKDEDIYTFFEPELPYNGMGIPRPKLNDAAKGSGDKKSGKSGSKPSQKQRVPQSPDNKRTTNNNKNNGFENGGKRSSGSADKVSWNVLDLKADNYFSCAVGRTRTNARYLLQSSDDVVSFLKELTEAS

SEQ ID NO: 11251 - protein, 927 aa, Vitis vinifera
MPGNKYNGISSVPTSRVERLLRDRELRKSSRASHPNEANDTNRGTEVLEHEGDNLGSSHVEQHSETAAIRGVLSEECEKQETRPARQRLLVVANRLPVSAIRRGEESWSLEISAGGLVSALLGVKEFEARWIGWAGVNVPDEAGQRALTKALAEKMCIPVFLDEDIVHQYYNGYCNNILWPLFHYLGLPQEDRLATTRSFQSQFAAYKKANQMFADVVNKHYEEGDVVWCHDYHLMFLPKCLKKYNSEMKVGWFLHTPFPSSEIHRTLPSRSELLHSVLAADLVGFHTYDYARHFVSACTRILGLEGTPEGVEDQGRLTRVAAFPIGIDSHRFIRALDAPQVQDRINELKRTFTGRKVMLGVDRLDMIKGIPQKILAFEKFLEENSEWQQKVVLLQIAVPTRTDVPEYQKLTSQVHEIVGRINGRFGTLTAVPIHHLDRSLDFYALCALYAVTDVALVTSLRDGMNLVSYEFVACQESKKGVLILSEFAGAAQSLGAGAILVNPWNITEVASSIAQALNMPPEEREKRHEHNFEHVKNHTAQEWAETFVSELNDTVVEADLRKRKVPPRLTPENAIKCYLQSNNRLLILGFNVTLTEPVDTPGSRGGDQIKEMDLKLHPELKGPLTALGNDPKTTIVVLSGSDRTVLDDNFGEFDMWLAAENGMFLRHTKGEWMTTMPEHLNMEWVDSVKHVFEYFTERTPRSQLQKRETSLVWNYKYADAEFGKLQARDMLQHLWTGPISNASVDVVQGSRSVEVRAVGVTKGAAIDRILGEIVHNKSMTSPIDYVLCAGHFLGKDEDVYTFFEPELPSDNISMAKSRAIDAFKLSGERKSSLKLPANKSGSKSSHGKTQRPLPNPDKKTPDHSSGSGSGRRPSPEKTSWNVLDLKGENYFSCAVGRTRTKARFTFGSSDEVVSFLKELAGAKSSF

SEQ ID NO: 11252 - protein, 326 aa, Castanea mollissima
MPGNKYISSSNHVGAPNHIPGRVERLLRDREIRKNNRTSHSNDLNDNISRGSESFEHELRLREVDNGHAGQCLEGPENERLHLEGRERLDGRPWRQRLLVVANRLPVSAVRRGEDSWSLEISGGGLVSALLGVKEFEARWIGWAGVNVPDEVGQKALTKALAEKRCIPVFLDEDIVHQYYNGYCNNILWPLFHYLGLPQEDRLATTRSFQSQFAAYKKANQMFADVVNKHYEEGDVVWCHDYHLMFLPKCLKEYNSKMKVGWFLHTPFPSSEIHRTLPSRSELLRSVLAADLVGFHTYDYARHLLVLVLVFLDLRVHLRELRIKGG

SEQ ID NO: 11253 - protein, 900 aa, Panax ginseng
MPRNKYNGNSSIPSSRIERLLRERELRKNSKASEGDGPEVSYVEQYLEGALAAHALTDGLDRPDGGPFRQRLLVVANRLPVSAVRRGEETWSLEISAGGLVSALLGVKEVEAKWIGWAGVNVPDEAGQNALTKALAEKRCIPVFLDEEIVHQYYNGYCNNILWPLFHYLGLPQEDRLATTRSFQSQFAAYEKANQMFADVVNKHYEEGDVVWCHDYHLMFLPKCLKEYNSKMKVGWFLHTPFPSSEIHRTLPSRSELLRAVLAADLVGFHTYDYARHFVSACTRILGLEGTPEGVEDQGRLTRVAAFPIGIDSERFIRALEVPQVQEHIKELKERFSGRKVMLGVDRLDMIKGIPQKILAFEKFLEENAYWRDKVVLLQIAVPTRTDVPEYQKLTSQVHEIVGRINGRFGTLTAVPIHHLDRSLDFYALCALYAVTDVALVTSLRDGMNLVSYEFVACQDSKKGVLILSEFAGAAQSLGAGALLVNPWNITEVASSIGQALNMTADEREKRHRHNFQHVTTHTAQEWAETFVSELNDTVVEAQQRIREVPPVLPVKDAIKHYLQSNNRLLILGFNATLTEPVDTPGRRGGDQIREMELKLHPDLKEPLMELCRDPKTTIVVLSGSDRTVLDDNFCEYNMWLAAENGMFLRVTSGEWMTTMPEHLNMDWVDSVKHVFEYFTERTPRSHFELRETSLVWNYKYADVEFGRLQARDMLQHLWTGPISNASVDVVQGSRSVEVRAVGVTKGAAIDRILGEIVHSKSISTPIDYVLCVGHFLGKDEDVYSFFEPEPSEAMGIPRAKISDPLKLPGERRAGLKLQNSRSGSKPSQRSQRPLPNPEKKNTHIIMCTQMGGVSHQRRYRGMCSISRGRITSPVLLAELAPMLGTFLEHLMMLFHFSRN

SEQ ID NO: 11254 - protein, 942 aa, Arabidopsis thaliana
MPGNKYNCSSSHIPLSRTERLLRDRELREKRKSNRARNPNDVAGSSENSENDLRLEGDSSRQYVEQYLEGAAAAMAHDDACERQEVRPYNRQRLLVVANRLPVSAVRRGEDSWSLEISAGGLVSALLGVKEFEARWIGWAGVNVPDEVGQKALSKALAEKRCIPVFLDEEIVHQYYNGYCNNILWPLFHYLGLPQEDRLATTRSFQSQFAAYKKANQMFADVVNEHYEEGDVVWCHDYHLMFLPKCLKEYNSKMKVGWFLHTPFPSSEIHRTLPSRSELLRSVLAADLVGFHTYDYARHFVSACTRILGLEGTPEGVEDQGRLTRVAAFPIGIDSDRFIRALEVPEVIQHMKELKERFAGRKVMLGVDRLDMIKGIPQKILAFEKFLEENANWRDKVVLLQIAVPTRTDVPEYQKLTSQVHEIVGRINGRFGTLTAVPIHHLDRSLDFHALCALYAVTDVALVTSLRDGMNLVSYEFVACQEAKKGVLILSEFAGAAQSLGAGAILVNPWNITEVAASIGQALNMTAEEREKRHRHNFHHVKTHTAQEWAETFVSELNDTVIEAQLRISKVPPELPQHDAIQRYSKSNNRLLILGFNATLTEPVDNQGRRGDQIKEMDLNLHPELKGPLKALCSDPSTTIVVLSGSSRSVLDKNFGEYDMWLAAENGMFLRLTNGEWMTTMPEHLNMEWVDSVKHVFKYFTERTPRSHFETRDTSLIWNYKYADIEFGRLQARDLLQHLWTGPISNASVDVVQGSRSVEVRAVGVTKGAAIDRILGEIVHSKSMTTPIDYVLCIGHFLGKDEDVYTFFEPELPSDMPAIARSRPSSDSGAKSSSGDRRPPSKSTHNNNKSGSKSSSSSNSNNNNKSSQRSLQSERKSGSNHSLGNSRRPSPEKISWNVLDLKGENYFSCAVGRTRTNARYLLGSPDDVVCFLEKLADTTSSP

SEQ ID NO: 11255 - protein, 934 aa, Tripterygium wilfordii
MPTNKYNGNSTHFPSRVERLLRERKLRKSSRDTHPNEVTDNHKGNEVYENDLQSREDNNLPNSYIEKFLDGAVATRALSEVCEKEDSRPSRQRLLVVANRLPVSAVRRGEDAWSLEISGGGLVSALLGVKDFEARWIGWAGVNVPDEIGQKALTKALAEKRCIPVFLDEEIVHQYYNGYCNNILWPLFHYLGLPQEDRLATTRSFQSQFEAYKKANQMFADVVNKHYEEGDVVWCHDYHLMFLPECLKEYNNKMKVGWFLHTPFPSSEIHRTLPSRSELLRSVLAADLVGFHTYDYARHFVSACTRILGLEGTPEGVEDQGRLTRVAAFPIGIDSARFISALELPQVKEHIRELKERFAGRKVMLGVDRLDMIKGIPQKILAFEKFLEENLTWRDKVVLLQIAVPTRTDVPEYQKLTSQVHEIVGRINGRFGTLTAVPIHHLDRSLDFHALCALYAVTDVALVTSLRDGMNLVSYEFVACQDSKKGVLILSEFAGAAQSLGAGAILVNPWNITEVAASIGLALNMSAEEREKRHRHNFDHVKSHTAQEWAETFVSELNDTVVEAELRTSQVPPGLPENKAIEQYFQSCNRLLILGFNATLTEPVDTSGRRGDQIKEMELKLHPEVKGSLTALCSDAKTTVVVLSGSHSSVMDENFGEFDMWLAAEHGMFLRHTKGEWMTTMPEHLNMEWVESVQHVFEYFTERTPRSHFEQRETSLLWNYKYADVEFGRLQARDMLQHLWTGPISNASLDVVQGSRSVEVRAVGVTKGAAIDRILGEIVHSKSMTTPIDYVLCIGHFLGKDEDVYTFFEPELPSDPSCVGRAKPTDGLKSPSERRALKIPPNRSGTKSSQGRMQRPSPNTEKKYTNHSTGTARRASPEKMSWNVLDLKGKNYFSCSVGRNRTKARYLLGSSDVVPFLKKLAGASSSSVSLAPNS

SEQ ID NO: 11256 - protein, 937 aa, Citrus clementina
MPGNSYNSNSSNIPPDRVTRLVREKIERDLRKSSRASHPNDVTDNGGREVFEDEQRLRDGDNLGPSIVDEDLEGPASTPNEGCERLDGRTFSRQRLLVVANRLPVSAIRRGEDSWSLEISAGGLVSALLGVKEFEARWIGWAGVNVPDEIGQKALTKALAEKRCIPVFLDEDIVHQYYNGYCNNILWPLFHYLGLPQEDRLATTRSFQSQFAAYIKANQMFADVVNKHYKDGDVVWCHDYHLMFLPKCLKEYNSDMKVGWFLHTPFPSSEIHRTLPSRSDLLRAVLAADLVGFHTYDYARHFVSACTRILGFEGTPEGVEDQGRLTRVAAFPIGIDSERFIRALEIHPVQVHIKELQETFAGRKVMLGVDRLDMIKGIPQKLLAFEKFLEENSDWRGKVVLLQIAVPTRTDVPEYQRLTSQVHEIVGRINGRFGTLTAVPIHHLDRSLDFPALCALYAVTDVALVTSLRDGMNLVSYEFVACQDLKKGVLILSEFAGAAQSLGAGAILVNPWNITEVANAIARALNMSPEEREKRHRHNFTHVTTHTAQEWAETFVSELNDTVVEAQLRIKQVPPSLREADSIERYLRSNNRLLILGFNATLTEPVDTPGRRGDQIREMELKLHPDLKQPLNALCHDPKTTIVVLSGSDRNVLDKNFREYNLWLAAENGMFLRCTTGKWMTTMPEHLNMEWVDSLKHVFEYFTERTPRSHFEQRETSLVWNYKYADVEFGRIQARDMLQHLWTGPISNASVEVVQGSKSVEVRAVGVTKGAAIDRILAEIVHSKKMKTAIDYVLCIGHFLGKDEDVYAFFEPELPDDGPGIPRTRPTDAIKVPGERRQALKVASRGSSKISQGKTQRPAQAPEKKTPNHNCTNVRQPSSDKTSYNVLDLNKENYFSCAVGRPRTNARFLLQSSDEVVSFLKKLADASSSHEAHNGPT

SEQ ID NO: 11257 - protein, 937 aa, Citrus sinensis
MPGNSYNSNSSNIPPDRVTRLVREKIERDLRKSSRASHPNDVTDNGGREVFEDEQRLRDGDNLGPSIVDEDLEGPASTPNEGCERLDGRTFSRQRLLVVANRLPVSAIRRGEDSWSLEISAGGLVSALLGVKEFEARWIGWAGVNVPDEIGQKALTKALAEKRCIPVFLDEDIVHQYYNGYCNNILWPLFHYLGLPQEDRLATTRSFQSQFAAYIKANQMFADVVNKHYKDGDVVWCHDYHLMFLPKCLKEYNSDMKVGWFLHTPFPSSEIHRTLPSRSDLLRAVLAADLVGFHTYDYARHFVSACTRILGFEGTPEGVEDQGRLTRVAAFPIGIDSERFIRALEINPVQVHIKELQETFAGRKVMLGVDRLDMIKGIPQKLLAFEKFLEENSDWRGKVVLLQIAVPTRTDVPEYQRLTSQVHEIVGRINGRFGTLTAVPIHHLDRSLDFPALCALYAVTDVALVTSLRDGMNLVSYEFVACQDLKKGVLILSEFAGAAQSLGAGAILVNPWNITEVANAIARALNMSPEEREKRHWHNFTHVTTHTAQEWAETFVSELNDTVVEAQLRIKQVPPSLREADSIERYLRSNNRLLILGFNATLTEPVDTPGRRGDQIREMELKLHPDLKQPLNALCHDPKTTIVVLSGSDRNVLDKNFQEYNLWLAAENGMFLRCTTGKWMTTMPEHLNMEWVDSLKHVFEYFTERTPRSHFEQRETSLVWNYKYADVEFGRIQARDMLQHLWTGPISNASVEVVQGSKSVEVRAVGVTKGAAIDRILAEIVHSKKMKTAIDYVLCIGHFLGKDEDVYAFFEPELPDDGPGIPRTRPTDAIKVPGERRQALKVASRGSSKISQGKTQRPAQAPEKKTPNHNCTNVRQPSSDKTSYNVLDLNKENYFSCAVGRPRTNARFLLQSSDEVVSFLKKLADASSSHEAHNGPT

SEQ ID NO: 11258 - protein, 929 aa, Malus domestica
MPGNKYNGNSAHIPPTRIERLLRERELRKNIKALNLNETFEPELQLREDENSKAALVERFLEGAAAARALNEGCEKQDGRPSRQRLLVVANRLPVSAIRRGEDSWSLEMSAGGLVSALLGVKEFEARWIGWAGVNVPDEIGQKALTRALAEKRCIPVFLDEEIVHQYYNGYCNNILWPLFHYLGLPQEDRLATTRSFQSQFAAYKKANQMFADVVNEHYEEGDVVWCHDYHLMFLPKCLKDYDSKMKVGWFLHTPFPSSEIHRTLPSRSELLRAVLAADLVGFHTYDYARHFVSACTRILGLEGTPEGVEDQGRLTRVAAFPIGIDSDRFIRGLEVPQVQEHIKKMKERLAGRKVMLGVDRLDMIKGIPQKLLAFEKFLEENPTWRDKVVLLQIAVPTRTDVPEYQKLTSQVHEIVGRINGRFGTLTAVPIHHLDCSLDFHELCALYAVTDVALVTSLRDGMNLVSYEFVACQDAKRGVLILSEFAGAAQSLGAGAILVNPWNITEVANSIAQALNMDSEQREKRHKHNFLHVTAHTAQEWAETFVSELNDTVVAAQLRTRQVPPPLPNKDAIQSYLQANNRLIILGFNATLTESVDTPERRGDQIKEMELKLHPKLKETLSALCNDPTTTIVVLSGSERHVLDDNFGELDMWLAAENGMFLRLTKGEWMTTMPEHVNMEWVNSVEHVFEYFKERTPRSHYERRQTSLVWNYKYADIDFGRLQARDMLQHLWTGPISNASVDVVQGSRSVEVRAVGVTKGAAIDRILGEIVHSKSMTSPIDYVLCIGHFLGKDEDVYTFFEPDLPPDPSSLPRTKIPDGLKPNERRSSLKAPAIKSGSKSSQSKAQRAPLPNHEKKNANHNTTNPRWPSPEKVSWNVLDLKKENYYSCAVGRTRTNARYLLQSSDDVVSFLKELAGASSASVSSSGSEI

SEQ ID NO: 11259 - protein, 947 aa, Arabidopsis lyrata
MPGNKYNCSSSHIPLSRTERLLRDRELREKRKSNRARNPNDIAGSSDNSENDLRLEGDSSRQYVEQYLEGAAAAMAHDDACERQEARPYNRQRLLVVANRLPVSAVRRGEDSWSLEISAGGLVSALLGVKEFEARWIGWAGVNVPDEVGQKALSKALAEKRCIPVFLDEEIVHQYYNGYCNNILWPLFHYLGLPQEDRLATTRSFQSQFAAYKKANQMFADVVNEHYEEGDVVWCHDYHLMFLPKCLKEYNSKMKVGWFLHTPFPSSEIHRTLPSRSELLRSVLAADLVGFHTYDYARHFVSACTRILGLEGTPEGVEDQGRLTRVAAFPIGIDSERFIRALEVPDVIQHMKELKERFAGRKVMLGVDRLDMIKGIPQKILAFEKFLEENASWRDKVVLLQIAVPTRTDVPECRSKTHKLTSQVHEIVGRINGRFGTLTAVPIHHLDRSLDFYALCALYAVTDVALVTSLRDGMNLVSYEFVACQEAKKGVLILSEFAGAAQSLGAGAILVNPWNITEVAASIGQALNMTAEEREKRHRHNFHHVKTHTAQEWAETFVSELNDTVIEAQLRISKVPPELPQHDAIQRYSKSNNRLLILGFNATLTEPVDNQGRRGDQIKEMDLNLHPELKGPLKALCSDPSTTIVVLSGSSRSVLDKNFGEYDMWLAAENGMFLRLTNGEWMTTMPEHLNMEWVDSVKHVFKYFTERTPRSHFETRDTSLIWNYKYADIEFGRIQARDLLQHLWTGPISNASVDVVQGSRSVEVRAVGVTKGAAIDRILGEIVHSKLMTTPIDYVLCIGHFLGKDEDVYTFFEPELPSDIPAIARARPSSDSGTKSSSGDRRPPSKLTHNNNKSGSKSSSSSNSNNNNKSSQRSLQSERKSGSNHSLGTSRRPSPEKISWNVLDLKGENYFSCAVGRTRTNARYLLGSPDDVVCFLEKLADTTTSAP

SEQ ID NO: 11260 - protein, 379 aa, Amsonia hubrichtii
MPGNKYNGSSNFPNRIQRLLRERELRKSSKASHSNDSADGGRGTPLSEHDLRQRDGDSSGASMEQYLRDSLAAQSQKTNEGWEWPDGRPVRQRLLVVANRLPVSAVRRGEESWSLEISAGGLVSALLGVKEFEARWIGWAGVNVPDEAGQKALTRALAEKRCIPVFLDEEIVHQYYNGYCNNILWPLFHYLGLPQEDRLATTRSFQSQFAAYKKANQMFADVVNEHYEEGDVVWCHDYHLMFLPKCLKEYNSKMKVGWFLHTPFPSSEIHRTLPSRLELLHAVLAADLVGFHTYDYARHFVSACTRILGLEGTPEGVEDQGRLTRVAAFPIGIDSERFIRALELPKVQEHIKELKKVCWRKVMLGVDRLDMIKGIPQRS

SEQ ID NO: 11261 - protein, 491 aa, Eutrema parvulum
MPGNKYNSSSSHIPLSRTERLLRERELREKWRSNRARNPNEVVGNSDNSENDQRLEGDSSRQYVEQYLEGAAAARAHDDVCERQEARPYNRQRLLVVANRLPVSAVRRGEDSWSLEISAGGLVSALLGVKEFEARWIGWAGVNVPDEVGQKALTKALAEKRCIPVFLDEEIVHQYYNGYCNNILWPLFHYLGLPQEDRLATTRSFQSQFAAYKKANQMFADVVNEHYEEGDVVWCHDYHLMFLPKCLKEYNSKMKVGWFLHTPFPSSEIHRTLPSRSELLRSVLAADLVGFHTYDYARHFVSACTRILGLEGTPEGVEDQGKLTRVAAFPIGIDSERFIRALEVPDVIQHMKELKERFAGRKVMLGVDRLDMIKGIPQKILAFEKFLEENASWRDKVVLLQIAVPTRTDVPEYQKLTSQVHEIVGRINGRFGTLTAVPIHHLDRSLDFYALCALYAVTDVALVTSLRDGMNLVSYEFVACQEAKKRRPYSQ

SEQ ID NO: 11262 - protein, 636 aa, Secale cereale
MSAAVGGAEFHGFGGAAQLPRSRMLGRPVRVAPSGATPAGGGGPSAASIRAVSTPLKKDAKEVKRSKVEIIKEKSNFLRYPLNEELVSEAPNVNETAVQLIKFHGSYQQSDREVRGQKNYSFMLRTKNPSGKVPNQTYLAMDTLADEFGIGTLRLTTRQTFQLHGVLKKNLKHVISTVIKNMGSTLGACGDLNRNVLAPAAPYVRKDILFAQETADNIAALLAPQSGAYYDLWVDGEKIMSAEEPPEVTKARNDNSHGTNFPDSPEPIYGTQYLPRKFKIAVTVAGDNSVDILTNDIGVVVVSDSAGEPVGFNLYVGGGMGRTHRIETTFPRLADPLGYVPKEDILYAIKAIVVTQRENGRRDDRRYSRMKYLIDSWGIDKFRAEVEKYYGKKFEDFRPLPEWQFNSYLGWQEQGDGKLFYGVHVDNGRLGGQAKKTLREIIEKYNLDVSITPNQNLILCGVDQAWREPITAALAQAGLLEPKDVDLLNITSMACPALPLCPLAQTEAERGILPILKRIRAVFDKVGIKDEESVVVRITGCPNGCARPYMAEVGFVGDGPNSYQIWLGGTPNQTTLAETFMNKVKLQDIEKVLEPLFSYWNSTRQEGESFGSFTNRMGFEQLKEVVNKWEGSASAA

SEQ ID NO: 11263 - protein, 636 aa, Secale cereale
MSAAVGGAEFHGFGGAAQLPRSRMLGRPVRVAPPGATPAGGGGPSAASIRAVSTPLKKDAKEVKRSKVEIIKEKSNFLRYPLNEELVSEAPNVNETAVQLIKFHGSYQQSDREVRGQKNYSFMLRTKNPSGKVPNQTYLAMDTLADEFGIGTLRLTTRQTFQLHGVLKKNLKHVISTVIKNMGSTLGACGDLNRNVLAPAAPYVRKDILFAQETADNIAALLAPQSGAYYDLWVDGEKIMSAEEPPEVTKARNDNSHGTNFPDSPEPIYGTQYLPRKFKIAVTVAGDNSVDILTNDIGVVVVSDSAGEPVGFNLYVGGGMGRTHRIETTFPRLADPLGYVPKEDILYAIKAIVVTQRENGRRDDRRYSRMKYLIDSWGIDKFRAEVEKYYGKKFEDFRPLPEWQFNSYLGWQEQGDGKLFYGVHVDNGRLGGQAKKTLREIIEKYNLDVSITPNQNLILCGVDQAWREPITAALAQAGLLEPKDVDLLNITSMACPALPLCPLAQTEAERGILPILKRIRAVFDKVGIKEEESVVVRITGCPNGCARPYMAEVGFVGDGPNSYQIWLGGTPNQTTLAETFMNKVKLQDIEKVLEPLFSYWNSTRQEGESFGSFTNRMGFEQLKEVVNKWEGSASAA

SEQ ID NO: 11264 - protein, 636 aa, Secale cereale
MSAAVGGAEFHGFGGAAQLPRSRMLGRPVRVAPPGATPAGGGGPSAASIRAVSTPLKKDAKEVKRSKVEIIKEKSNFLRYPLNEELVSEAPNVNETAVQLIKFHGSYQQSDREVRGQKNYSFMLRTKNPSGKVPNQTYLAMDTLADEFGIGTLRLTTRQTFQLHGVLKKNLKHVISTVIKNMGSTLGACGDLNRNVLAPAAPYVRKDILFAQETADNIAALLAPQSGAYYDLWVDGEKIMSAEEPPEVTKARNDNSHGTNFPDSPEPIYGTQYLPRKFKIAVTVAGDNSVDILTNDIGVVVVSDSAGEPVGFNLYVGGGMGRTHRIETTFPRLADPLGYVPKEDILYAIKAIVVTQRENGRRDDRRYSRMKYLIDSWGIDKFRAEVEKYYGKKFEDFRPLPEWQFNGYLGWQEQGDGKLFYGVHVDNGRLGGQAKKTLREIIEKYNLDVSITPNQNLILCGVDQAWREPITAALAQAGLLEPKDVDLLNITSMACPALPLCPLAQTEAERGILPILKRIRAVFDKVGIKEEESVVVRITGCPNGCARPYMAEVGFVGDGPNSYQIWLGGTPNQTTLAETFMNKVKLQDIEKVLEPLFSYWNSTRQEGESFGSFTNRMGFEQLKEVVNKWEGSASAA

SEQ ID NO: 11265 - protein, 633 aa, Brachypodium distachyon
MSAVGGAGFHGAAQLPRSRMLGRPVRVAPPPAATPAGGGGPSASSIRAVSAPLKKDATEVKRSKVEIIKEKSNFLRYPLNEELVSEAPNINDNAVQLIKFHGSYQQTDRAVRGQKNYSFMLRTKNPSGKVPNKLYLAMDTLADEFGIGTLRLTTRQTFQLHGVLKKNLKHVISTVIKNMGSTLGACGDLNRNVLAPAAPYVRKDILFAQETAENIAALLAPQSGAYYDLWVDGEKIMSAEEPPEVTKARNDNSHGTNFPDSPEPIYGTQYLPRKFKIAVTVGGDNSVDILTNDIGVVVVSDSAGEPVGFNLYVGGGMGRTHRVETTFPRLADPLGYVPKEDILYAIKAIVVTQRENGRRDDRRYSRMKYLLDRWGIDKFRAEVEKYYGKKFENFRPLPEWEFKSYLGWQEQGDGKLFYGVHVDNGRLGGQAKKTLREIIEKYNLDVSITPNQNLILCGVDQAWRAPITAALTQAGLLEPKDVDLLNITSMACPALPLCPLAQTEAERGILPILKRIRAVFDKVGIKDQESVVVRITGCPNGCARPYMAEVGFVGDGPNSYQIWLGGTPNQTTLAETFMNKVKLQDIEKVLEPLFSYWNSTRQDGESFGSFTNRMGFEQLKEVVNKWEESASAA

SEQ ID NO: 11266 - protein, 635 aa, Avena sativa
MSAAVGGADFHGFAGAAQLPRSRMLGRPVRVAPPGASPAGGGSSAASIRAVSAPLKKDASTVKRSKVEIIKEKSNFLRYPLNEELESEAPNVNDSAVQLIKFHGSYQQSDREVRGQKNYSFMLRTKNPSGKVPNQTYLAMDTLADEFGIGTLRLTTRQTFQLHGVLKKNLKTVISTVIKNMGSTLGACGDLNRNVLAPAAPYVRKDIQFAQETADNIAALLAPQSGAYYDLWVDGEKIMSAEEPPEVTAARNDNSHGTNFPDSPEPIYGTQYLPRKFKIAVTVGGDNSVDILTNDIGVVVVSDDAGEPVGFNIYVGGGMGRTHRVETTFPRLADPLGYVPKEDILYAIKAIVVTQRENGRRDDRRYSRMKYLLDRWGIDKFRAETEKYYGKKFEEFRPQPEWQFNSYLGWQEQGDGKLFYGVHVDNGRLGGQVKKTLREIIEKYNLDVSITPNQNLILCGVEQAWREPITAALAQAGLLEPKDVDLLNITSMACPALPLCPLAQTEAERGILPILKRIRAVFDKVGIKDEESVVVRITGCPNGCARPYMAEVGFVGDGPNSYQIWLGGTPNQTTLAETFMNKVKLQDIEKVLEPLFSYWHNTRQEGESFGTFTNRMGFDQLKEVVNKWAESAAAA

SEQ ID NO: 11267 - protein, 634 aa, Avena sativa
MSAAVGGADFHGFGGAARLPRSRMLGRPVRVAPPGASPAGGSSAASIRAVSAPLKKDASTVKRSKVEIIKEKSNFLRYPLNEELESEAPNVNDSAVQLIKFHGSYQQSDREVRGQKNYSFMLRTKNPSGKVPNQTYLAMDTLADEFGIGTLRLTTRQTFQLHGVLKKNLKTVISTVIKNMGSTLGACGDLNRNVLAPAAPYVRKDIQFAQETADNIAALLAPQSGAYYDLWVDGEKIMSAEEPPEVTAARNDNSHGTNFPDSPEPIYGTQYLPRKFKIAVTVGGDNSVDILTNDIGVVVVSDDAGEPVGFNIYVGGGMGRTHRVETTFPRLADPLGYVPKEDILYAIKAIVVTQRENGRRDDRRYSRMKYLLDRWGIDKFRAETEKYYGKKFEEFRPQPEWQFNSYLGWQEQGDGKLFYGVHVDNGRLGGQVKKTLREIIEKYNLDVSITPNQNLILCGVEQAWREPITAALAQAGLLEPKDVDLLNITSMACPALPLCPLAQTEAERGILPILKRIRAVFNKVGIKDEESVVVRITGCPNGCARPYMAEVGFVGDGPNSYQIWLGGTPNQTTLAETFMNKVKLQDIEKVLEPLFSYWHSTRQEGESFGTFTNRMGFDQLKEVVNKWEESAAAA

SEQ ID NO: 11268 - protein, 641 aa, Oryza sativa
MSAAVGGAEFHGFRGGGGGAAQLQRSRMLGRPLRVATPHAAAPAGGGGSSSASIRAVSAPLKKDASEVKRSKVEIIKEKSNFLRYPLNEELVSEAPNINDSAVQLIKFHGSYQQTDRDVRGQKNYSFMLRTKNPCGKVPNQLYLAMDTLADEFGIGTLRLTTRQTFQLHGVLKKNLKTVISTVIKNMGSSLGACGDLNRNVLAPAAPYVRKDILFAQETAENIAALLTPQSGAYYDLWVDGEKIMSAEEPPEVTKARNDNTYGTNFPDSPEPIYGTQYLPRKFKIAVTVAGDNSVDILTNDIGVVVVSDSAGEPVGFNIYVGGGMGRTHRVETTFPRLADPLGYVPKEDILYAIKAIVVTQRENGRRDDRRYSRMKYLIDNWGIEKFRAEVEKYYGKKFEDSRPLPEWQFNSYLGWQEQGDGKLFYGVHVDNGRVAGQAKKTLREIIEKYNLEVSITPNQNLILCGIDQAWKDPITAALAQSGLLEPKDVDPLNITSMACPALPLCPLAQTEAERGILPILKRIRAVFDKVGIKDHESVVVRITGCPNGCARPYMAEVGFVGDGPNSYQIWLGGTPNQSTLAETFMNKVKLQDIEKVLEPLFSYWNSTRQEGESFGSFTRRTGFDKLKEVVNKWAESASAA

SEQ ID NO: 11269 - protein, 941 aa, Setaria italica
MELRATENRHGACMHVRTHSAATDRDILPISRHTKVFSKRAASYSMPRLYPSPRDRTSRGNQQSNEARRRPLTVSAVTASRHHTGNRRQAATRDPGPRATNERFASDLISDLTPPPFMRAVRLRRLRADRDRGSQVRRGIQLLATKKTSTFNEPTQIPGQIQSHPRSRLQAASWPPRSGCAHIKNSSKSQTLRDNWRAPNVSLTCGARVARPTCQSIAYDAWSAQASGVDRGGCFTTAVPVFPTGIHHPHTPAPRASTATISFQLTCGPVPVVPSGTTPHIPRSLATPPAAAPPPIAFLLPPSPAMSAAVGGAEFHGFRGAAAQLPRSRMLGRPLRVAPPAAAPAGGGASSGSIRAVSAPLKKGAAEVKRSKVEIIKEKSNFLRYPLNEELVSEAPNINDSAVQLIKFHGSYQQTDRDVRGQKNYSFMLRTKNPCGKVPNQLYLAMDTLADEFGIGTLRLTTRQTFQLHGVLKKNLKTVLSTVIKNMGSTLGACGDLNRNVLAPAAPYVRKDILFAQQTAENIAALLTPQSGAYYDLWVDGEKIMSAEEPPEVTKARNDNSHGTNFPDSPEPIYGTQYLPRKFKIAVTVAGDNSVDILTNDIGVVVVSDDAGEPVGFNIYVGGGMGRTHRVETTFPRLADPLGYVPKEDILYAIKAIVVTQRENGRRDDRKYSRMKYLIDRWGIDKFRAEVEKYYGKKFESFRPLPEWQFNSYLGWQEQGDGKLFYGVHVDNGRVGGQAKKTLREIIEKYNLDVSITPNQNLILCGIDQAWREPITTALAQAGLLEPKDVDPLNLTAMACPALPLCPLAQTEAERGILPILKRIRAVFDKVGIKDSESVVVRITGCPNGCARPYMAELGFVGDGPKSYQIWLGGTPNQSTLAESFMNKVKLDDIEKVLEPLFSYWNSTRLEGESFGSFTNRTGFNKLKEVVDKWVESPSAA

SEQ ID NO: 11270 - protein, 636 aa, Setaria italica
MSAAVGGAEFHGFRGAAAQLPRSRMLGRPLRVAPPAAAPAGGGASSGSIRAVSAPLKKGAAEVKRSKVEIIKEKSNFLRYPLNEELVSEAPNINDSAVQLIKFHGSYQQTDRDVRGQKNYSFMLRTKNPCGKVPNQLYLAMDTLADEFGIGTLRLTTRQTFQLHGVLKKNLKTVLSTVIKNMGSTLGACGDLNRNVLAPAAPYVRKDILFAQQTAENIAALLTPQSGAYYDLWVDGEKIMSAEEPPEVTKARNDNSHGTNFPDSPEPIYGTQYLPRKFKIAVTVAGDNSVDILTNDIGVVVVSDDAGEPVGFNIYVGGGMGRTHRVETTFPRLADPLGYVPKEDILYAIKAIVVTQRENGRRDDRKYSRMKYLIDRWGIDKFRAEVEKYYGKKFESFRPLPEWQFNSYLGWQEQGDGKLFYGVHVDNGRVGGQAKKTLREIIEKYNLDVSITPNQNLILCGIDQAWREPITTALAQAGLLEPKDVDPLNLTAMACPALPLCPLAQTEAERGILPILKRIRAVFDKVGIKDSESVVVRITGCPNGCARPYMAELGFVGDGPKSYQIWLGGTPNQSTLAESFMNKVKLDDIEKVLEPLFSYWNSTRLEGESFGSFTNRTGFNKLKEVVDKWVESPSAA

SEQ ID NO: 11271 - protein, 541 aa, Leymus cinereus x Leymus triticoides
TAVQLIKFHGSYQQSDRGVRGQKNYSFMLRTKNPSGKVPNQLYLAMDTLADEFGIGTLRLTTRQTFQLHGVLKKNLKHVISTVIKNMGSTLGACGDLNRNVLAPAAPYVRKDILFAQETAENIAALLAPQSGAYYDLWVDGEKIMSAEEPPEVTKARNDNSHGTNFPDSPEPIYGTQYLPRKFKIAVTVAGDNSVDILTNDIGVVVVSDSAGEPVGFNLYVGGGMGRTHRIETTFPRLADPLGYVPKEDILYAIKAIVVTQRENGRRDDRRYSRMKYLIDSWGIDKFRAEVEKYYGKKFEDFHPLPEWQFNSYLGWQEQGDGKLFYGVHVDNGRLGGQAKKTLREIIEKYSLDVSITPNQNLILCGVDQAWREPITAALAQAGLLEPKDVDLLNITSMACPALPLCPLAQTEAERGILPILKRIRAVFDKVGIKDEESVVVRITGSPNGCARPYMAEVGFVGDGPNSYQIWLGGTPNQTTLAETFMNKVKLQDIEKVLEPLFSYWNSTRQEGESFGSFTNRMGFEQLKEVVNKWEGSASAA

SEQ ID NO: 11272 - protein, 553 aa, Panicum virgatum
EELVSEAPNINESAVQLIKFHGSYQQTDRDVRGQKNYSFMLRTKNPCGKVPNQLYLAMDTLADEFGIGTLRLTTRQTFQLHGVLKKNLKTVLSTVIKNMGSTLGACGDLNRNVLAPAAPYVRKDILFAQQTAENIAALLTPQSGAYYDLWVDGEKIMSAEEPPEVTKARNDNSHGTNFPDSPEPIYGTQYLPRKFKIAVTTAGDNSVDILTNDIGVVVVSDDAGEPVGFNIYVGGGMGRTHRVETTFPRLADPLGYVPKEDILYAIKAIVVTQRENGRRDDRKYSRMKYLIDRWGIDKFRAEVEKYYGKKFESFRPLPEWQFNSYLGWQEQGDGKLFYGVHVDNGRVGGQAKKTLREIIEKYNLDGSITPNQNLILCGIDQAWREPITKALAEAGLLEPKDVDPLNLTAMACPALPLCPLAQTEAERGILLILNRIRAVFDKVGIKDSESVVVRITGCPNGCARPYMAELGFVGDGPKSYQIWLGGTPNQSTLAESFMDKVKLDDIEKVLEPLFSYWNSTRQEGESFGSFTNRTGFNKLKEVVDKWAESPSAA

SEQ ID NO: 11273 - protein, 1844 aa, Phaseolus vulgaris
MAPRNSRGKAKGEKKKKEEKVLPVVIDITVKLLDETHVLKGISTDRIIDVRRLLSVNTDTCYVTNFSLSHEVRGSRLKDTVDVSALKPCLLTLVEEEYNEERAVEHVRRLLDIVACTTSFGPSPPPPPKVAAGTVTKSGKSEVPPAKDAAVTVADVDGEISHSCPKLENFYEFFSLSHLTAPIQYVKKGSRRRVEEISEADYLFSLDVKVCNGKVVHVEACRKGFYSVGKQRILCHNLVDLLRQISRAFDNAFDDLLKAFSERNKFGNLPYGFRANTWLVPPVAAQSPSSFPPLPVEDETWGGNGGSLGKDGTYDLIPWAKEFSLIASMPCKTAEERQVRDRKAFLLHSLFVDVSIFRAIGAVKHVMEEPNVSCSVVENNVVYTERVGDLSIKVLKNGSIASCKIDTKIDGVEATGVNQKDLIERNLLKGITADENTAAHDITTLGVINVRYCGYVVVVKVEGGVRENVVSPSQQIIELFDQPEGGANALNINSLRLLLHNTAPPENNKPMIQIQTFESEETGASHSFVEKLINESLAKLEEEELGMDYFVRWELGACWMQHLQDQSNNTEKDKKPSLEKAKNEMKVEGLGKPLKSLKNFKKKSDSSNTTSASEYSKFSRESQSPSLPSIESQHETTEAENELVLKRMLSEEAFTRFKESGTGLHCKSMHDLIDLSQKYYTDVALPKLVADFGSLELSPVDGRTLTDFMHTRGLRMRSLGHVVKLSEKLSHVQSLCIHEMIVRAFKHILRAVISSVNKEKMASSIAGALNLLLGVPGNRDSDKSHEVHPLVWKWLEMFLKKRFDWDLHRLNYKDVRKFAILRGLCHKVGIELVPRDFDMDSPIPFHKSDIVSLVPVHKQAACSSADGRQLLESSKTALDKGKLEDAVTYGTKALAKLVAVCGPYHRMTAGAYSLLAVVLYHTGDFNQATIYQQKALDINERELGLDHPDTMKSYGDLAVFYYRLQHTELALKYVKRALYLLHLTCGPSHPNTAATYINVAMMEEGLGNVHVALRYLHKALKCNQRLLGADHIQTAASYHAIAIALSLMEAYPLSVQHEQTTLQILRSKLGPDDLRTQDAAAWLEYFESKAFEQQEAARNGTRKPDASIASKGHLSVSDLLDYINPNHDTKGRDAATKRRSQITKVRATSYLNLGMSSSDESSKEIPKEASDEEVQIPVAEGSADSEQESNSGPDSEHTILKQIPDEKPQIYDEILSEAHAEGEDGWQPVQRPRSTGSYGRRLKQRRATLGKVYSYQKNVEVGTESPFVRNASPNSRYYFLKKRPISHGGYTGDHTVNITQGPKFGRKVVKALTYRVKSIPSTSKASANETLETGDKLFSSVSEPDPIDVNPVKNSIVSLGKSPSYKEVALAPPGTISKFQVYNPPSEISVSCEHDGGKPEEEDIEANRNVNPTPAEANDMDKGKSNNSVSSSVDGSQDDTGVTTEGKEETQLIVAVQDKCMNAEGKLGDVEAQGAIDNSSSIQEVDDHVDSSKKELDASNLAGSLEPSDNTNPISQGGKDLRVDVSSSNQSHTGGIPYKKLSASAAPFNPSPTIARAPSIAMNMTLPSGPSVVPGIGPWPVNMNVHPGPTTVLPAVTPMCSSPHHAYPSPPTTPNMMQPLPYMYPPYTQPQSMPPGSFPVTSSAFHANHFTWQCNLNPTVSKFGPGAVWPGCHPVEFPLPLPIVEPIPDPISESQVPCNGSESPSSASVLPEDIDNIGDSNQLVKTLVSDTSEDEAVRAGSESVKENGDMNLHGTENSGNEQNQNIGSNGNSSSGETNMDGEKTFSILIRGRRNRKQTLRMPISLLTRPNGSQSFKVIYNRVVRGSHASKSINLSSSKDCTATA

SEQ ID NO: 11274 - protein, 1828 aa, Cicer arietinum
MAPRNSRGKAKGEKKKKEEKVLPVVMDITVNLPDETNVVLKGISTDRIIDVRRLLSVNTETCYLTNFSLSHEIRGIRLKDTVDVSALKPCLLTLVEEDYEEDGAVDHVRRLLDIVACTTSFGPSSPPKNAAKSSKSQPPPAKQSPKDAAAADGDGEISHSCPKLESFYEFFSLSHLTAPLQYVKKASKRNVEEISEADHLFSLDVKVCNGKVVHVEACRKGFYSVGKQRILCHNLVDLLRQISRAFDNAYDDLLKAFSERNKFGNLPYGFRANTWLVPPIAAQSPSFFPPLPVEDENWGGNGGGLGRNGEYDLIPWANKFSFIASMPCKTAEERQVRDRKAFLLHSLFVDVAIFRAIRAVKHVLEEPNFSCSVAENEIYSERVGDLSVRVLKDGSVANFKIDSKIDGVEATGVNQKDLVERNLLKGITADENTAAHDITTLGVVYVRYCGYVVVVKVEGVGDEKVNSSSHQNSELFDQPEGGANALNINSLRFLLHSTALPENNKQMTEIQMFEGEELGGTDTFVEKLIKNSLANLEEEELSSDYFVRWELGACWVQHLQDQNSTEKDKKPSSEKTSNEMKVEGLGKPLKALKNNNKKKSDSSNPNFASESSKSNLEAEKAALSSSETQHETTAAENELVLKRMLSEAAFTRLKESGTGLHCKSIQDLIDLSQKYYMDVAIPKLVADFGSLELSPVDGRTLTDFMHTRGLRMRSLGHVVKLSEKLSHVQSLCIHEMIVRAFKHILRAVISAVVDKEKMALSIAGALNLLLGVPENKESDKSCYVHPLVWKWLELFLKKRFDWDLNRLNYKDVRKFAILRGLCHKVGIELVPRDFDMDSPFPFQKSDIVSLVAVHKQAACSSADGRQLLESSKTALDKGKLEDAVTYGTKALAKLVAVCGPYHRMTAGAYSLLAVVLYHTGDFNQATIYQQKALDINERELGLDHPDTMKSYGDLAVFYYRLQHTELALKYVKRALYLLHLTCGPSHPNTAATYINVAMMEEGLGNVHIALRYLHKALKCNQKLLGADHIQTAASYHAIAIALSLMEAYPLSVQHEQTTLQILRAKLGPDDLRTQDAAAWLEYFESKAFEQQEAARNGTRKPDASIASKGHLSVSDLLDYINPNHDTKGRDAAAKRRNQVRAISYQNNVSASSDESSKEIQKEASDEELPIPEPGGGADSENESNSAPDSEQPILEKISDEKPQTSNDLLSEALPDGEDGWQSVQRPRSAGSYGRRLKQRRATLGKVYSHQKNVEVGTEHPLVKSANKENSRYYFLKKRTMYHGGYADNRAVNISQGTKFGRKAVKAVAYRVKSTPSASKAIENETLEVGDKEPDSIDVNPVKTSIVSLGKSPSYKEVALAPPGTISKLQVYNPQSEISVSREHDEKHEEEDIEAHRNINPTPKEANNAVKEKYDDSLSDSIEDSQDDTLVATEKKEETQLNKVVEDNCVATEGLESGDIEAQGAVVNSIVINAVEDPADSYKQEFVASNSPCSFEPCNNTNSGSNGGEDLGVNISSSGQSHAGGISYKKLSASAAPFNPSPAIARPAPIAMNMTHPSGPGTGPAIGHWPVNMNVHPGPVVNPMCSSPHHAYPSPPTTPNMIQPLPFMYPPYTQPQSVQTSNFPVTSNAFHANHFTWQCNLNPVIAKFGPGAVWPGCHPVEFPRPVPIVESIPDIISEAQVQCSTVESPTSASVLLEDINKVVDSSKEVKTSASEMSDDDTVRVGSESIKDNGNPNFPGTENAGNEPNQNTGLNGSTSNSEMNMDGEKTFSILIRGRRNRKQTLRMPISLLTRPHGSQSFKVNYNRVVRGSDSPRSINFSSSEHCTATA

SEQ ID NO: 11275 - protein, 1837 aa, Lotus japonicus
MAPRNTRGKAKGEKKKKEEKVLPVVIDVTVNLVDETQVVLKGISTDRTIDVRRLLTVNTETCHITNFSLSHEVRGPRLKDSVDVSALKPCFLTLVEEDYDEERAVAHVRRLLDIVACTTTFGPSSTPKNAATTAPKSKPPPANPSPKDATAAAAAAAADGDGEISHSCPKLDSFYEFFSLSNLTAPIQYVKKASKRHVEEIAEADHLLSLDVKLCNGKVVHVEACRKGFYSIGKQRILCHNLVDLLRQLSRAFDHAYDDLLKAFLERNKFGNLPYGFRANTWLVPPIAAHSQSVFPSLPVEDETWGGNGGGLGRDGKFDLIPWANKFSYIASMSCKTAEERQIRDRKAFLLHSLFVDVAIFRAIRAVKHVMEEHNFSCSAAENGIIYTEKVGDLSIRILKDGSVASCKIDTKIDGVEATGVNQKDLLERNLLKGITADENTAAHDITTLGVVNVRYCGYVVVVKVEDGGSENNNSPSDQNDELFDQPEGGANALNINSLRLLLHSTTQPENNKQMTQTQMFEELSGSNAFVEKLIKESLSKLEEEELGLDYFVRWELGACWIQHLQDQNSADKDKKPSLEKAKNEMKVEGLGKPLKALKNNKKKSDSSNTMLASEYSKPNQEVENAPLPSIESQPDTTAADNELLLKGILSAAAFIRLKESGAGLHCKASLLDLINLSRKYYLDVAIPKLVADFGSLELSPVDGRTLTDFMHTRGLRMQSLGHVVKLSEKLSHVQSLCIHEMIVRAFKHILRAVISAVVDKEKMATSIAGALNLLLGVPENRESDKSCELHPIVWRWLVLFLKKRFDWDLSRLNYKDVRKFAILRGLCHKVGIELAPRDFDMDSPFPFQKSDIVSLVPVHKQAACSSADGRQLLESSKTALDKGKLEDAVTYGTKALAKLVAVCGPYHRMTAGAYSLLAVVLYHTGDFNQATIYQQKALDINERELGLDHPDTMKSYGDLAVFYYRLQHTELALKYVKRALYLLHLTCGPSHPNTAATYINVAMMEEGLGNVHVALRYLHKALKCNQRLLGADHIQTAASYHAIAIALSLMEAYPLSVQHEQTTLQILRTKLGPDDLRTQDAAAWLEYFESKAFEQQEAARNGTRKPDASIASKGHLSVSDLLDYINPNHDSKGRDAAAKRRSQVTKVKASTYQNIGSASSDESSKEIQKEVSDEDVPIPDPGGSADSEPENNSAPDSEEHICEKISDEKPQMSGQILSEAPADGDDGWQPVQRPRSAGSYGRRLKQKRLGKVHNYQKNVETSAEYPLGRSDNQNSRYYFLKKRSMYHGGSADNHAFNITQGSKFGRKVVKAVTYRVKSMPSAPKTASDETLEIGDKQLSSHSELDSNDDHPIKTSVVSLGKSPSYKEVALAPPGTISKFQVYNPQSEIPECREHDVGKHKEEDVEAHKSINPTPKEVNDMSQEKCDDPLSDSVDDTQDDIVVAPEKKAESQLIEVVQENSGSAEVLESVDVDAQGTDDNSIVIDAVQNHLESYKQEPNATNSSGSFEPSDDTKSNSPGGDDSSSSPSHAGVIAYKKLSASAAPFNPSPAIARAAPIAMNITHLSGPGPVPAIGPWALNMPGPATLLPAGTPMCSSPHHAYPSPPTTPNMIQPLPFMYPPFTQPQSIPTNNFPVSNAFHANHFTWQCNLNPAISKFGPSAVWPGCHPMEFSHPVPIVEPIPDIISEPQVQYHAVESPRSASVLPEDIDNIGDSNKEIKALTSEASEDEVVRAGSESIKENGNPNFPGTENAENKPNLNIGSNGSSSSSETNMDGEKTFSILIRGKRNRKQTLRMPISLLTRPHGSQSFKVIYNRVVRGSDAPKSINFSSSKHCTATA

SEQ ID NO: 11276 - protein, 356 aa, Zea mays
MGVAGEKFQLGTVGALSLSVVSSVSIVICNKALMSSLGFNFATTLTSWHLLVTFCSLHVALCMKLFEHKPFDARTVMGFGVLNGISIGLLNLSLGFNSVGFYQMTKLAIIPCTVILETLFFRKKFSRNIKLSLSVLLLGVGVATVTDLQLNVMGSVLSLLAIITTCIAQIMTNTIQKKFKVSSTQLLYQSCPYQALTLFLVGPFLDGFLTNQNVFAFDYTTQVLFFIVLSCLISVSVNFSTFLVIGKTSPVTYQVLGHLKTCLVLTFGYVLLHDPFSWRNILGILIAVIGMVLYSYFCTRETQQKPAEASPQAVQAKEGESNPLISDSLSAAENGGSATDDEPLKVPMWSSKYSKA

SEQ ID NO: 11277 - protein, 354 aa, Zea mays
MGVGGEKFQLGTVGALSLSVVSSVSIVICNKALMSSLGFNFATTLTSWHLLVTFCSLHVALWMKFFEHKPFDSRTVMGFGVLNGISIGLLNLSLGFNSVGFYQMTKLAIIPCTVILETLFFRKKFSRSIQMSLSVLLLGVGVATVTDLQLNAVGSILSLLAIITTCIAQIMTNTIQKKFKVSSTQLLYQSCPYQSLTLFLIGPFLDGFLTNQNVFAFNYTSQVVFFIVLSCLISVSVNFSTFLVIGKTSPVTYQVLGHLKTCLVLTFGYVLLHDPFSWRNILGILIAVVGMVLYSYFCTVETQHKNTEVSPQQVKESEAAPLISDSLSKVENGGGVVDDEPLKVPMWSSKYSRE

SEQ ID NO: 11278 - protein, 169 aa, Arabidopsis lyrata
MSTVRKITLKSSDGENFEIDEAVALESQTIKHMIEDDCADNGIPLPNVTSKILSKVIEYCKKHVEAAAKSETTTEAAATTTTVASGSSDEDLKTWDSEFIKVDQGTLFDLILAANYLNIKGLLDLTCQTVADMIKGKTPEEIRKTFNIKNDFTPEEEEEVRRENQWAFE

SEQ ID NO: 11279 - protein, 159 aa, Linum usitatissimum
MSTARKITLKSSDGETFEVDEAVALESQTIKHMIEDDCADNGIPLPNVTSKILSKVIEYCKRHVEVAATKTEDRPTTADDDLKNWDAEFVKVDQATLFDLILAANYLNIKSLLDLTCQTVADMIKGKTPEEIRKTFNIKNDFTPEEEEEVRRENQWAFE

SEQ ID NO: 11280 - protein, 157 aa, Cleome gynandra
MSGRKITLKSSDGETFEVDEAVALESQTIKHMIEDDCADNGIPLPNVTSKILSKVIEYCKKHVDATAKSENAAASTDDDLKNWDAEFVKVDQATLFDLILAANYLNIKGLLDLTCQTVADMIKGKTPEEIRKTFNIKNDFTPEEEEEVRRENQWAFE

SEQ ID NO: 11281 - protein, 157 aa, Cleome spinosa
MSGRKITLKSSDGETFEVDEAVALESQTIKHMIEDDCADNGIPLPNVTSKILSKVIEYCKKHVDAAAKSEAAAAAEEDVMKNWDAEFVKVDQATLFDLILAANYLNIKGLLDLTCQTVADMIKGKTPEEIRKTFNIKNDFTPEEEEEVRRENQWAFE

SEQ ID NO: 11282 - protein, 158 aa, Cleome spinosa
MSGRKIALKSSDGETFEVDEAVALESQTIKHMIEDDCADNGIPLPNVTSKILSKVIEYCKKHVDASVKTETATTYSTDDDLKNWDAEFVKVDQATLFDLILAANYLNIKGLLDLTCQTVADMIKGKTPEEIRKTFNIKNDFTPEEEEEVRRENQWAFE

SEQ ID NO: 11283 - protein, 159 aa, Linum usitatissimum
MSTTRKITLKSSDGETFEVDEAVALESQTIKHMIEDDCADNGIPLPNVTSKILSKVIEYCKRHVEVAATKTEDRPTSADDDLKNWDAEFVKVDQATLFDLILAANYLNIKSLLDLTCQTVADMIKGKTPEEIRKTFNIKNDFTPEEEEEVRRENQWAFE

SEQ ID NO: 11284 - protein, 159 aa, Linum usitatissimum
MSTTRKITLKSSDGEAFEVDEAVALESQTIKHMIEDDCADNGIPLPNVTSKILSKVIEYCKRHVEVASTKTEDRPTSADDDLKNWDAEFVKVDQATLFDLILAANYLNIKSLLDLTCQTVADMIKGKTPEEIRKTFNIKNDFTPEEEEEVRRENQWAFE

SEQ ID NO: 11285 - protein, 161 aa, Carpinus betulus
MSSGRKITLKSSDGETFEVEEAVALESQTIKHMIEDDCADNGIPLPNVTSKILSKVIEYCKKHVEAPKAAAASEDRSTSSDDDLKAWDAEFVKVDQATLFDLILAANYLNIKSLLDLTCQTVADMIKGKTPEEIRKTFNIKNDFTPEEEEEVRRENQWAFE

SEQ ID NO: 11286 - protein, 158 aa, Unknown
  Sequence found in Organisms: Gossypium hirsutum, Gossypium raimondii
MASTGRKIILKSSDGENFEVDEAVALESQTIKHMIEDDCADNGIPLPNVTSKILSKVIEYCKKHVEASKSEDRSASLDDDLKAWDADFVKVDQATLFDLILAANYLNIKGLLDLTCQTVADMIKGKTPEEIRKTFNIKNDFTPEEEEEVRRENQWAFE

SEQ ID NO: 11287 - protein, 158 aa, Unknown
  Sequence found in Organisms: Gossypium hirsutum, Gossypium raimondii
MASTGRKIILKSSDGENFEVDEAVALESQTIKHMIEDDCADNGIPLPNVTSKILSKVIEYCKKHVEASKSEDRSASLDDDLKGWDADFVKVDQATLFDLILAANYLNIKGLLDLTCQTVADMIKGKTPEEIRKTFNIKNDFTPEEEEEVRRENQWAFE

SEQ ID NO: 11288 - protein, 156 aa, Euphorbia peplus
MSTGRKITLKSSDGETFEVDEAVALESQTIKHMIEDDCADNGIPLPNVTSKILSKVIEYCKKHVETPKSDDRPSADEELKTWDAEFVKVDQATLFDLILAANYLNIKTLLDLTCQTVADMIKGKTPEEIRKTFNIKNDFTPEEEEEVRRENQWAFE

SEQ ID NO: 11289 - protein, 158 aa, Citrus clementina
MSTSKKITLKSSDGEAFEVDEAVALESQTIKHMIEDDCADNGIPLPNVTSKILSKVIEYCKKHVEASKSDDRATSGVDDDLKAWDTDFVKVDQATLFDLILAANYLNIKSLLDLTCQTVADMIKGKTPEEIRKTFNIKNDFTPEEEEEVRRENQWAFE

SEQ ID NO: 11290 - protein, 157 aa, Carica papaya
MSTRKITLKSSDGETFEVDESVALESQTIKHMIEDDCADNGIPLPNVTSKILSKVIEYCKKHVESPKSDDRTTSTVDDELKAWDAEFVKVDQATLFDLILAANYLNIKSLLDLTCQTVADMIKGKTPEEIRKTFNIKNDFTPEEEEEVRRENQWAFE

SEQ ID NO: 11291 - protein, 157 aa, Manihot esculenta
MSTGRKITLKSSDGETFEMDEAVALESQTIKHMIEDDCADNGIPLPNVTSKILSKVIEYCKKHVETPKSEDRPSSVDDELKAWDAEFVKVDQATLFDLILAANYLNIKSLLDLTCQTVADMIKGKTPEEIRKTFNIKNDFTPEEEEEVRRENQWAFE

SEQ ID NO: 11292 - protein, 157 aa, Ricinus communis
MSTSRKITLKSSDGETFEVDEAVALESQTIKHMIEDDCADNGIPLPNVTSKILSKVIEYCKKHVETSKSDDRPSSVDDELKTWDAEFVKVDQATLFDLILAANYLNIKSLLDLTCQTVADMIKGKTPEEIRKTFNIKNDFTPEEEEEVRRENQWAFE

SEQ ID NO: 11293 - protein, 157 aa, Cucurbita pepo
MSSGRKITLKSSDGEIFEVDEAVALESQTIKHMIEDDCADSGIPLPNVNSKILSKVIEYCKKHVESPKPEDRAGSVEDDLKTWDSEFVKVDQATLFDLILAANYLNIKSLLDLTCQTVADMIKGKTPEEIRKTFNIKNDFTPEEEEEVRRENQWAFE

SEQ ID NO: 11294 - protein, 157 aa, Momordica charantia
MSSARKITLKSSDGEIFEVDEAVALESQTIKHMIEDDCADSGIPLPNVNSKILSKVIEYCKKHVESPKPEDRAASVDDDLKTWDTEFVKVDQATLFDLILAANYLNIKSLLDLTCQTVADMIKGKTPEEIRKTFNIKNDFTPEEEEEVRRENQWAFE

SEQ ID NO: 11295 - protein, 157 aa, Humulus lupulus
MSTGRKITLKSSDGETFEVDEAVALESQTIKHMIEDDCADNGIPLPNVTSKILSKVIEYCKKHVEAPKAEDRASSVDDELKAWDADFVKVDQATLFDLILAANYLNIKSLLDLTCQTVADMIKGKTPEEIRKTFNIKNDFTPEEEEEVRRENQWAFE

SEQ ID NO: 11296 - protein, 158 aa, Bruguiera gymnorhiza
MSAGRKITLRSSDGETFEVDEAVALESQTIKHMIEDDCADNGIPLPNVTSKILSKVIEYCKKHVEAPKSDDRSTPSADEELKSWDAEFVKVDQATLFDLILAANYLNIKSLLDLTCQTVADMIKGKTPEEIRKTFNIKNDFTPEEEEEVRRENQWAFE

SEQ ID NO: 11297 - protein, 157 aa, Jatropha curcas
MSTGRKITLKSADGETFEVDEAVALESQTIKHMIEDDCADNGIPLPNVTSKILSKVIEYCKKHVETPKSDDRPSSADEELKTWDADFVKVDQATLFDLILAANYLNIKSLLDLTCQTVADMIKGKTPEEIRKTFNIKNDFTPEEEEEVRRENQWAFE

SEQ ID NO: 11298 - protein, 157 aa, Cucumis melo
MSSGRKITLKSSDGEIFEVDEAVALESQTIKHMIEDDCADSGIPLPNVTSKILSKVIEYCKKHVESPKPEDRTGSVDDDLKTWDSEFVKVDQATLFDLILAANYLNIKSLLDLTCQTVADMIKGKTPEEIRKTFNIKNDFTPEEEEEVRRENQWAFE

SEQ ID NO: 11299 - protein, 157 aa, Camellia sinensis
MSSTRKIILKSSDGETFEVDEVVALESQTIKHMIEDDCADNGIPLPNVTSKILSKVIEYCKKHVETPKSEDRATGVEDELKTFDIEFVKVDQGTLFDLILAANYLNIKSLLDLTCQTVADMIKGKTPEEIRKTFNIQNDFTPEEEEEVRRENQWAFE

SEQ ID NO: 11300 - protein, 156 aa, Fagus grandifolia
MSSRKITLKSSDGETFEVEEVVALESQTIKHMIEDDCADNGIPLPNVTSKILSKVIEYCKKHVESPKAEDRVASVDEELKTWDAEFVKVDQATLFDLILAANYLNIKNLLDLTCQTVADMIKGKTPEEIRKTFNIKNDFTPEEEEEVRRENQWAFE

SEQ ID NO: 11301 - protein, 156 aa, Manihot esculenta
MSSKKIILKSSDGESFEVDEAVALESQTIKHMIEDDCADNGIPLPNVTSKILAKVIEYCKRHVETPKSDDRNNSVDDDLKTWDAEFVKVDQATLFDLILAANYLNIKGLLDLTCQTVADMIKGKTPEEIRKTFNIKNDFTPEEEEEVRRENQWAFE

SEQ ID NO: 11302 - protein, 156 aa, Unknown
  Sequence found in Organisms: Castanea mollissima, Quercus alba
MSSRKITLKSSDGETFEVEEAVALESQTIKHMIEDDCADNGIPLPNVTSKILSKVIEYCKKHVETPKAEDRVASADEELKNWDLEFVKVDQATLFDLILAANYLNIKSLLDLTCQTVADMIKGKTPEEIRKTFNIKNDFTPEEEEEVRRENQWAFE

SEQ ID NO: 11303 - protein, 157 aa, Euonymus alatus
MSTSRKITLKSSDGENFEVDEAVALESQTIKHMIEDDCADNGIPLPNVTSKILSKVIEYCKKHVDAAKVEERPATADDELKAWDAEFVKVDQATLFDLILAANYLNIKSLLDLNCQTVADMIKGKTPEEIRKTFNIKNDFTPEEEEEVRRENQWAFE

SEQ ID NO: 11304 - protein, 157 aa, Euonymus alatus
MSTSRKITLKSSDGENFEVDEAVALESQTIKHMIEDDCADNGIPLPNVTSKILSKVIEYSKKHVDAAKVEERPATADDDLKAWDAEFVKVDQATLFDLILAANYLNIKSLLDLTCQTVAEMIKGKTPEEIRKTFNIKNDFTPEEEEEVRRENQWAFE

SEQ ID NO: 11305 - protein, 159 aa, Linum usitatissimum
MSATRKIILKSSDGETFEVDEAVALESQTIKHMIEDDCADNGIPLPNVTSKILSKVIEYCKRHVEVAVTKTEDRPNSADDDLKNWDAEFVKVDQATLFDLILAANYLNIKSLLDLTCQTVADMIKGKTPEEIRKTFNIKNDFTPEEEEEVRRENQWAFE

SEQ ID NO: 11306 - protein, 159 aa, Fragaria vesca
MSSGRKITLKSSDGESFEVDEAVALESQTIKHMIEDDCADNGIPLPNVTSKILAKVIEYCKKHVDAAPKSDDRSSSSGDEELKNWDADFVKVDQATLFDLILAANYLNIKNLLDLTCQTVADMIKGKTPEEIRKTFNIKNDFTPEEEEEVRRENQWAFE

SEQ ID NO: 11307 - protein, 157 aa, Tripterygium wilfordii
MSTSRKITLKSSDGETFEVDEAVALESQTIKHMIEDDCADNGIPLPNVTSKILSKVIEYSKKHVDAAKAEERPATADDELKAWDAEFVKVDQATLFDLILAANYLNIKGLLDLTCQTVADMIKGKTPEEIRKTFNIKNDFTPEEEEEVRRENQWAFE

SEQ ID NO: 11308 - protein, 157 aa, Panax ginseng
MSSTKKITLKSSDGEVFEVDQAVALESQTIKHMIEDDCADNGIPLPNVTSKILSKVIEYCKKHVEAPTTEDRVPDSDDDLKAFDTEFVKVDQGTLFDLILAANYLNIKSLLDLTCQTVADMIKGKTPEEIRKTFNIKNDFTPEEEEEVRRENQWAFE

SEQ ID NO: 11309 - protein, 154 aa, Chelidonium majus
MSTKKVTLKSSDGETFDVDEAVALESQTIKHMIEDDCADNGIPLPNVTSKILAKVIEYCKKHVESPKGDDRSADEDLKTWDSEFVKVDQATLFDLILAANYLNIKSLLDLTCQTVADMIKGKTPEEIRKTFNIKNDFTPEEEEEVRRENQWAFE

SEQ ID NO: 11310 - protein, 157 aa, Unknown
  Sequence found in Organisms: Cucumis sativus, Cucurbita pepo, Citrullus lanatus
MSSGRKITLKSSDGEIFEVDEAVALESQTIKHMIEDDCADSGIPLPNVNSKILSKVIEYCKKHVESPKPEDRTGSVDDDLKTWDSEFVKVDQATLFDLILAANYLNIKSLLDLTCQTVADMIKGKTPEEIRKTFNIKNDFTPEEEEEVRRENQWAFE

SEQ ID NO: 11311 - protein, 157 aa, Euonymus alatus
MSTSRKITLKSSDGETFEVDEAVALESQTIKHMIEDDCADNGIPLPNVTSKILSKVIEYCKKHVDAAKVEERPANADDELKAWDAEFVKVDQATLFDLILAANYLNIKSLLDLTCQTVADMIKGKTPEEIRKTFNIKNDFTPDEEEEVRRENQWAFE

SEQ ID NO: 11312 - protein, 155 aa, Carpinus betulus
MSSSKKITLKSSDGEAFEVDEAVALESQTIKHMIEDDCADNGIPLPNVTSKILAKVIEYCKKHVEAANPEERTSDDDLKAWDAEFVKVDQATLFDLILAANYLNIKSLLDLTCQTVADMIKGKTPEEIRKTFNIKNDFTPEEEEEVRRENQWAFE

SEQ ID NO: 11313 - protein, 156 aa, Quercus alba
MSSRKITLKSSDGETFEVEEVVALESQTIKHMIEDDCADNGIPLPNVTSKILSKVIEYCKKHVETPKAEDRVASADEELKNWDLEFVKVDQATLFDLILAANYLNIKSLLDLTCQTVADMIKGKTPEEIRKTFNIKNDFTPEEEEEVRRENQWAFE

SEQ ID NO: 11314 - protein, 159 aa, Rosa hybrid cultivar
MSSGRKITLKSSDGESFEVDEAVALESQTIKHMIEDDCADNGIPLPNVTSKILAKVIEYCKKHVDAAPKSDDRSSSSGDDELKNWDADFVKVDQATLFDLILAANYLNIKNLLDLTCQTVADMIKGKTPEEIRKTFNIKNDFTPEEEEEVRRENQWAFE

SEQ ID NO: 11315 - protein, 157 aa, Tripterygium wilfordii
MSTSRKITLKSSDGETFEVDEAVALESQTIKHMIEDDCADNGIPLPNVTSKILSKVIEYSKKHVDAAKAEERPANADDELKAWDAEFVKVDQATLFDLILAANYLNIKSLLDLTCQTVADMIKGKTPEEIRKTFNIKNDFTPEEEEEVRRENQWAFE

SEQ ID NO: 11316 - protein, 357 aa, Cicer arietinum
MAYAFSKSHFFTFLVILTFLSFSLIKESEAQAKPPPIVKGLSWNFYDSSCPKLESIIRNELKKIFDDDIGQAAGLLRLHFHDCFVQGCDGSVLLDGSASGPSEKDAPPNLSLRASAFKIIEKLRGRVQKQCGRIVSCADITAIAARDAVFLSGGADYKVPLGRRDGLTFATRNVTLDNLPSPSSNTTTILNSLATKNLNPTDVVALSGGHTIGISHCSSFTNRLYPKQDPVMDKTYGNNLKLTCPTNNTDNTTVLDIRSPNKFDNKYYVDLMNRQGLFTSDQDLYTDKRTKDIVTNFAVNQSLFFEKFVAAMIKMGQLNVLTGTQGEIRANCSVRNKATKSFLGSVVEDVVEGFLEI

SEQ ID NO: 11317 - protein, 308 aa, Cicer arietinum
MIISHPFAPLPSCFTITCSKPFSHKNHFISSSSTSPHLVLTYSTTSTLLCSARSRRRTDFNVDITDEDQVVENDDYGGFSAQGMESKDIDIEDDDKRYSGGGLYKGVEEKDFDRNPEFAELIGDFLDDPEKAQSRMEDRLRKKRNKILHTKTGSGVQMKVSFNKFDFSNSYIWFEFHNAPLAKDVSLLCDTIRAWHILGRLGGCNAMNMQLSQSQMEKRPNYDYIQGANVTPTTFYNIGDLEVQDNLARIWVDIGTNEPLILDVLINALTQISSDFVGIKQVVFGGEEFENWKENLTSEDSGYGVHKI

SEQ ID NO: 11318 - protein, 233 aa, Cicer arietinum
MLKLSRALRSYSRHQLLEVVSSTKVEVAGFSTATNNYSAKGYNNNYNSSDRIFAPYSVYKGKAAFSLSPCLPTFTKLDSGALVVERRGSIMMSFMHAIGEHKYDWEKRQRFALSATEVGSLIAIGPQDSCEFFHDPSMKSSNAGQVRKNLSIKPHSNGYFVSLNVVNIVLNTKDSFSVPVTTAEFAVMKTACSFALPHIMGWDRLTNQQMQSNGTVGFQSKTNPQILDLEWDK

SEQ ID NO: 11319 - protein, 465 aa, Oryza sativa
MDKSQGVLLSSNVGAGSRPWPELLGSAHWDGLLDPLDLTLRRLILLCGDLCQVTYDSFNSDSHSKYCGTCRFSRSTLLDRTQFPAAGDLSVAAYLYATSDATAFPGSMVYSMSREAWSKESNWIGYVAVSNDAAAAASGQRVIYVAWRGTIRSLEWVDVLKPDLVDHDDILPEGHPGRGRSRVMKGWYLIYSSTDERSPFSKYSARDQMLAAVRELVARYRNESLSVVCTGHSLGASLATLCAFDIVVNGVSKVGDGAHIPVTAVVFGSPQIGNPEFKKQFEEQPNLRALHVRNTPDLIPLYPSGLLGYANVGKTLQVDSKKSPYVKRDTSPGDYHNLQGILHTVAGWNGKDGEFKLQVKRSVALVNKSSGFLKDSNLVPESWWVERNKGMVLGQNGEWQLEGPAEENLPVPPVVTGKIIDDDVAAVATSSSAKEDKKTGKGSKLLSGLIDQLLCVPDTCKAGAA

SEQ ID NO: 11320 - protein, 223 aa, Glycine max
MEKAESSASTSEPDSDDNHHRHPTNHHLNPPSGLTPLEFASLVPSVAEHHSYLVGPGQCSSLLAQRVHAPPDAVWSFVRRFDKPQTYKHFIKSCAVKEPFHMAVGVTRDVNVISGLPAATSTERLDFLDDVRRVTGFSIIGGEHRLRNYRSVTTVHSFDDDNASADGKIYTVVLESYVVDVPDGNTEEDTRLFADTVVKLNLQKLASVTEGTNGDGDGKPHSR

SEQ ID NO: 11321 - protein, 126 aa, Phaseolus vulgaris
MEKGESSATTSEPDSDDNHRIPTNHHLNPPFGLTPHEFGSLVPSITEHHIYLVGPGQCSSLLAQRVQAPPEVVWSVVRRFDKPQTYKHFIKSCAVKEPFHMAVGVTRDVNVISGLPPLLVQSGSTT

SEQ ID NO: 11322 - protein, 212 aa, Phaseolus vulgaris
MALSLCSGVRVPYCSPSCSWKPNGKNCEAPTKMSCTAVHSDKKNPLVGMGIGLVTAWVMGLTALDADATRIEYYATVGEPLCEYKYVKSGLGYCDIVEGFGVEAPIGELINVHYTARFGDGIVFDSSYKRGRSLTMRIGVGKVIKGLDQGILGGEGVPPMRIGGKRKLYVPPQLAYGPEPAGCFSGDCNIPANATLLYDVNFVELYSGNRSK

SEQ ID NO: 11323 - protein, 77 aa, Glycine max
MRIGVGKVIKGLDQGILGGEGVPPMRISGKCKLQIPLHLAYGPEPAVCFSGDCNIPGNATLLYDINFIEVYSGNRSK

SEQ ID NO: 11324 - protein, 213 aa, Medicago truncatula
MALSFSLCSGTTVHNRFPSCMKLNGKSYKVSDKVLCSARNGNEKKPLVGIGIGIVAAWVMGLTALDADATRIEYYATVGEPMCELNYVKSGLGYCDYVEGFGDEAPLGELIDIHYTARFADGIVFDSSYKRARPLTMRIGVGKVIRGLDQGILGGEGVPPMRIGGKRKLTIPPLLAYGPEPAGCFSGDCNIPGNATLLYDIKFVGLYSGNRSQ

SEQ ID NO: 11325 - protein, 309 aa, Glycine max
MKAWVYGEYGGVDVLKLDSNVTVPDVKEDQVLIKVVAAALNPVDAKRRQGKFKATDSPLPTVPGYDVAGVVVKVGSQVKDFKVGDEVYGDVNEKALEGPKQFGSLAEYTAVEEKLLASKPKNLDFAQAAALPLAIETAYEGLERTGFSPGKSILVLNGSGGVGSLVIQLAKQVFGASRVAATSSTRNLDLLKSLGADLAIDYTKENFEDLPEKFDVVYDAIGQCDRAVKAVKEGGSVVALTGAVTPPGFRFVVTSNGAVLRKLNPYLESGKVKPIVDPKGPFSFDKLAEAFSYLETNRATGKVVIHPIP

SEQ ID NO: 11326 - protein, 309 aa, Phaseolus vulgaris
MKAWVYGEYGGVDVLKLDSNVAVPDVKEDQVLVKVAAAALNPVDGKRRQGKFKATDSPLPTVPGYDVAGVVVKVGSEVKDFKVGDEVYGDLSEKALEGPKQFGSLAEYTAVEEKLLALKPKNLDFAQAAALPLAIETAHEGLERTAFSPGKSILVLNGSGGVGSLVIQLAKQVFGASRVAATSSTRNLDLLKSLGADLAIDYTKENFEDLSEKFDVVFDAIGQCDRAVKAVKEGGSVVALTGAVTPPGFRFVVTSNGAVLRKLNPYLESGKVKPIVDPKGPFPFDQLAEAFSYLETNRATGKVVIHPIP

SEQ ID NO: 11327 - protein, 309 aa, Cicer arietinum
MKAWVYGEYGGVDVLKFDSSIAVPDVKEDQVLVRVFAAALNPVDGKRRQGKFKATDSPLPTVPGYDVAGVVVKVGSEVKDFKVGDEVYGDVNEKALEGPKQFGSLAEYTAVEEKLLALKPKNLDFAQAASLPLAIETAYEGLERTGFSAGKSILVLNGSGGVGSLVIQLAKQVFGASRVAATASTRNLELLKSLGADLAIDYTKENFEDLPEKFDVVYDAIGQCDRAVKAIKEGGSVVALTGAVTPPGFRFVVTSNGAVLKKLNPYLESGKVKPIVDPKGPFPFDQVVEAFSYVETNRATGKVVIYPIP

SEQ ID NO: 11328 - protein, 309 aa, Arachis hypogaea
MKAWVYGEYGGVDVLKFDSSVGVPDVKEDQVLVKVVAAALNPVDAKRRQGKFKATDSPLPTVPGYDVAGVVVKVGSKVKDFKVGDEVYGDVNEKALEGPKQFGSLAEYTAVEERLLAPKPKNLNFAEAASLPLAIETAYEGLERLGFSPGKSILVLNGSGGVGTLVIQLAKKVFGASRVAATSSTRNLELLKSLGADLAIDYTKENFEDLPEKFDVVYDAIGQCEKAVKAVKEGGSVVALTGAVTPPGFRFVVTSNGAVLRKLNPYLESGQVKPVVDPKGPFSFAQLVEAFTYLETNRATGKVVISPIP

SEQ ID NO: 11329 - protein, 309 aa, Medicago truncatula
MKAWVYGEYGGVDVLKFDSNVAVPDVKEDQVLVKVVAAALNPVDGKRRQGKFKATDSPLPTVPGYDVAGVVVKVGSEVKDFKVGDEVYGDVNEKALEGPNQFGSLAEYTAVEEKLLALKPTNLDFAQAASLPLAIETAYEGLERTGFSSGKSILVLNGSGGVGSLVIQLAKQVFGASRVAATSSTRHLELLKSLGADLAIDYTKENFEDLPEKFDVVYDAIGQCDRAVKAIKEGGSVVALTGAVTPPGFRFVVTSNGAVLKKLNPYLESGKVKPIIDPKGPFPFDQVAEAFSYIETNKATGKVVVFPIP

SEQ ID NO: 11330 - protein, 122 aa, Arachis hypogaea
MKAWVYGEYGGVDVLKFDSSVGVPDVKEDQVLVKVVAAALNPVDAKRRQGKFKATDSPLPTVPGYDVAGVVVKVGSKVKDFKVGDEVYGDVNEKALEGPKQFGSLAEYTAVEERLLAPKPRT

SEQ ID NO: 11331 - protein, 503 aa, Glycine max
MATAAVIGLSGGKRLLSSSYHYSDIIEKLSYGSDFGSTHYQIVPTKSLIVAKKSSNYTPTFPASNQQNQSIKALKEHVDDAPTIADPWFQSYNSNDLEVESSEMGYSVEALLLLQKSMLEKQWNLSFEREVLTENSSKGKKCRKVAVTCSGVSARQRRMNTKRKTAIKTCGAMQLKSKISPELLQHRLKGYVKGLVSEELLSHAEVVNLSEKIKVGLSLEEHKSRLKEKLGCEPSDDQMATSLKISRTELRARMIECSLAREKLAMSNVRLVMSIAQKYDNLGAEMGDLVQGGLIGLLRGIEKFDSSKGFKISTYVYWWIRQGVSRALVENSRTLRLPAHLHERLSLIRNAKFRLEERGITPTIDRIAKYLNMSQKKVRNATEAISKIISLDREAFPSLNGLQGETHHSYIADNRVENIPWNGVDEWALKDEVNRLINVTLVEREREIIRLYYGLEKECLTWEDISKRIGLSRERVRQVGLVALEKLKHAARKRQMEAMLLKH

SEQ ID NO: 11332 - protein, 504 aa, Phaseolus vulgaris
MASAAVIGLSGGKRLLSSSYHYSDIIEKLSYGSDFGSTHYQIVSTKSVIVAKKSSNYTPTFPAPNRQNQSIKVLKEIVDDAATVADAWFQSLSSNDLEVESSEMGYSVEALLLLQKSMLEKQWSLSFEGEGVTEHSSKEKNCRKVAAVTCSGVSARQRRMNAKRKTAVKTGGAVQLKSKISPELLQNRLKGYVKGVVSEELLSHAQVVSLSEKIKVGLSLEEHKSRMKERLGCEPSDDEIATSLKISSTELREKMLECSLAREKLAMSNVRLVMSIAQRYENAGTEMGDLVQGGLIGLLRGIEKFDSSKGFKISTYVYWWIRQGVSKALIENSRTLRLPAHLHERLSLIRNAKLRLEERGITPTIDRIAQHLNMSQKKVRNATEAISKTISLDREAFPSLNGLRGDTHHSYIADNRVENIPWEGVDEWALKDEVNRLINVTLKEREREIIRLYYGLGKECLTWEDISKRMGLSRERVRQVGLVALEKLKHGARNRELEAMLLKH

SEQ ID NO: 11333 - protein, 511 aa, Arachis hypogaea
MATAAVIGLSGGKRILSSSYHYSDVTEKLSFGTDFGSTHYQIVPTKSVIIAKKPSNYTPTFAASNRQNQSIKALQEHVDAEAAGTSDPSWFQGFSSSDLELESSEMGYSVEALLLLQKSMLEKQWNLSFERDVLNEHSRMDKSRRKVAVTCSGVSARQRRMNTKRKASGKTSAMIEPCTAMQLRSAISPELLQYRLKGYVKGVVSEQLLSHAEVVNLSEKIKAGLSLEEHKSRMKDKLGCEPSDDQIAASLKISRAALRAKMIECSLAREKLAMSNVRLVLSIAQRYDNMGAEMDDLVQGGLIGLLRGIEKFDSSKGFKISTYVYWWIRQGVSRALVENSRTLRLPTHIHERLSLIRNAKFRLEEKGVTPTVERIAKCLNMSQKKVRNATEAMSKIFSLDREAFPSLNGLPGETHHSYIADTREENIPWNRVDEWALKDEVNKLLNVTLVEREREIIRLYYGLDRESLTWEDISKRIGLSRERVRQVGLVALEKLKHAARKGGMEAMLLKH

SEQ ID NO: 11334 - protein, 500 aa, Lupinus angustifolius
MATAAVIGLSGGKRLLSSSYHYSDITEKLFYGSDFGSTHYQIAPTKYVIISKKSSNYTPTFPTCNKEKEIQSIKALKEHVDAAPTIADQWFEGYDNSDVLEVEGSDMDNSMDALLLLQKSMLEKQWNLSFQRGVLRKKSKREKSRRKDTVTCSGVSARQRRMSTKRKTPGMQLRSIISPELLQNRLKGYVKGVLSEELLSHAEVVNLSQKIKVGLSLDEHKCRLKERLGCEPSDDQIATSLKISCAELRARMIECSLARERLTMSNVRLVMSIAQRYDNLGAEMADLVQGGLIGLLRGIEKFDSSKGFKISTYVYWWIRQGVSRALVENSRTLRLPTHLHERLSLIRNAKLRLEEKGITPTIERIAKSLNMSQKKVKNATEAINKVISLDREAFPSLNGLPGETHHSYIADSRHENIPWNGVDEWALKDEVNKLINVTLVEREREIIRFYYGLDKECLTWEDISKRIGLSRERVRQVGLVALEKLKHAARKREMEAMLLN

SEQ ID NO: 11335 - protein, 510 aa, Lupinus angustifolius
MATAAVIGLSGGKRLLSSSYHYSDITEKLFYGSDFGSVHYQTAQTKSVIIAKKTSNYTPSFPTCNNEKQIQSIKALKEHVVDAPIIADQWFEGYNNCNDLEVESSDIGYSVDALLLLQKSMLEKQWNLSFEKGVLSEKSRREKSRRKVTVTCSGVSARQRRMSTKRKTLGKTGSAMIQPCMQLRSIISPELLQNRLKGYVKGVVSEELLSHAEVVNLSEKIKVGLSLDEHKCRLKERLGCELSDDQIATSLKISCAELRAKMIECSFARERLTMSNVRLVMSIAQRYVNLGAEMADLVQGGLIGLLRGIEKFDSSKGFKISTYVYWWIRQGVSRALVENSRTLRLPTYLHERISLIRNAKFRLEEKGITPTIDRIAKSLNMSQKKVKNATQAINKVISLDREAFPSLNGLPGETHHSYIADSHVENIPWNGVDEWALKDEVNKLINVTLVEREREIIRLYYGLEKECLTWEDISKRIGLSRERVRQVGLVALEKLKHAARKKDMEAMLLN

SEQ ID NO: 11336 - protein, 504 aa, Medicago truncatula
MATAAVIGLSGGKRLLSSSYHYSDIIEKFSHACDFGSTQYQLPPSKSVIVAKKSSKYTPTFPPERKNQSIKALKEHVVDSAQADSEQWFQGYNSNDFEVESSDMDYSLDSLLLLQKSMLEKQWSLSFERKVLSENSRREKIRRKVSVTCSGVSARQRRMTTKRKVAAKSGSAVMQLRSTISPELIQNRLKGYVKGVVCDELLSHAEVVKLSEKIKAGLSLDEHKSRLKERLGSEPSDDQVATSLKISRADLRAKIIECSLAREKLTMSNVRLVLSIAQRYDNMGAEMGDLVQGGLIGLLRGIEKFDSSKGFKISTYVYWWIRQGVSRALVENSRTLRLPAHLHERLSLIRNAEYKLEERGITPTIDRIAKSLNMSQRKVRNATEATSKVFSLDREAFPSLNGLPGDTHHSFIADKQNENIPWNVVDEWALKEEVNRLINLTLVEREREIIRLYYGLDKECLTWEDISKRIGLSRERVRQVGLVALEKLKHAARKREMEAMLLKY

SEQ ID NO: 11337 - protein, 381 aa, Glycine max
MFISRSILFVFVFSACLLLFPANGIRSFATTNGYETEVEEVDPFVQFREAPEYRNQQKCTLIDTTNVQLVCDPSLVHVAMTIDWHYLRGSIAAVHSVVKHTSCPQNLFFHFIASDARLESKDVFERIVHTSFPSLGFKVYVFRESLVGNLISPSIREALDNPLNYARSYLADLLDQCIERVIYLDSDVVVVDDVQELWKVSLTGSRVIGAPEYCHTNFTRYFSYEFWSSAEFSEVFQGKRPCYFNTGVMVMDLVRWREGGYTRKIEKWMEIQKERRIYKLGSLPPFLLAFGGDVEAIEHRWNQHGLGGDNVRNSCRTLHPGPVSLLHWSGKGKPWTRLDAKMPCSVDFLWAPYDLYIPHHHTHHQHHHHQRIAIGSTHSSF

SEQ ID NO: 11338 - protein, 372 aa, Phaseolus vulgaris
MFLSRSFVLVFSACFLLCQAKGIRSFARENGYETEVEVASFVQFREAPEYRNQKKCSLLDTSNVAMASCDPSLVHIAMTIDWHYLRGSIAALHSVVKHTSCPQNLFFHFIASDARLESRDEFERIVHTSFPSLRFEVHVFEESLVGNLISPSIRQALDNPLNYARSYLADLLDPCIERVIYLDSDVIVVDDVQELWKVPLSGSRVIGAPEYCHANFTRYFSYEFWSSAEFSEVFQGKRPCYFNTGVMVVDLLRWREGDYTRKIEKWMEIQKERRIYMLGSLPPFLLVFGGDVEAIEHRWNQHGLGGDNLRNSCRTLHPGSVSLLHWSGKGKPWTRLDAKKPCSVDFLWAPYDLYIPPQQKRIAATGTINSSF

SEQ ID NO: 11339 - protein, 348 aa, Nicotiana benthamiana
MSVEERPSSSSSTSSTTSSCMVVDPLLKDLSEKKQNFRRNVVSLAAELKEVRNRLASQEQSFVRETLTRQVAESKAKKMEEEISKLQKNLEQKDGQLQVSSLNTEKYLKQLDDLRSQLSATQATADASAASAQSAQLQCLALLKELDDKNSSLKEHEVRVNKLGEQLDLLQKDLQARESSQMQLKDEVLRIEHDIMQALAKSGANKDCELMKILDEVSPKNIEKMNKLLTSKDEEIAKLRDEIRIMSAHWKLKTKELESQLEKHRRADQELKKRIMKLEFCLQEARTQTRKLQRMGERRDKAIKELRDQLAAKQVGTSINDKQNFWESSGFKIVVSMSMLVLVLFSKR

SEQ ID NO: 11340 - protein, 348 aa, Nicotiana benthamiana
MSVEERPSSSSSTSSTTSSCMVVDPLLKDLSEKKHNFRRNVVSLAAELKDVRNRLASQEQSFVRETLTRQVAESKAKKMEEEISKLHKNLEQKDGQLQVSSLNTEKYLKQLDDLRSQLSATQATADASAASAQSAQLQCLALLKELDEKNSSLKEHEARVNKLGEQLDLLQKDLQARESSQMQLKDEVLRIEHDIMQALAKSGANKDCELRKILDEVSPKNIEKMNKLLTSKDEEIAKLRDEIRIMSAHWKLKTKELESQLEKHRRADQELKKRIMKLEFCLQEARTQTRKLQRMGERRDKAIKELRDQLATKQVGTSSNDKQNLWESSGFKIVVSMSMLVLVLFSKR

SEQ ID NO: 11341 - protein, 495 aa, Nicotiana benthamiana
MEGAATAQAISRIGLAGLAVMGQNLALNIAEKGFPISVYNRTTSKVDETLDRAQREGQLPLTGQYNPRDFVLSIQRPRSVIILVKAGAPVDQTIAALAEHMEPGDTIIDGGNEWYENTERRIGEASSKGLLYLGMGVSGGEDGARNGPSLMPGGSHGAYINIKDILEKVAAQVEDGPCVTYIGEGGSGNFVKMVHNGIEYGDMQLISEAYDVLKNAGGLSNSELADIFAEWNRGELESFLVEITADIFNVKDEKTGSGELVDKILDKTGMKGTGKWTVQQAAELSIAAPTIAASLDSRYMSGLKEEREDAAGIFKKEGLKEEINFDVNGSSVDKKRLIDDVRQALYASKICSYAQGMNLLRAKSAEKGWNLNLGEMARIWKGGCIIRAVFLDRIKKAYQRNPGLANLMVDPEFAREMVQRQAAWRRVVGQAIQRGISVPGMSASLQYFDTYRRSRLPANLVQAQRDYFGAHTYERIDMPGAYHTEWSKLARKARV

SEQ ID NO: 11342 - protein, 495 aa, Nicotiana benthamiana
MEGAATAQALSRIGLAGLAVMGQNLALNIAEKGFPISVYNRTTSKVNETLDRAQREGQLPLTGQYNPRDFVLSIQRPRSIIILVKAGAPVDQTIAALAEHMESGDTIIDGGNEWYENTERRIGEASSKGLLYLGMGVSGGEDGARNGPSLMPGGSHGAYMNIKDILERVAAQVEDGPCVTYIGEGGSGNFVKMVHNGIEYGDMQLISEAYDVLKNAGGLSNPELADIFAEWNRGELESFLVEITADIFNVKDEKTGSGELVDKILDKTGMKGTGKWTVQQAAELSIAAPTIAASLDGRYMSGLKEEREDAARIFKKEGLKEEMNFDVNGASVDKKRLIDDVRQALYASKICSYAQGMNLLRAKSAEKGWNLNLGEMARIWKGGCIIRAVFLDRIKKAYQRNPGLANLMVDPEFAREMVQRQAAWRRVVGLAIQRGISVPGMSASLQYFDTYRRSRLPANLVQAQRDYFGAHTYERVDMPGAYHTEWSKLARKARV

SEQ ID NO: 11343 - protein, 488 aa, Mimulus guttatus
MESAALSQIGLAGLAVMGQNLALNIAEKGFPISVYNRTISKVDETLDRAHREGQLPLTGHYNPKDFVLSIKKPRSIIILVKAGAPVDQTIAALSAHMEPGDTIIDGGNEWYENTERRIVDASANGLLYLGMGVSGGEDGARNGPSLMPGGSHRAYLNIHGILDKVAAQVDDGPCVTYIGEGGSGNFVKMVHNGIEYGDMQLISEAYDVLKNVGGLSNDELAEIFEEWNRGELESFLIEITTDIFKVKDLETGNGHLVDKILDKTGMKGTGKWTVQQAAELSIAAPTIAASLDSRYMSGLKEEREAASEIFKNEGLKEEIENVGDVDKKRLIDDVRQALYASKICSYAQGMNLLRAKSMEKGWGLNLGELARIWKGGCIIRAVFLDRIKQAYQRNPGLANLLVDPEFAREMVQRQSAWRRVVGVAIQKGVSVPGMSASLQYFDTYRRGRLPANLVQAQRDYFGAHTYERIDLPGAYHTEWSKLARNAKL

SEQ ID NO: 11344 - protein, 487 aa, Echinacea purpurea
MEAATLSRIGLAGLAVMGQNLALNIAEKGFPISVYNRTTSKVDETLDRAHTEGQLPLTGYYTPRDFVLSIQKPRSVIILVKAGAPVDQTIAALAAHMEPGDTIIDGGNEWYENTERRIVEASDKGLLYLGMGVSGGEEGARNGPSLMPGGSYEAYNNIKDIVAKVAAQVEDGPCVTYIGEGGSGNFVKMVHNGIEYGDMQLISEAYDVLKNVGGLSNSELAEIFQEWNTGELESFLIEITADIFKVKDEHGEGELVDKILDKTGMKGTGKWTVQQAAELSVAAPTIAASLDCRYLSGLKDEREAAAKVLSDAGLKDEVGSVRSGIDKKRLIDDVRQALYASKICSYAQGMNLLRAKSVEKNWNLNFGELARIWKGGCIIRAVFLDRIKKAYQRNPNLASLVVDPEFAKEMVQRQAAWRRVVGLAISAGISTPGMCASLAYFDTYRRARLPANLVQAQRDLFGAHTYERVDRTGAFHTEWTKLARKKA

SEQ ID NO: 11345 - protein, 504 aa, Triphysaria pusilla
MESAALSQIGLAGLAVMGQNLALNIAEKGFPISVYNRTISKVDETLDRAHREGQLPLSGHYNPKDFVLSIKKPRSIIILVKAGAPVDQTIAALSAHMDPGDTIIDGGNEWYENTERRMVEASASGLLYLGMGVSGGEDGARYGPSLMPGGSHRAYLNIHGILEKVAAQVDDGPCVAYIGEGGAGNFVKMIHNGIEYGDMQLISEAYDVLKNAGGLGNDELADIFEEWNRGELESFLIEITSDIFRVRDEETGDGHLVDKILDKTGMKGTGKWTVQQAAELSIAAPTIAASLDSRYMSGLKDEREAAAEIFKNEGLKEEINNVGPVDKKRLIEDVRQALYASKICSYAQGMNLLRAKSMEKGWGLNLGELARIWKGGCIIRAVFLDRIKQAYQRNPGLANLLVDPEFAREMVQRQGAWRRVVGLAVQKGISVPGMSASLQYFDTYRRGRLPANLVQARGITSVPTPMRGLIVQERIIRSGPNLLKRLDCSGLRFGLVWFNWYLFS

SEQ ID NO: 11346 - protein, 487 aa, Arabidopsis lyrata
MESAALSRIGLAGLAVMGQNLALNIAEKGFPISVYNRTTSKVDETLDRASDEGNLPVAGQYSPRDFVLSIQRPRSVIILVKAGAPVDQTISALSEYMEPGDCIIDGGNEWYQNTERRIVEAEKKGLLYLGMGVSGGEEGARNGPSLMPGGSFTAYNNVKDILEKVAAQVEDGPCVTYIGEGGSGNFVKMVHNGIEYGDMQLISEAYDVLKNVGGLSNDELAEIFTEWNRGELESFLVEITSDIFRVKDDYGDGELVDKILDKTGMKGTGKWTVQQAAELSVAAPTIAASLDCRYLSGLKDERENAARVLEDAGLKEDIGSASRGVDKKRLIDDVRQALYASKICSYAQGMNLLRAKSLEKGWDLNLGEMARIWKGGCIIRAVFLDRIKKAYQRNPNLASLVVDPDFAKEMVQRQAAWRRVVGLAISAGISTPGMCASLAYFDTYRRARLPANLVQAQRDLFGAHTYERTDRPGAYHTEWTKLARKSQ

SEQ ID NO: 11347 - protein, 487 aa, Arabidopsis lyrata
MESAALSRIGLAGLAVMGQNLALNIAEKGFPISVYNRTTSKVDETLDRAAVEGNLPVSGQYSPRDFVLSIQRPRSLIILVKAGAPVDQTIDAFSEYMEPGDCIIDGGNEWYQNTERRISEAEQKGLLYLGMGVSGGEEGARNGPSLMPGGSFQAYDNIKDILGKVAAQVEDGPCVTYIGEGGSGNFVKMVHNGIEYGDMQLISEAYDVLKNVGGFSNEELAEIFTEWNRGELESFLVEITSDIFRVKDEFGDGELVDKILDKTGMKGTGKWTVQQAAELSVAAPTIAASLDCRYLSGLKDERENAAKVLREAGLKEEIGSASSGIDKKRLVDDVRQALYASKICSYAQGMNLLRAKSLEKGWNLNFGELARIWKGGCIIRAVFLDRIKKAYQRNPDLASLVVDPEFAKEMVQRQAAWRRVVGLAVSAGISTPGMCASLAYFDTYRRARLPANLVQAQRDLFGAHTYERTDRPGAYHTEWTKLARKNN

SEQ ID NO: 11348 - protein, 487 aa, Arabidopsis thaliana
MESAALSRIGLAGLAVMGQNLALNIAEKGFPISVYNRTTSKVDETLDRAAVEGNLPVSGQYSPRDFVLSIQRPRSLIILVKAGAPVDQTIDAFSEYMEPGDCIIDGGNEWYQNTERRISEAEQKGLLYLGMGVSGGEEGARNGPSLMPGGSFQAYDNIKDILEKVAAQVEDGPCVTYIGEGGSGNFVKMVHNGIEYGDMQLISEAYDVLKNVGGLSNEELAEIFTEWNSGELESFLVEITSDIFRVKDEFGDGELVDKILDKTGMKGTGKWTVQQAAELSVAAPTIAASLDCRYLSGLKDERENAAKVLREAGLKEEIGSASSGIDKKRLVDDVRQALYASKICSYAQGMNLLRAKSLEKSWNLNFGELARIWKGGCIIRAVFLDRIKKAYQRNPDLASLVVDPEFAKEMVQRQAAWRRVVGLAVSAGISTPGMCASLAYFDTYRRARLPANLVQAQRDLFGAHTYERTDRPGAYHTEWTKLARKNH

SEQ ID NO: 11349 - protein, 487 aa, Eutrema halophilum
MESAALSRIGLAGLAVMGQNLALNIAEKGFPISVYNRTTSKVDETLDRASVEGNLPVSGQYSPRDFVLSIQRPRSLIILVKAGAPVDHTIAAFSEYMEPGDCIIDGGNEWYLNTERRISEAEQKGLLYIGMGVSGGEEGARNGPSLMPGGSFQAYDNIKDILEKVAAQVEDGPCVTYIGEGGSGNFVKMVHNGIEYGDMQLISEAYDVLKNVGGLSNEELAEIFTEWNRGELESFLVEITSDIFRVKDEFGDGELVDKILDKTGMKGTGKWTVQQAAELSVAAPTIAASLDCRYLSGLKDERENAAKVLREAGLKEEIGSASSGIDKKRLVDDVRQALYASKICSYAQGMNLLRAKSSEKGWNLNFGELARIWKGGCIIRAVFLDRIKKAYQRNPDLASLVVDPDFAKEMVQRQAAWRRVVGLAVSAGISTPGMCASLAYFDTYRRARLPANLVQAQRDLFGAHTYERIDRPGAYHTEWSKLAKKST

SEQ ID NO: 11350 - protein, 497 aa, Arachis hypogaea
MEASAALSRIGLAGLAVMGQNLALNIAEKGFPISVYNRTTSKVDETVDRARQEGSLPLTGQYNPRDFVLSLQRPRSVIILVKAGAPVDQTIAALSDHMEPGDTIIDGGNEWYENTERRIHQASEKGLLYLGMGVSGGEEGARNGPSLMPGGSLQAYNNIQDILSKVAAQVEDGPCVTYIGEGGSGNFVKMVHNGIEYGDMQLISEAYDVLKHVGGLNNSELADIFAEWNRGELESFLIEITADIFKVKDEEGGDGFLVDKILDKTGMKGTGKWTVQQAAELSIAAPTIAASLDSRYLSGLKEERENAASVLKEAGMSDDIASAARVGVDKKRLIDDVRQALYASKICSYAQGMNLLRAKSNEKGWNLNLGELARIWKGGCIIRAVFLDRIKKAYQRNPNLASLIVDPEFAREMVQRQAAWRRVVGLAISAGISTPGMCASLAYFDTYRRARLPANLVQAQRDLFGAHTYERVDRPGAFHTEWTKLARKSGSGVGALN

SEQ ID NO: 11351 - protein, 487 aa, Arabidopsis thaliana
MESVALSRIGLAGLAVMGQNLALNIADKGFPISVYNRTTSKVDETLDRASNEGKLPVAGQYSPRDFVLSIQRPRSVIILVKAGAPVDQTISALSEYMEPGDCIIDGGNEWYQNTERRIVEAEKKGLLYLGMGVSGGEEGARNGPSLMPGGSFTAYNNVKDILEKVAAQVEDGPCVTYIGEGGSGNFVKMVHNGIEYGDMQLISEAYDVLKNVGGLSNDELAEIFTEWNRGELESFLVEITSDIFRVKDDYGDGELVDKILDKTGMKGTGKWTVQQAAELSVAAPTIAASLDCRYLSGLKDERENAAKVLEEAGLKEDIGSASRGVDKKRLIDDVRQALYASKICSYAQGMNLLRAKSLEKGWDLNLGEMARIWKGGCIIRAVFLDRIKKAYQRNPNLASLVVDPDFAKEMVQRQAAWRRVVGLAISAGISTPGMCASLAYFDTYRRARLPANLVQAQRDLFGAHTYERTDRPGAYHTEWTKLARKSQ

SEQ ID NO: 11352 - protein, 411 aa, Panax ginseng
MEASQVLSRIGLAGLAVMGQNLALNIADKGFPISVYNRTTSKVDETLDRAHNEGQLPLTGHYTPRDFVLSIQKPRSVIILVKAGAPVDQTIAALSAHMEPGDTIIDGGNEWYENTERRISEASSNGLLYLGMGVSGGEEGARNGPSLMPGGSYQAYENIKDIVEKVAAQVEDGPCVTYIGEGGSGNFVKMVHNGIEYGDMQLISEAYDVLKNVGGLSNAELAEIFDEWNRGELESFLIEITADIFKVKDPLGEGELVDKVLDKTGMKGTGKWTVQQAAELSVPVPTIAASLDCRFLSGLKDEREAASEVYKEVGVVRSGVDKKRLIDDVRQALYASKICSYAQGMNLLRAKSVEKGWNLNFGELARIWKGGCIIRAVFLDRIKKAYQWNPNLASLLVDPEFAREMVQREKA

SEQ ID NO: 11353 - protein, 495 aa, Theobroma cacao
MEASPALSRIGLAGLAVMGQNLALNVAEKGFPISVYNRTTSKVDETVQRAQEEGQLPLFGQYSPREFVLSIQRPRSVVILVKAGSPVDQTIAALSDHMEPGDCIIDGGNEWYENTERRIQEVSNKGLLYLGMGVSGGEEGARNGPSLMPGGSHQAYSNIKDILEKVAAQVEDGPCVTYIGEGGSGNFVKMVHNGIEYGDMQLISEAYDVLKHVGGLTNDELAEIFSEWNRGELESFLIEITSDIFRVKDELEDGYLVDKILDKTGMKGTGKWTVQQAAELSVAAPTIAASLDCRYLSGLKEERENAAGVLKEAGLKEEVGSLAQGIDKKRLIDDVRQALYASKICSYAQGMNLLRAKSVEKGWNLNLGELARIWKGGCIIRAVFLDRIKKAYQRNPNLASLVVDPEFAREMVQRQAAWRRVVGLAISAGISTPGMCASLAYFDTYRRARLPANLVQAQRDLFGAHTYERTDRPGAFHTEWTKLARKSTAGVGALN

SEQ ID NO: 11354 - protein, 489 aa, Panax ginseng
MEASTALSRIGLAGLAVMGQNLALNIAEKGFPISVYNRTISKVDETLDRAQNEGQLPLTGHHTPRDFVLSLRKPRSVIILVKAGAPVDETIAALSAHMEPGDTIIDGGNEWYENTERRISEASSNGLLYLGMGVSGGEEGARNGPSLMPGGSYQAYNNIKDIVEKVAAQVEDGPCVTYIGEGGSGNFVKMVHNGIEYGDMQLISEAYDVLKNVGGLSNAELAEIFDEWNRGELESFLIEITADIFKVKDSLGEGELVDKVLDKTGMKGTGKWTVQQAAELSVPVPTIAASLDCRFLSGLKDEREAASEVYEKVGVVKSGVDKKRLIDDVRQALYASKICSYAQGMNLLRAKSVEKGWNLNFGELARIWKGGCIIRAVFLDRIKKAYQRNPDLASLLVDTEFAREMVQREKAWRRVVGLAISAGVSIPGMCASLSYFDTYRRARLPANLVQAQRDLFGAHTYERVDRPGSFHAEWTKLARKSNTRVAALN

SEQ ID NO: 11355 - protein, 489 aa, Panax ginseng
MEASQALSRIGLAGLAVMGQNLALNIADKGFPISVYNRTTSKVDETLDRAHNEGQLPLTGHYTPRDFVLSIQKPRSVIILVKAGAPVDQTIAALSAHMEPGDTIIDGGNEWYENTERRISEASSNGLLYLGMGVSGGEEGARNGPSLMPGGSYQAYENIKDIVEKVAAQVEDGPCVTYIGEGGSGNFVKMVHNGIEYGDMQLISEAYDVLKNVGGLSNAELAEIFDEWNRGELESFLIEITADIFKVKDPLGEGELVDKVLDKTGMKGTGKWTVQQAAELSVPVPTIAASLDCRFLSGLKDEREAASEVYKEVGVVRSGVDKKRLIDDVRQALYASKICSYAQGMNLLRAKSVEKGWNLNFGELARIWKGGCIIRAVFLDRIKKAYQRNQNLASLLVDPEFAREMVQREKAWRRVVGLAISAGVSIPGMCASLSYFDTYRRARLPANLVQAQRDLFGAHTYERVDRPGAFHTEWTKLSRKSANGVAALK

SEQ ID NO: 11356 - protein, 495 aa, Glycine max
MESAALSRIGLAGLAVMGQNLALNIAEKGFPISVYNRTASKVDETVDRARNEGSLPLTGQYTPRDFVLSLQRPRSVIILVKAGAPVDQTIAALSDHLDPGDCIIDGGNEWYENTERRMSLVADKGLLYLGMGVSGGEDGARHGPSLMPGGSHQAYSNVQDILHKIAAQVEDGPCVTYIGEGGSGNFVKMVHNGIEYGDMQLISEAYDVLKHVGGLSNSELADIFAEWNRGELESFLIEITADIFKVKDEDGEGFLVDKILDKTGMKGTGKWTVQQAAELSIAAPTIAASLDCRYLSGLKEERESAAAVLKEAGLSDELGRVSVSGVDKKRLIDDVRQALYASKICSYAQGMNLLRAKSNEKGWNLNLGELARIWKGGCIIRAVFLDRIKKAYQRNPNLASLIVDPEFAREMVQRQAAWRRVVGLAVSAGISTPGMCASLAYFDTYRRARLPANLVQAQRDLFGAHTYERVDRPGAFHTEWTKLARKSGTGVGALN

SEQ ID NO: 11357 - protein, 494 aa, Vitis vinifera
MEASTLSRIGLAGLAVMGQNLALNIAEKGFPISVYNRTTSKVDETLDRAHREGHLPLSGHYSPRDFVLSIQRPRSIVILVKAGAPVDQTIAALSEHMEAGDCIIDGGNEWYENTERRIVEASGKGILYLGMGVSGGEEGARHGPSLMPGGSYQAYQNIEDIVKKVAAQVDDGPCVTYIGEGGSGNFVKMVHNGIEYGDMQLISEAYDVLKNVGGLSNSELSDIFGEWNRGELESFLIEITADIFKVKDEHGDGELVDKILDKTGMKGTGKWTVQQAAELSVAAPTIAASLDCRYLSGLKEEREAAAGVLSEAGLKDEVGFARSGVDKKRLIDDVRQALYASKICSYAQGMNLLRAKSVEKGWNLNFGELARIWKGGCIIRAVFLDRIKKAYQRNPNLASLIVDPEFAREMVQRQAAWRRVVGLAISAGISTPGMCASLAYFDTYRRARLPANLVQAQRDLFGAHTYERIDRPGSFHTEWTKLARKSDAGFATLK

SEQ ID NO: 11358 - protein, 495 aa, Glycine max
MESAALSRIGLAGLAVMGQNLALNIAEKGFPISVYNRTASKVDQTVDRARNEGSLPLTGQYTPRDFVLSLQRPRSVIILVKAGSPVDHTIAALSDHLDPGDCIIDGGNEWYENTERRMNLVADKGLLYLGMGVSGGEDGARHGPSLMPGGSHHAYSNVQDILHKIAAQVEDGPCVTYIGEGGSGNFVKMVHNGIEYGDMQLISEAYDVLKHVGGLSNSELAEIFVEWNRGELESFLIEITADIFKVKDEDGEGFLVDKILDKTGMKGTGKWTVQQAAELSIAAPTIAASLDCRYLSGLKEERESAAAVLKEAGLSDELGRVNVSGVDKKRLIDDVRQALYASKICSYAQGMNLLRAKSNEKGWNLNLGELARIWKGGCIIRAVFLDRIKKAYQRNPNLASLIVDPEFAREMVQRQAAWRRVVGLAVSAGISTPGMCASLAYFDTYRRARLPANLVQAQRDLFGAHTYERVDRPGAFHTEWTKLARNSGAGVGALN

SEQ ID NO: 11359 - protein, 495 aa, Medicago truncatula
MDASTLSRIGLAGLAVMGQNLALNIAEKGFPISVYNRTTSKVDETVDRAHREGSLPLTGQYSPREFVLSLQRPRSVIILVKAGAPVDQTISALSDHMEPGDCIIDGGNEWYENTERRIQQISEKGILYLGMGVSGGEEGARNGPSLMPGGSYQAYSNIQDILTKVAAQVEDGPCVTYIGEGGSGNFVKMVHNGIEYGDMQLISEAYDVLKHVGGLSNSELADIFAEWNSGELESFLIEITADIFKVKDEGGDGYLVDKILDKTGMKGTGKWTVQQAAELSVAAPTIAASLDCRYLSGLKEERENAAAVLKEAGLGEEVGGFVRSGVDKKRLIDDVRQALYASKICSYAQGMNLLRAKSDEKGWNLNFGELARIWKGGCIIRAVFLDRIKKAYQRNPNLASLIVDPEFAKEMVQRQGAWRRVVGLAISAGISTPGMCASLAYFDTYRRARLPANLVQAQRDLFGAHTYERLDRPGAFHTEWTKLARQSGTGAAALN

SEQ ID NO: 11360 - protein, 471 aa, Eutrema halophilum
LGQNLALNIAEKGFPISVYNRTTSKVDETLDRASVEGNLPVSGQYSPRDFVLSIQRPRSLIILVKAGAPVDQTIAAFSEYMEPGDCIIDGGNEWYLNTERRISEAEQKGLLYLGMGVSGGEEGARNGPSLMPGGSFQAYDNIKDILEKVAAQVEDGPCVTYIGEGGSGNFVKMVHNGIEYGDMQLISEAYDVLKNVGGLSNEELAEIFTEWNQGELESFLVEITSDIFRVKDEFGDGELVDKILDKTGMKGTGKWTVQQAAELSVAAPTIAASLDCRYLSGLKDERENAAKVLREAGLKEEIGSASSGIDKKRLVDDVRQALYASKICSYAQGMNLLRAKSSEKGWNLNFGELARIWKGGCIIRAVFLDRIKKAYQRNPDLASLVVDPDFAKEMVQRQAAWRRVVGLAVAAGISTPGMCASLAYFDTYRRARLPANLVQAQRDLFGAHTYERIDRPGAYHTEWSKLAKKST

SEQ ID NO: 11361 - protein, 495 aa, Prunus mume
MEASPALSRIGLAGLAVMGQNLALNIAEKGFPISVYNRTTSKVDETVDRAHNEGNLPLFGQYNPRDFVLSIQRPRSVIILVKAGAPVDQTIAALSAHMEPGDAIIDGGNEWYENTERRIAEATGRGLLYLGMGVSGGEEGARHGPSLMPGGSHQAYTNVQDILHKVAAQVEDGPCVTYIGEGGSGNFVKMVHNGIEYGDMQLISEAYDVLKNVGGLSNEELGEIFAEWNKGELESFLIEITADIFKVRDDLADGFLVDSLLDKTGMKGTGKWTVQQAAELSVAAPTIAASLDCRYLSGLKEEREKAEEALKQAGFKEEIGSVTSGIDKKRLIDDVRQALYASKICSYAQGMNLLRAKSVEKGWGLNLGELARIWKGGCIIRAVFLDRIKNAYQRNQSLPNLIVDPDFAKEMVQRQAAWRRVVGLAVAAGISTPGMCASLSYFDTYRRGRLPANLVQAQRDLFGAHTYERVDRPGAFHTEWTKLAQKSGSSVGALN

SEQ ID NO: 11362 - protein, 494 aa, Populus trichocarpa
MDASTLSRIGLAGLAVMGQNLALNIAEKGFPISVYNRTTSKVDETLHRAQSEGPFPLTGQYSPRDFVLSIQRPRSIIILVKAGNPVDQTISALTEFMEPGDTIIDGGNEWYQNTERRIQEVGDKGILYLGMGVSGGEEGARHGPSLMPGGSLEAYNNIESVLKSVAAQVDDGPCVTYIGEGGSGNFVKMVHNGIEYGDMQLISEAYDVLKNVGGLSNGELAEIFGEWNRGELESFLIEITSDIFKVKDDLADGDLVDKILDKTGMKGTGKWTVQQAAELSVAAPTIAASLDCRYLSGLKEERESAAEILEKAGLKEEMGSVKSEIDKKRLIDDVRQALYASKICSYAQGMNLLRSKSVEKGWDLNLGELARIWKGGCIIRAVFLDRIKKAYQRNPSLASLIVDPEFAREMVQRQAAWRRVVGLAISAGISTPGMCASLAYFDTYRRARLPANLVQAQRDLFGAHTYERTDRPGAFHTEWTKLARKSNAGFGAFN

SEQ ID NO: 11363 - protein, 494 aa, Cicer arietinum
MDSSTLSRIGLAGLAVMGQNLALNIAEKGFPISVYNRTTSKVDETVDRAHREGSLPLTGQYSPREFVLSLQRPRSVIILVKAGNPVDQTIAALSDHMEPGDCIIDGGNEWYENTERRIQQISNKGILYLGMGVSGGEEGARNGPSLMPGGSYQAYSNIQDILMKVAAQVEDGPCVTYIGEGGAGNFVKMVHNGIEYGDMQLISEAYDVLKHVGGLSNSELADIFAEWNSGELESFLVEITADIFKVKDDIGDGYLVDKILDKTGMKGTGKWTVQQAAELSVAAPTIAASLDCRYLSGLKEERENASAVLKEAGLNEEAGFVKSGIDKKRLIDDVRQALYASKICSYAQGMNLLRAKSDEKGWNLNLGELARIWKGGCIIRAVFLDRIKKAYQRNPNLASLIVDPEFAKEMVQRQGAWRRVVGLAISAGISTPGMCASLAYFDTYRRARLPANLVQAQRDLFGAHTYERLDRPGAFHTEWTKIARQSGTGVAALN

SEQ ID NO: 11364 - protein, 218 aa, Panax ginseng
MDGPAGCGVVSACATIAASLDCRFLSGLKDEREAASEVYKEVGVVRSGVDKKRLIDDVRQALYASKICSYAQGMNLLRAKSVEKGWNLNFGELARIWKGGCIIRAVFLDRIKKAYQRNQNLASLLVDPEFAREMVQREKAWRRVVGLAISAGVSIPGMCASLSYFDTYRRARLPANLVQAQRDLFGAHTYERVDRPGAFHTEWTKLAQKSANGVAALK

SEQ ID NO: 11365 - protein, 497 aa, Lupinus angustifolius
MESAAALSRIGLAGLAVMGQNLALNIADKGFPISVYNRTTSKVDETVDRAHREGTLPLTGHYNPRDFVLSLTRPRSVIILVKAGAPVDQTIAALSDYMEPGDAIIDGGNEWYENTERRIQQVNEKGILYLGMGVSGGEDGARNGPSLMPGGSYQAYSNVQDILHKIAAQVNDGPCVTYIGEGGAGNFVKMVHNGIEYGDMQLISEAYDVLKHVGGLSNSELADIFDEWNRGELESFLVEITADIFKVNDYESGYGYLVDKILDKTGMKGTGKWTVQQAAELSVAAPTIAASLDCRYLSGLKEERENAASVLKEAGLNQEVGALSSGVDKKRLIDDVRQALYASKICSYAQGMNLLRAKSVEKGWDLNFGELARIWKGGCIIRAVFLDRIKKAYQRNPNLASLIVDPEFAREMVQRQGAWRRVVGLAISAGISTPGMCASLAYFDTYRRARLPANLVQAQRDLFGAHTYERVDCPGAFHTEWTKLARQSGTTGAGSLN

SEQ ID NO: 11366 - protein, 298 aa, Chenopodium quinoa
MAAASQIGLAGLAVMGQNLALNIAEKGFPISVYNRTSTKVDETIDRAKSEGDLPLFGHYTPRDFVLSIERPRSIIILVKAGSPVDQTIQSLSSFMEPGDTIIDGGNEWYQNTERRLSDAHSNGLLYLGMGVSGGEDGARFGPSLMPGGDYAAYENVEKILKKVAAQVDDGPCVTYIGEGGSGNFVKMVHNGIEYGDMQLISEAYDVLKNVGGLSNDELAGIFDEWNNSELESFLVEITADIFKVKDDLAEGGLVDKILDKTGMKGTGKWTVQQAAELSVAAPTIAASLDCRLPKWAEG

SEQ ID NO: 11367 - protein, 492 aa, Populus trichocarpa
MDASTLSRIGLAGLAVMGQNLALNIAEKGFPISVYNRTTSKVDETLIRAQSEGPFSLTGHYSPRDFVLSIQRPRSIIILVKAGNPVDQTISALTEFMEPGDTIIDGGNEWYQNTERRIQQVADKGILYLGMGVSGGEEGARHGPSLMPGGSFEAYKNIESVLKSVAAQVDDGPCVTYIGEGGSGNFVKMVHNGIEYGDMQLISEAYDVLKNVGGLSNSELAEIFGEWNRGELESFLIEITSDIFKVKDNLVDGDLVDKILDKTGMKGTGKWTVQQAAELSVAAPTIAASLDCRYLSGLKEERESAAEILKEAGLEEEVGSVKSGVDKKRLIDDVRKALYASKICSYAQGMNLLRAKSVEKGWDLDFGELARIWKGGCIIRAVFLDRIKKAYQRNPNLASLVVDPEFAREMVQRQAAWRRVVGLAISAGISTPGMCASLAYFDTYRRARLPANLVQAQRDLFGAHTYERTDRPGAFHTEWTKLARKSSAGAFS

SEQ ID NO: 11368 - protein, 237 aa, Phaseolus vulgaris
MESAALSRIGLAGLAVMGQNLALNIAEKGFPISVYNRTASKVDETVDRARNEGFLPLTGQYNPREFVLSIQRPRSVIILVKAGAPVDQTIAALSDHLEPGDCIIDGGNEWYENTERRISQVADKGLLYLGMGVSGGEDGARYGPSLMPGGSKTAYNNVHDILHKIAAQVDDGPCVTYIGEGGSGNFVKMVHNGIEYGDMQLISEAYDVLKHVGGLSNSELADINAEWPLRPGSLRVS

SEQ ID NO: 11369 - protein, 495 aa, Phaseolus vulgaris
MESAALSRIGLAGLAVMGQNLALNIAEKGFPISVYNRTASKVDETVDRARNEGSLPLTGQYNPREFVLSIQRPRSVIILVKAGAPVDQTIAALSDHLEPGDCIIDGGNEWYENTERRISQVADKGLLYLGMGVSGGEDGARYGPSLMPGGSKTAYNNVHDILHKIAAQVDDGPCVTYIGEGGSGNFVKMVHNGIEYGDMQLISEAYDVLKHVGGLSNPELADIFAEWNSGELESFLIEITADIFKVKDEDGEGFLVDKILDKTGMKGTGKWTVQQAAELSIPVPTIAASLDCRYLSGLKEERENAEMVLKEAGMSDEFGRIGMTGVEKKRLIDDVRQALYASKICSYAQGMNLLRAKSNQKGWNLNLGELARIWKGGCIIRAAFLDRIKKAYQRNPNLANLIVDPEFTREMMQRLAAWKRVVGLTVSAGISAPGMCASLVYFDTYRRGTMPANLVQAQRDLFGAHTYERVDRPGAFHTEWTKLARQSGTGVGALN

SEQ ID NO: 11370 - protein, 492 aa, Phaseolus vulgaris
MESAALSRIGLAGLAVMGQNLALNIAEKGFPISVYNRTASKVDETVDRARNEGFLPLTGQYNPREFVLSIQRPRSVIILVKAGAPVDQTIAALSDHLEPGDCIIDGGNEWYENTERRISQVADKGLLYLGMGVSGGEDGARYGPSLMPGGSKTAYNNVHDILHKIAAQVDDGPCVTYIGEGGSGNFVKMVHNGIEYGDMQLISEAYDVLKHVGGLSNPELADIFAEWNSGELESFLIEITADIFKVKDEDGEGFLVDKVLDKTGMKGTGKWTVKQAADLSIAAPTIAGSLDCRYLSGLKEERENAATVLKKAGLSDGIDVSGVDKKRLIDDVRQALYASKICSYAQGMNLLKAKSNEKGWNLNLAELARIWKGGCIIRAVFLDRINKAYRRNPDLANLIVDPDFAIEMVQRESAWRRVVNLAVSAGISTTGMGGSLSYFDNYRRGRLPANLVQAQRDLFGAHTYERVDRPGSFHTEWTKLARQSGTGVGSLN

SEQ ID NO: 11371 - protein, 130 aa, Raphanus sativus
MASTVMTTLPQFNGLRASKISAAPVQGLATVVPMSRKGNGALGAKCDFIGSSTNLIMVTSTTLMLFAGRFGLAPSANRKATAGLKLEARDSGLQTGDPAGFTLADTLACGTVGHIIGVGVVLGLKNIGAI

SEQ ID NO: 11372 - protein, 130 aa, Brassica juncea
MASTMMTTLPQFNGLRANKISAAPVQGLATVVPMRRKGNGALGAKCDFIGSSTNLIMVTSTTLMLFAGRFGLAPSANRKATAGLKLEARDSGLQTGDPAGFTLADTLACGTVGHIIGVGVVLGLKNIGAI

SEQ ID NO: 11373 - protein, 130 aa, Brassica juncea
MASTMMTTLPQFNGLRATKISAAPVQGLATVVPMRRKGNGALGAKCDFIGSSTNLIMVTSTTLMLFAGRFGLAPSANRKATAGLKLEARDSGLQTGDPAGFTLADTLACGTVGHIIGVGVVLGLKNIGAI

SEQ ID NO: 11374 - protein, 131 aa, Unknown
  Sequence found in Organisms: Brassica napus, Brassica juncea, Triticum aestivum
MASTVMTTLPQFNGLRASKISAAPVQGLATVQPMRRKANGALGAKCGDFIGSSTNLIMVTSTTLMLFAGRFGLAPSANRKATAGLKLEARDSGLQTGDPAGFTLADTLACGTVGHIIGVGVVLGLKNIGAI

SEQ ID NO: 11375 - protein, 131 aa, Brassica juncea
MASIVMTTLPQFNGLRASKISAAPVQGLATVQPMRRKGNGALGAKCGDFIGSSTNLIMVTSTTLMLFAGRFGLAPSANRKATAGLKLEARDSGLQTGDPAGFTLADTLACGTVGHIIGVGVVLGLKNIGAI

SEQ ID NO: 11376 - protein, 130 aa, Brassica nigra
MASTMMTTLPQFNGLRANKISAAPVQGLATVVPMRRKGNGALGAKCDFIGSSTNLIMVTSTTLMLFAGRFGLAPSANRKATAGLKLEARDSGLQTGDPAGLTLADTLACGTVGHIIGVGVVLGLKNIGAI

SEQ ID NO: 11377 - protein, 131 aa, Raphanus sativus
MASTVMTTLPQFNGLRASKISAAPVQRLATVQPMRRKGNGALGAKCGDFIGSSTNLIMVTSTTLMLFAGRFGLAPSANRKATAGLKLEARDSGLQTGDPAGFTLADTLACGTVGHIIGVGVVLGLKNIGAI

SEQ ID NO: 11378 - protein, 130 aa, Brassica juncea
MASTMMTTLPQFNGLQAIKISAAPVQGLATVVPMRRKGNGALGAKCDFIGSSTNLIMVTSTTLMLFAGRFGLAPSANRKATAGLKLEARDSGLQTGDPAGFTLADTLACGTVGHTIGVGVVLGLKNIGAI

SEQ ID NO: 11379 - protein, 131 aa, Raphanus sativus
MASTVMTTLPQFNGLRASRISAAPVQRLATVQPMRRKGNGALGAKCGDFIGSSTNLIMVTSTTLMLFAGRFGLAPSANRKATAGLKLEARDSGLQTGDPAGFTLADTLACGTVGHIIGVGVVLGLKNIGAI

SEQ ID NO: 11380 - protein, 130 aa, Eutrema parvulum
MASTVMTTLPQFSGLRASKISAAPVQGLATVQPMRRKGNGALGAKCDFIGSSTNLIMVTSTTLMLFAGRFGLAPSANRKATAGLKLEARDSGLQTGDPAGFTLADTLACGSFGHIIGVGVVLGLKNIGAI

SEQ ID NO: 11381 - protein, 130 aa, Arabidopsis thaliana
MASTMMTTLPQFNGLRATKISAAPVQGLASVQPMRRKGNGALGAKCDFIGSSTNLIMVTSTTLMLFAGRFGLAPSANRKATAGLRLEARDSGLQTGDPAGFTLADTLACGTVGHIIGVGVVLGLKNIGAI

SEQ ID NO: 11382 - protein, 131 aa, Brassica rapa
MASTLMTTLPQFSGLRASKISAAPVQGLATVQPMRRKANGALGAKCGDFIGSSTNLIMVTSTTLMLFAGRFGLAPSANRKATAGLKLEARDSGLQTGDPAGFTLADTLACGTVGHIIGVGVVLGLKNIGAI

SEQ ID NO: 11383 - protein, 131 aa, Raphanus sativus
MTSIVMTTLPQFNGLRASKISAAPVQGLATVQPMRRKANGALGAKCGDFIGSSTNLIMVTSTTLMLFAGRFGLAPSANRKATAGLKLEARDSGLQTGDPAGFTLADTLACGTVGHIIGVGVVLGLKNIGAI

SEQ ID NO: 11384 - protein, 132 aa, Brassica juncea
MTSTVMMTALPQFNGLRASKISAAPVQGLATVQPMRRKANGALGAKCGDFIGSSTNLIMVTSTTLMLFAGRFGLAPSANRKATAGLKLEARDSGLQTGDPAGFTLADTLACGTVGHIIGVGVVLGLKNIGAI

SEQ ID NO: 11385 - protein, 131 aa, Arabidopsis lyrata
MASTVMTTLPQFNGLRATKISAAPVQGLASVQPMRRKGNGALGAKCGDFIGSSTNLIMVTSTTLMLFAGRFGLAPSANRKATAGLRLEARDSGLQTGDPAGFTLADTLACGTVGHIIGVGVVLGLKKIGAI

SEQ ID NO: 11386 - protein, 131 aa, Unknown
  Sequence found in Organisms: Eutrema halophilum, Eutrema parvulum
MASTVMTTLPQFNGLRACKISAAPVQGLATVQPMRRKGNGALGAKCGDFIGSSTNLIMVTSTTLMLFAGRFGLAPSANRKATAGLKLESRESGLQTGDPAGFTLADTLACGSFGHIIGVGVVLGLKNIGAI

SEQ ID NO: 11387 - protein, 130 aa, Cleome gynandra
MASTVMTTLPQFNGLRPNKISAVPVQGLANVQPMRRKGKGALGARCDFIGSPTNLIMVTSTSLMLFAGRFGLAPSANRKATAGLKLEARDSGLQTGDPAGFTLADTLACGTVGHIIGVGVVLGLKNIGAI

SEQ ID NO: 11388 - protein, 130 aa, Cleome spinosa
MASTVMTSLPQFNGLRTRKIFASPVHGPGAVQPMRRKGNGALGARCDFIGSPTNLIMVTSTTLMLFAGRFGLAPSANRKATAGLKLEARDSGLQTGDPAGFTLADTLACGTVGHIIGVGVVLGLKNIGAL

SEQ ID NO: 11389 - protein, 132 aa, Cleome spinosa
MASTVMTTLSLPQFNGLRPNRISACPVQGLVTVQPMGRKGNGALGARCDFIGSPTNLIMVTSTSLMLFAGRFGLAPSANRKATAGLKLEGRDSGLQTGDPAGFTLADTLACGTVGHIIGVGVVLGLKNIGAL

SEQ ID NO: 11390 - protein, 129 aa, Lotus japonicus
MATTVMTTLPQFSGLRPKFSATPVQNLVTVQPMRRKGNGALGARCDFIGSPTNLIMVASTTLMLFAGRFGLAPSANRKATAGLKLEVRDSGLQTGDPAGFTLADTLACGTVGHIIGVGVVLGLKNIGSL

SEQ ID NO: 11391 - protein, 129 aa, Cajanus cajan
MATTVMTTLPQFTGLRPQFSAAPVQNLVAVQPMRRKGKGALGARCDFIGSSTNLIMVASTTLMLFAGRFGLAPSANRKATAGLKLEVRDSGLQTGDPAGFTLADTLACGTVGHIIGVGVVLGLKNIGAL

SEQ ID NO: 11392 - protein, 129 aa, Vitis vinifera
MATTVMTTLPQFNGLRPKSSTSPVQTLAAVQPMRRKGRGALGARCDFIGSPTNLIMVTSTSLMLFAGRFGLAPSANRKATAGLKLEVRDSGLQTGDPAGFTLADTLACGTVGHIIGVGVVLGLKNIGVL

SEQ ID NO: 11393 - protein, 129 aa, Vitis vinifera
MATTVMTTLPQFNGLRPKSSTSPVQTLAAVQPMRRKGKGALGARCDFIGSPTNLIMVTSTSLMLFAGRFGLAPSANRKATAGLKLEVRDSGLQTGDPAGFTLADTLACGTVGHIIGVGVVLGLKNIGVL

SEQ ID NO: 11394 - protein, 130 aa, Eucalyptus grandis
MATTVMTSLPQFNGLRPAAPAAPVRSLAAVVQPMRRKGKGALGARCDFIGSPTNLIMVTTTTLMLFAGRFGLAPSANRKATAGLKLEARDSGLQTGDPAGFTLADTLACGSFGHIIGVGVVLGLKNIGAL

SEQ ID NO: 11395 - protein, 129 aa, Arachis hypogaea
MATTMMTTLPQFNGLRPKFSAAPVQNLVAVQPMRRKGKGALGTRCDFIGSETNLIMVASTTLMLFAGRFGLAPSANRKATAGLKLEVRDSGLQTGDPAGFTLADTLACGTVGHIIGVGIVLGLKNTGAL

SEQ ID NO: 11396 - protein, 130 aa, Solanum melongena
MASTMMTTLPQFNGLRPQAFSTSPVQGLVPVQPRKNKGQGAMGARCEFIGSSTNLIMVTSTTLMLFAGRFGLAPSANRKATAGLKLEVRDSGLQTGDPAGFTLADTLACGTVGHIIGVGVVLGLKNIGAI

SEQ ID NO: 11397 - protein, 129 aa, Humulus lupulus
MATTVATSLPQFNGLRPQFSATPVRTLAAVQPMKRKGKGALGARCDFIGSPTNLIMVTSTTLMLFAGRFGLAPSANRKATAGLKLEARDSGLQTGDPAGFTLADTLACGTVGHIIGVGVVLGLKNIGSL

SEQ ID NO: 11398 - protein, 130 aa, Unknown
  Sequence found in Organisms: Solanum tuberosum, Solanum phureja
MASTMMTTLPQFNGLKPQPFSASPVQGLVAIQPRRNKGQGGLGARCDFIGSSTNLIMVTSTSLMLFAGRFGLAPSANRKATAGLKLEVRDSGLQTGDPAGFTLADTLACGTVGHIIGVGVVLGLKNIGAI

SEQ ID NO: 11399 - protein, 74 aa, Arachis hypogaea
MVASTTLMLFAGRFGLAPSANRKATAGLKLEVRDSGLQTGDPAGFTLADTLACGTVGHIIGVGIVLGLKNTGAL

SEQ ID NO: 11400 - protein, 129 aa, Unknown
  Sequence found in Organisms: Theobroma cacao, Pteridium aquilinum
MAATAMTTLPQFSGLRPRISAAPVRGLAAVQPMRRKGKGALGARCGYIGSPTNLIMVTTTSLMLFAGRFGLAPSANRKATAGLKLEARDSGLQTGDPAGFTLADTLACGSVGHIIGVGIVLGLKNIGAL

SEQ ID NO: 11401 - protein, 129 aa, Glycine max
MATTVMTTLPQFSGLRPQFSAAPVKNLVAVQPMSRKGKGALGARCDYIGSSTNLIMVASTTLMLFAGRFGLAPSANRKATAGLKLEVRDSGLQTGDPAGFTLADTLACGSVGHIIGVGVVLGLKNIGAL

SEQ ID NO: 11402 - protein, 129 aa, Cannabis sativa
MATTVATSLPQFNGLRPQISSTPVRTLAAVQPMKRKGKGALGARCDFIGSPTNLIMVTSTTLMLFAGRFGLAPSANRKATAGLKLETRDSGLQTGDPAGFTLADTLACGTVGHIIGVGVVLGLKNIGSL

SEQ ID NO: 11403 - protein, 129 aa, Carica papaya
MATTVMTSLPQFSGLRPNFSAAPVKTLAAVRPMKRKGNGALGARCDFIGSPTNLIMVTSTSLMLFAGRFGLAPSANRKATAGLKLEVRDSGLQTGDPAGFTLADTLACGVVGHIIGVGVVLGLKNLGAL

SEQ ID NO: 11404 - protein, 129 aa, Arachis hypogaea
MATTMMTTLPQFNGLRPKFSAAPVQNLVAVQPMRRKAKGALGTRCDFIGSETNLIMVASTTLMLFAGRFGLAPSANRKATAGLKLEVRDSGLQTGDPAGFTLADTLACGTVGHIIGVGIVLGLKNTGAL

SEQ ID NO: 11405 - protein, 130 aa, Capsicum annuum
MASTMMTTLPQFSGLKPQAFSTSPIQGLVSVQPRRNKGQGALGARCDFIGSSTNLIMVTSTTLMLFAGRFGLAPSANRKATAGLKLEVRDSGLQTGDPAGFTLADTLACGTVGHIIGVGVVLGLKNIGAL

SEQ ID NO: 11406 - protein, 130 aa, Nicotiana tabacum
MAATMMTSLPQFNGLKPKTFSTSPVQGLVAVQPMRRKGHGALGARCDFIGSPTNLIMVTSTSLMLFAGRFGLAPSANRKATAGLKLEVRDSGLQTGDPAGFTLADTLACGVVGHIIGVGVVLGLKNIGAI

SEQ ID NO: 11407 - protein, 78 aa, Arachis hypogaea
VVSTQSTGGILSKKKKNRESLEIQVMATTMMTTLPQFNGLRPKFSAAPVQNLVAVQPMRRKGKGALGTRCDFIGQKPI

SEQ ID NO: 11408 - protein, 130 aa, Prunus persica
MAAATVTTSLPQFNGLKSKVSYANVQSLAAVQPMRRKGQGALGARCDFIGSPTNLIMVTTTTLMLFAGRFGLAPSANRKATAGLKLETRDSGLQTGDPAGFTLADTLACGTVGHIIGVGVVLGLKNIGSL

SEQ ID NO: 11409 - protein, 129 aa, Echinacea purpurea
MASVVMTSLPQFNGLKPQTTTLSPVRNLVAVPMRRKGQGALGARCDFIGSPTNLIMVTATSLMLFAGRFGLAPSANRKATAGLKLEARDSGLQTGDPAGFTLADTLACGTVGHIIGVGVVLGLKNIGAI

SEQ ID NO: 11410 - protein, 129 aa, Arachis hypogaea
MATTMMTTLPQFNGLRPKFSASPVQNLVAVQPMRRKAKGALGTRCDFIGSETNLIMVASTTLMLFAGRFGLAPSANRKATAGLKLEVRDSGLQTGDPAGFTLADTLACGTVGHIIGVGIVLGLKNTGAL

SEQ ID NO: 11411 - protein, 130 aa, Nicotiana tabacum
MAATMMTSLPQFNGLKPKTFSTSPVQGLVAVQPMRRKGQGALGARCDFIGSPTNLIMVTSTSLMLFAGRFGLAPSANRKATAGLKLEVRDSGLQTGDPAGFTLADTLACGVVGHIIGVGVVLGLKNIGAL

SEQ ID NO: 11412 - protein, 130 aa, Unknown
  Sequence found in Organisms: Solanum lycopersicum, Triticum aestivum
MASTMMTTLPQFNGLKPQPFSASPIQGLVAIQPRRNKGQGGLGARCDFIGSSTNLIMVTSTSLMLFAGRFGLAPSANRKATAGLKLEVRDSGLQTGDPAGFTLADTLACGTVGHIIGVGVVLGLKNIGAL

SEQ ID NO: 11413 - protein, 133 aa, Mesembryanthemum crystallinum
MASAVMTSLSLPQFSGLRVSPQHSTSSVKSLAVSFPSKGKGNGALGAKCEFIGSSTNLIMVTSTTLMLFAGRFGLAPSANRKATAGLKLEARDSGLQTGDPAGFTLADTLACGTVGHIIGVGVVLGLKNIGAI

SEQ ID NO: 11414 - protein, 130 aa, Chenopodium quinoa
MASVVMTSLPHFTGLRPQQASFPVKTLSSSLPMRGKGKGALGARCGDFIGSSTNLIMVTSTTLMLFAGRFGLAPSANRKATAGLKLEVRDSGLQTGDPAGFTLADTLACGTVGHIIGVGVVLGLKNIGAI

SEQ ID NO: 11415 - protein, 130 aa, Chenopodium quinoa
MASVVMTSLPHFTGLRPQQASFPVKSLSATLPMRGKGKGALGARCGDFIGSSTNLIMVTSTTLMLFAGRFGLAPSANRKATAGLKLEVRDSGLQTGDPAGFTLADTLACGTVGHIIGVGVVLGLKNIGAI

SEQ ID NO: 11416 - protein, 130 aa, Prunus mume
MAAATVTTSLPQFNGLKSKVSYANVQSLAAVQPMRRKGQGALGARCDFIGSPTNLIMVTTTSLMLFAGRFGLAPSANRKATAGLKLETRDSGLQTGDPAGFTLADTLACGTVGHIIGVGVVLGLKNIGSL

SEQ ID NO: 11417 - protein, 140 aa, Fraxinus spp
MASAVITSLPQFNGLRFVPASASPVKSLVAAQPMKRKGQGALGARCDFIGSPTNLIMVTSTSLMLFAGRFGLAPSANRKATAGLKLEVRDSGLQTGDPAGFTLADTLACGTVGHIIGVGVVLGLKTLEPSKFIFTKPVND

SEQ ID NO: 11418 - protein, 130 aa, Triphysaria pusilla
MATAVITTLPQFNGLKPQSASASPLKNLVAVQPMRRKGQGALGARCDFIGSPTNLIMVTSTTLMLFAGRFGLAPSANRKATAGLKLESRDSGLQTGDPAGFTLADTLACGSFGHIIGVGVVLGLKNIGAI

SEQ ID NO: 11419 - protein, 130 aa, Ambrosia trifida
MASTVMSSLPQFTGLKATSSSLSPVQSMVAVQPMKPKEKGALGVRCDFIGSSTNLIMVTSTTLMLFAGRFGLAPSANRKATAGLKLEVRDSGLQTGDPAGFTLADTLACGTVGHIIGVGVVLGLKNIGAI

SEQ ID NO: 11420 - protein, 129 aa, Phaseolus vulgaris
MATTAMTTLPQFSGLRPQFSAAPVHNLVAVQPMRRKGKGALGTRCDYIGSSTNLIMVASTSLMLFAGRFGLAPSANRKATAGLKLEVRDSGLQTGDPAGFTLADTLACGAVGHIIGVGVVLGLKNIGAL

SEQ ID NO: 11421 - protein, 129 aa, Bruguiera gymnorhiza
MAAAMMTTLPQFNGLRPQLLAAPAKSLGAVQPMRRKGNGALGARMDFIGSPTNLIMVTSTSLMLFAGRFGLAPSANRKATAGLKLEVRDSGLQTGDPAGFTLADTLACGTVGHIIGVGIVLGLKNIGAL

SEQ ID NO: 11422 - protein, 130 aa, Nicotiana benthamiana
MAATMMTSLPQFNGLKPKTFSTSPVQGLVAVQPMRRKGQGALGARCDFIGSPTNLIMVTSTSLMLFAGRFGLAPSANRKATAGLKLEVRDSGLQTGDPARFTLADTLACGVVGHIIGVGVVLGLKNIGAL

SEQ ID NO: 11423 - protein, 130 aa, Tabernaemontana elegans
MASAMMTSLPQFNGLTPMTFSASPVQGLVAAQPMKRKGQGALGARCDFIGSPTNLIMVTSTSLMLFAGRFGLAPSANRKATAGLKLEIRDSGLQTGDPAGFTLADTLACGTVGHIIGVGVVLGLKNIGVL

SEQ ID NO: 11424 - protein, 130 aa, Triphysaria pusilla
MATAVVTTLPQFNGLKPQSVSASPLRNLVAVQPMRRKGQGALGARCDFIGSPTNLIMVTSTTLMLFAGRFGLAPSANRKATAGLKLESRDSGLQTGDPAGFTLADTLACGSFGHIIGVGVVLGLKNIGAI

SEQ ID NO: 11425 - protein, 129 aa, Juglans hindsii x Juglans regia
MATTVMTSLPQYSGLRPQISAAPVRTLAAVQPMGRKGKGALGARCDYIGSPTNLIMVASTSLMLFAGRFGLAPSANRKATAGLKLEVRDSGLQTGDPAGFTLADTLACGSVGHIIGVGVVLGLKNIGAL

SEQ ID NO: 11426 - protein, 130 aa, Unknown
  Sequence found in Organisms: Gossypium hirsutum, Gossypium raimondii
MAATAAITTLPQFSGLRPKVSTAPVRSLAAVQPMRRKGKGALGARCDFIGSPTNLIMVTTTTLMLFAGRFGLAPSANRKATAGLKLEVRDSGLQTGDPAGFTLADTLACGVVGHIFGVGIVLGLKNIGAL

SEQ ID NO: 11427 - protein, 131 aa, Amsonia hubrichtii
MASAMMMTSLPQFNGLGHKTFSASPVQSLVAAQPMKRKGQGALGARCDFIGSPTNLIMVTSTSLMLFAGRFGLAPSANRKATAGLKLESRDSGLQTGDPAGFTLADTLACGTVGHIIGVGVVLGLKNIGAL

SEQ ID NO: 11428 - protein, 130 aa, Cicer arietinum
MATSMMTTFPQFTGLRPQFSASPVQGLVAVQPMTRRKGKGALGVRCDFIGSSTNLIMVASTTLMLFAGRFGLAPSANRKATAGLKLETRDSGLQTGDPAGFTLADTLACGSFGHIIGVGVVLGLKNIGAL

SEQ ID NO: 11429 - protein, 129 aa, Rosa hybrid cultivar
MAAATVTTSLPQFSGLRPKISSNVQSLAAVQPMRRKSQGALGARCDFIGSPTNLIMVTTTSLMLFAGRFGLAPSANRKATAGLKLEIRDSGLQTGDPAGFTLADTLACGTVGHIIGVGVVLGLKNIGAL

SEQ ID NO: 11430 - protein, 129 aa, Lupinus angustifolius
MATSLMTTLPQFNGLRPSSSATPVQNLVAVQPMRRRGKGALSVRCDFIGSPTNLILVASTSIMLFAGRFGLAPSANRKATAGLKLEVRDSGLQTGDPAGFTLADTLACGTVGHIIGVGVVLGLKNIGAI

SEQ ID NO: 11431 - protein, 130 aa, Triphysaria pusilla
MATAVITTLPQFNGLKPQSASASPLKNLVAVQPMRRRGQGALGARCDFIGSPTNLIMVTSTTLMLFAGRFGLAPSANRKATAGLKLESRDSGLQTGDPAGFTLADTLACGSFGHIIGVGVVLGLKNIGAI

SEQ ID NO: 11432 - protein, 129 aa, Phaseolus vulgaris
MATTAMTTLPQFTGLRPQFSAVPVQSLVAVQTMRRKGKGALGTRCDYIGSSTNLIMVASTSLMLFAGRFGLAPSANRKATAGLKLEVRDSGLQTGDPAGFTLADTLACGAVGHIIGVGVVLGLKNIGAL

SEQ ID NO: 11433 - protein, 129 aa, Manihot esculenta
MAASMMTTLPQFNGLKPQISVAPVKSVAAVQPMRRKGNGALGARMDFIGSPTNLIMVTTTSLMLFAGRFGLAPSANRKATAGLKLEARDSGLQTGDPAGFTLADTLACGTVGHIMGVGIVLGLKNLGAL

SEQ ID NO: 11434 - protein, 129 aa, Vigna unguiculata
MATTAITTLPQFTGLRPQFSAAPVQNLVAVQPLRRKGKGGLGVRCDYIGSSTNLIMVASTSLMLFAGRFGLAPSANRKATAGLKLEVRDSGLQTGDPAGFTLADTLACGTVGHIIGVGIVLGLKNIGAI

SEQ ID NO: 11435 - protein, 130 aa, Mimulus guttatus
MASAVMTSLPQFNGLKPQIAPASPVKSLVAVQPMRRRGQGALGARCDFIGSPTNLIMVTSTSLMLFAGRFGLAPSANRKATAGLKLEARDSGLQTGDPAGFTLADTLGCGVVGHIIGVGVVLGLKNIGAL

SEQ ID NO: 11436 - protein, 130 aa, Olea europaea
MASAVMTSLPQFNGLRLKPASASPVKSLVAAQPMKRKGQGALGARCDFIGSPTNLIMVTSTSLMLFAGRFGLAPSANRKATAGLKLEVRDSGLQTGDPAGFTIADTLACGSVGHIIGVGVVLGLKNIGVI

SEQ ID NO: 11437 - protein, 130 aa, Lippia dulcis
MATAVMTSIPQFNGLKAQPGSVSPVKNLVAVRPSLRKSRRALGARCDFIGSSTNLIMVTSTSLMLFAGRFGLAPSANRKATAGLKLEARDSGLQTGDPAGFTLADTLACGTVGHIIGVGVVLGLKNIGAI

SEQ ID NO: 11438 - protein, 129 aa, Senecio madagascariensis
MATAVMTSLPQFTGLKASSPSVSQVQNMVALPMKPKGKGALGVRCDFIGSSTNLIMVTSTTLMLFAGRFGLAPSANRKATAGLKLEVRDSGLQTGDPAGFTLADTLACGTVGHIIGVGVVLGLKNIGAI

SEQ ID NO: 11439 - protein, 140 aa, Ambrosia trifida
ELTIFQTHINDGKCCHVFSSSVHWFKSHLTITSPVQSMVALQPMKPKGKGALGVRCDFIGSSTNLIMVTSTTLMLFAGRFGLAPSANRKATAGLKLEVRDSGLQTGDPAGFTLADTLACGTVGHIIGVGVVLGLKNIGAI

SEQ ID NO: 11440 - protein, 132 aa, Glycine max
MATTTVIMTTLPQFSGLRPQFSAAPVKNLVAVQQPMRPKGKGALGARCDYIGSSTNLIMVASTTLMLFAGRFGLAPSANRKATAGLKLEVRDSGLQTGDPAGFTLADTLACGSVGHIIGVGVVLGLKNIGAL

SEQ ID NO: 11441 - protein, 130 aa, Populus trichocarpa
MAATTMMTATALPQFSGLRPSAAPVKSLAAVQPTRRKGNGALGARMDFIGSPTNLIMVTSTSLMLFAGRFGLAPSANRKATAGLKLEVRDSGLQTGDPAGFTLADTLACGSVGHIIGVGVVLGLKNIGAL

SEQ ID NO: 11442 - protein, 132 aa, Flaveria ramosissima
MAASVMSSLPQFTGLKASSSSLSPVQNMVAVQPMKPKGKGKGALGVRCDFIGSSTNLIMVTSTTLMLFAGRFGLAPSANRKATAGLKLEVRDSGLQTGDPAGFTLADTLACGTVGHIIGVGVVLGLKNIGAI

SEQ ID NO: 11443 - protein, 154 aa, Flaveria ramosissima
LGEKLLNSILKLGIPTCFKFKNNGSQCHVLSSSVHWFKSEFIITLPGSKHGSSATNETKGQGKGALGVRCDFIGSSTNLIMVTSTTLMLFAGRFGLAPSANRKATAGLKLEVRDSGLQTGDPAGFTLADTLACGTVGHIIGVGVVLGLKNIGAI

SEQ ID NO: 11444 - protein, 145 aa, Cicer arietinum
MATSMMTTFPQFTGLRPQFSASPVQGLVAVQPMTRRKGKGALGVRCDFIGSSTNLIMVASTTLMLFAGRFGLAPSANRKATAGLKLETRDSGLQTGDPAGFTLADTLACGSFGHIIGVVWFLVLRTLVLCKKWKKILCCELVLYL

SEQ ID NO: 11445 - protein, 130 aa, Castanea mollissima
MATTVMTSLPQFNGLRPNLSAAPVKSMAAIQPMRRKGKGALGARCEGFIGSPTNLIIVTSTSLMLFAGRFGLAPSANRKSTAGLKLEVRDSGLQTGDPAGFTLADTLACGSVGHIIGVGVVLGLKNIGAL

SEQ ID NO: 11446 - protein, 130 aa, Heritiera littoralis
MAATAMVTLPQFSGLRPQFSAAPVRSLAAVQPKRGNKGKGALGARCDFIGSATNLIMVTTTSLMLFAGRFGLAPSANRKATAGLKLEVRDSGLQTGDPAGFTLADTLACGSVGHIIGVGVVLGLKNIGAL

SEQ ID NO: 11447 - protein, 129 aa, Fragaria vesca
MAAATMTTSLPQFNGLRPKISSNVQSLAAVQPMRRKSQGALGARCDFIGSPTNLIMVTTTSLMLFAGRFGLAPSANRKATAGLKLEIRESGLQTGDPAGFTLADTLACGTVGHMIGVGVVLGLKNMGAL

SEQ ID NO: 11448 - protein, 131 aa, Vinca minor
MASAMMTSLPQFNGLRPTMTFSASPVQSLVTTQPMKRRGQGALGARCDFIGSPTNLIMVTATSIMLFAGRFGLAPSANRKATAGLKLEVRDSGLQTGDPAGFTLADTLACGTVGHIIGVGVVLGLKNIGAL

SEQ ID NO: 11449 - protein, 81 aa, Arachis hypogaea
GINAEYGGTTPEFFQRKKKNRESLEIQVMATTMMTTLPQFNGLRPKFSASPVQNLVAVQPMRRKAKGALGTRCDFIGSETI

SEQ ID NO: 11450 - protein, 135 aa, Chelidonium majus
MAAYKLTSPTAVMTSLPQFSGLRSKPSSARVESLVVLPIKRKGNGALGARCDFIGSPTNLIMVTATSLMLFAGRFGLAPSANRKATAGLKLETRDSGLQTGDPAGFTLADTLGCGTVGHIIGVGVVLGLKNIGAI

SEQ ID NO: 11451 - protein, 130 aa, Panax ginseng
MATAVMTSLPQFNGLRPKTSSVSPVQSLVAVQPMKRRGNGALGARCGYIGSPTNLIMVTATSLMLFAGRFGLAPSANRKATAGLKLEARDSGLQTGDPAGFTLADTLACGSVGHIIGVGVVLGLKNIGAL

SEQ ID NO: 11452 - protein, 129 aa, Lupinus angustifolius
MTTSLMTTLPQFSGLRPKFSPGPVQNLVAVQPMRRKGKGGLGVRCDFIGSPTNLIIVASTSLMLFAGRFGLAPSANRKATAGLKLEVRDSGLQTGDPAGFTLADTLACGTVGHIIGVGVVLGLKNIGAI

SEQ ID NO: 11453 - protein, 126 aa, Triphysaria pusilla
VITTLPQFNGLKPQSASASPLKNLVAVQPMRRKGQGALGARCDFIGSPTNLIMVTSTTLMLFAGRFGLAPSANRKATAGLKLESRDSGLQTGDPAGFTLADTLACGSFGHIIGVGVVLGLKNIGAI

SEQ ID NO: 11454 - protein, 129 aa, Ricinus communis
MAASMMTTLPQFNGLKPQLPIASEKSLVAVQPMRRKGNGALGARMDFIGSPTNLIMVTSTSLMLFAGRFGLAPSANRKATAGLKLEVRDSGLQTGDPAGFTLADTLACGTVGHIIGVGVVLGLKNIGAL

SEQ ID NO: 11455 - protein, 137 aa, Elaeis guineensis
MMTTLPQFNGLRATKISAAPVQGLASVQPMRRKGNGALGAKCDFIGSSTNLIMVTSTTLMLFAGRFGLAPSANRKATAGLRLEARDSGLQTGDPAGFTLADTLACGTVGHIIGVGVVLGLKKHWCYLKFLKLFLLYL

SEQ ID NO: 11456 - protein, 130 aa, Lippia dulcis
MASVVMTSLPQFNGLKPQTATLSPVKSLVAVQPMRRRGQGALGARCDFIGSPTNLIMITATSLMLFAGRFGLAPSANRKATAGLKLEARDSGLQTGDPAGFTLADTLACGTVGHIIGVGVVLGLKNIGAL

SEQ ID NO: 11457 - protein, 129 aa, Salvia sclarea
MASVVMTSLPQFNGLKPQTRTLSPVKNLVAVPMRRRGQGGLGARCDFIGSPTNLIMVTATSLMLFAGRFGLAPSANRKATAGLKLEARDSGLQTGDPAGFTLADTLACGTVGHIIGVGVVLGLKNIGAS

SEQ ID NO: 11458 - protein, 130 aa, Nicotiana tabacum
MAATMITSLPQFNGLKINTFSTSPIQGLVAVQPMRSRGQGALGARCDFIGSPTNLIMVTSTSLMLFAGRFGLAPSANRKATAGLKLEVRDSGLQTGDPAGFTLADTLACGVVGHIIGVGVVLGLKNIGAI

SEQ ID NO: 11459 - protein, 130 aa, Nicotiana tabacum
MAATILTFLPQFNGLKTNTFSTSPIQGLVAVQPMRSRGQGALGARCDFIGSPTNLIMVTSTSLMLFAGRFGLAPSANRKATAGLKLEVRDSGLQTGDPAGFTLADTLACGVVGHIIGVGVVLGLKNIGAI

SEQ ID NO: 11460 - protein, 339 aa, Cirsium arvense
MSGTEGFEGFENLEDERRRSKIGSLRKKAINASNKLTHSITKRGLRKVDYRVPSIQDIRDASEERAVHELRQKLIDMDLLPERHDEYHTLLRFLKARDFDIEKTIRMWAEMLNWRKEYGTDTILEDYVFEELEEVLQHYPQGYHGVDRVGRPIYIERLGKAHPGRLMRITSIDRYLKYHVQEFERAFIEKFPACSIAAKRQICSTTTILDVQGLGLKNFTPSAASILGAMAKVDNNYYPETLHRMFVVNAGSTFRKYLWPAAQKFLDAKTITKIQVLEPKSLGKLHEAIDPSQLPDFLGGSCTCSAEGGCLRSNMGPWNDPEIMKVVINAEATFARQIS

SEQ ID NO: 11461 - protein, 132 aa, Flaveria ramosissima
MATSVMSSLPQFTGLKASSPSLSPVQCMVALQPMKPKGKGRGALGVRCDFIGSSTNLIMVTSTTLMLFAGRFGLAPSANRKATAGLKLEVRDSGLQTGDPAGFTLADTLACGTVGHIIGVGVVLGLKNIGAI

SEQ ID NO: 11462 - protein, 132 aa, Flaveria ramosissima
MATSVMSSLPQFTGLKASSPSLSSVQNMVALQPMKPKGNGKGALGVRCDFIGSSTNLIMVTSTTLMLFAGRFGLAPSANRKATAGLKLEVRDSGLQTGDPAGFTLADTLACGTVGHIIGVGVVLGLKNIGAI

SEQ ID NO: 11463 - protein, 132 aa, Flaveria ramosissima
MATSVMSSLPQFTGLKASSPSLVSVQSMVALQPMKPKGNGKGALGVRCDFIGSSTNLIMVTSTTLMLFAGRFGLAPSANRKATAGLKLEVRDSGLQTGDPAGFTLADTLACGTVGHIIGVGVVLGLKNIGAI

SEQ ID NO: 11464 - protein, 132 aa, Flaveria ramosissima
MATSVMYSLPQFTGLKASSPSLSSVQSMVALQPMKPKGNGKGALGVRCDFIGSSTNLIMVTSTTLMLFAGRFGLAPSANRKATAGLKLEVRDSGLQTGDPAGFTLADTLACGTVGHIIGVGVVLGLKNIGAI

SEQ ID NO: 11465 - protein, 132 aa, Flaveria ramosissima
MATSVMYSLPQFTGLKASSPSLSSVQSMVALRPMKPNGKGNGALGVRCDFIGSSTNLIMVTSTTLMLFAGRFGLAPSANRKATAGLKLEVRDSGLQTGDPAGFTLADTLACGTVGHIIGVGVVLGLKNIGAI

SEQ ID NO: 11466 - protein, 131 aa, Helianthus annuus
MAAVMTSLPQFTGLKATSSSLSPVQSMVSLQPMKPKGKGKGALGVRCDFIGSSTNLIMVTSTTLMLFAGRFGLAPSANRKATAGLKLEVRDSGLQTGDPAGFTLADTLACGTVGHIIGVGVVLGLKNIGAI

SEQ ID NO: 11467 - protein, 131 aa, Centaurea maculosa
MATTAMASLPQFTGLRASSSSSPIQSMVAFQPMKPKTKGKGALGVRCDFIGSSTNLIMVTSTTLMLFAGRFGLAPSANRKATAGLKLEVRDSGLQTGDPAGFTLADTLACGTVGHIIGVGVVLGLKNIGAI

SEQ ID NO: 11468 - protein, 148 aa, Ambrosia trifida
MACVVMSSLPQFTGLKATSPSPSPIQSMVAVQPMKPKGKGALGVRCDFIGSSTNLIMVTSTTLMLFAGRFGLAPSANRKATAGLKLEVRDSGLQTGDPAGFTLADTLACGTVGHIIGVGVVLGLKTLVPSKLVCCLKHIIMLITLLLL

SEQ ID NO: 11469 - protein, 140 aa, Jatropha curcas
AASMMTTLPQFHGLKPQFSSAPVKSLAAVQPIRRKGNGALGTRMDFIGSPTNLIMVTSTSLMLFAGRFGLAPSANRKATAGLKLEVRDSGLERVATLLVLLLLIPWPVELLGTSLELVLFLALKTLVPSKLTIKYFPLLF

SEQ ID NO: 11470 - protein, 129 aa, Echinacea purpurea
MAAVMTSLPQFTGLKATSSSLSPVQSMVSFQPMKPKGKGALGVRCDFIGSPTNLIMVTSTTLMLFAGRFGLAPSANRKATAGLKLEVRDSGLQTGDPAGFTLADTLACGTVGHIIGVGVVLGLKNIGAL

SEQ ID NO: 11471 - protein, 129 aa, Fagus grandifolia
MATTVMTSLPQFNGLRPNFSVAPVRSLAAIQPMRRKGKGALGARCGFIGSPTNLIIVTSTTLMLFAGRFGLAPTANRKSTAGLRLEVRDSGLQTGDPAGFTLADTLACGSLGHIIGVGVVLGLKNIGAL

SEQ ID NO: 11472 - protein, 130 aa, Nicotiana benthamiana
MAATMLTSLPQFNGLKTNTFSTSPIQGLVALQPMRNRGQGALGARCDFIGSPTNLIMVTSTSLMLFAGRFGLAPSANRKATAGLKLEVRDSGLQTGDPAGFTLADTLACGVVGHIIGVGVVLGLKNIGAI

SEQ ID NO: 11473 - protein, 130 aa, Helianthus annuus
MASAVMSSLPQFTGLKATSPSLSPVQNMVAVQPVKPKGKGALGVRCDFIGSPTNLIMVTSTTLMLFAGRFGLAPSANRKATAGLKLEVRDSGLQTGDPAGFTLADTLACGTVGHIIGVGVVLGLKNIGAL

SEQ ID NO: 11474 - protein, 130 aa, Tamarix hispida
MATTMMASLPQFSGLRPQQQSSTPVKSLAAVLPKKRKGNGALGARCDFIGSPTNLIMVTSTTLMLFAGRFGLAPSANRKATAGLRLEVRDSGLQTGDPAGFTLADTLACGSFGHIIGVGVVLGLKNIGAL

SEQ ID NO: 11475 - protein, 147 aa, Tropaeolum majus
MATSTMMMTTTLPQFNGLKPGIFSSSPVQGLASIQPIKRKGNGASGARCEFIGSSTNLIMVTSTSLMLFAGRFGLAPSANKKATAGLKLEVRDSGLQTGDPAGFTLADTLACGTVGHIIGVGVVLGLKTLVLYKQNCIIFFMCFVKF

SEQ ID NO: 11476 - protein, 131 aa, Centaurea maculosa
MATTAMASLPQFTGLRASSSSSPIQSMVAFQPMKPKTKGKGALGVRCDFIGSSANLIMVTSTTLMLFAGRFGLAPSANRKATAGLKLEVRDSGLQTGDPAGFTLADTLACGTVGHIIGVGVVLGLKNIGAI

SEQ ID NO: 11477 - protein, 131 aa, Trifolium pratense
MATSMMTTTFTQFTGLRSQFKGSPVQGLVAAQPMTSRRGKGALGVRCDFIGSSTNVIMVASTTLMLFAGRFGLAPSANRKATAGLKLEARDSGLQTGDPAGFTLADTLACGTVGHIIGVGVVLGLKNIGAI

SEQ ID NO: 11478 - protein, 132 aa, Flaveria ramosissima
MATSVMSSLPQFTGLKASSSSLSPIQSMIAFQPMKPKGKGKGALGVRCDFIGSSTNLIMVTSTTLMLFAGRFGLAPSANRKATAGLKLEVRDSGLQTGDPAGFTLADTLACGTVGHIIGVGVVLGLKNIGAI

SEQ ID NO: 11479 - protein, 132 aa, Flaveria ramosissima
MATSVMSSLPQFTGLKASSPSLSSVQNMVALQPMKPKGNGKGALGVRCDFIGSSTNLIMVTSTTLMLFAGRFGLAPSANRKATAGLKLEVRDSGLQTGDPAGFTLADTLACGTVGHIIGGGVVLGLKNIGAI

SEQ ID NO: 11480 - protein, 132 aa, Flaveria ramosissima
MATSVMSSLPQFTGLKASSPALSSVQSMVALQPMKPKGKGNGALGVRCDFIGSSTNLIMVTSTTLMLFAGRFGLAPSANRKATAGLKLEVRDSGLQTGDPAGFTLADTLACGTVGHIIGVGVVLGLKNIGAI

SEQ ID NO: 11481 - protein, 132 aa, Flaveria ramosissima
MATSVMSSLPQFTGLKASSPSLSSLQSMVALQPMKPKGNGKGALGVRCDFIGSSTNLIMVTSTTLMLFAGRFGLAPSANRKATAGLKLEVRDSGLQTGDPAGFTLADTLACGTVGHIIGVGVVLGLKNIGAI

SEQ ID NO: 11482 - protein, 131 aa, Papaver somniferum
MASSSAVMTSLPQFSGLRSKPSAPRVDSLVSIVPMKRKGNGALGARCDYIGSPTNLIMVTSTTLMLFAGRFGLAPSANRKATAGLKLEGRDSGLQTGDPAGFTLADTLACGSFGHIIGVGVVLGLKGIGAL

SEQ ID NO: 11483 - protein, 133 aa, Flaveria ramosissima
MATSVMSSLPQFTGLKASSPSLSPVQSMVALQPMKPKGKGKGALGVRCDFIGSSTNLIMVTSTTLMLFAGRFGLAPSANRKATAGLKLEVRDSGLQTGDPAGFTLADTLACGTVGHDYWCWCCFGSTKNFGAI

SEQ ID NO: 11484 - protein, 130 aa, Medicago truncatula
MATSMMITLPQFTGLRSQLKPSPIQGLVAAQPMTKRKGKGALGVRCDFIGSSTNVIMVASTTLMLFAGRFGLAPSANRKATAGLKLETRDSGLQTGDPAGFTLADTLACGTVGHIIGVGVVLGLKNIGAL

SEQ ID NO: 11485 - protein, 130 aa, Manihot esculenta
MAAASMMTTLPQFNGLKPQFSAAPIKSLALVRPMRRKGNGALGTRMDFIGSPTNLIMVTTTSLMLFAGRFGLAPSANRKATAGLKLEARDSGLQTGDPAGFTLADTLACGTVGHIIGVGIVLGLKNLGSL

SEQ ID NO: 11486 - protein, 131 aa, Vinca minor
MASAMMTSLPQFNGLRPTITFSASPVRSLVAAQPMKRRGQGALGARCDFIGSPTNLIMVTATSLMLFAGRFGLAPSANRKATAGLKLEVRESGLQTGDPAGFTLADTLACGTVGHIIGVGVVLGLKNIGAL

SEQ ID NO: 11487 - protein, 129 aa, Echinacea purpurea
MAAVMSSLPQFTGLKATSSSLSPVQSMVSFQPMKPKGKGALGVRCDFIGSPTNLIMVTSTTLMLFAGRFGLAPSANRKATAGLKLEVRDSGLQTGDPAGFTLADTLACGTVGHIIGVGVVLGLKNIGAL

SEQ ID NO: 11488 - protein, 128 aa, Unknown
  Sequence found in Organisms: Citrus clementina, Citrus sinensis
MATSLMTMPQFSGLRPQISAAPAQSLVAAQPMRRKCSGALGARCGFIGSPTNLIMVTTTTLMLFAGRFGLAPSANRKATAGLKLEVRDSGLQTGDPAGFTLADTLACGSVGHIIGVGVVLGLKNLGAL

SEQ ID NO: 11489 - protein, 130 aa, Flaveria ramosissima
MATAVMSSLPQFTGLKATSSSPSPVQSMVSLQPMKPKGKRALSVRCDFIGSSTNLIMVTSTTLMLFAGRFGLAPSANRKATAGLKLEMRDSGLQTGDPAGFTLADTLACGTVGHIIGVGVVLGLKNIGAI

SEQ ID NO: 11490 - protein, 130 aa, Flaveria ramosissima
MATAVMSSLPQFTGLKAASSSPSPVQSMVSLQPMKPKGKRALSVRCDFIGSSTNLIMVTSTTLMLFAGRFGLAPSANRKATAGLKLEMRDSGLQTGDPAGFTLADTLACGTVGHIIGVGVVLGLKNIGAI

SEQ ID NO: 11491 - protein, 129 aa, Primula obconica
MAGVMSTIPQFSGLKATVSSTTSVQRLVAVQPMKRRGNGALGARCDFIGSPTNLIMVASTSLMLFAGRFGLAPSANRVATAGLKLETRDSGLQTGDPAGFTLADTLACGTVGHIIGVGVVLGLKNIGAL

SEQ ID NO: 11492 - protein, 129 aa, Primula obconica
MAGVMSTIPQFTGLKATVSSTTSVQRLVAVQPMKRRGNGALGARCDFIGSPTNLIMVASTSLMLFAGRFGLAPSANRVATAGLKLETRDSGLQTGDPAGFTLADTLACGTVGHIIGVGVVLGLKNIGAL

SEQ ID NO: 11493 - protein, 130 aa, Sesamum indicum
MATALMTSLPHFNGLKPQSPSLSPLKNLVAVQSMGRKGQGALGARCDFIGSPTNLIMVTSTSLMLFAGRFGLAPSANRKATAGLKLEARDSGLQTGDPAGFTLADTLACGVVGHIIGVGVVLGLKNIGAI

SEQ ID NO: 11494 - protein, 63 aa, Primula obconica
MKRRGNGALGARCDFIGSPTNLIMVASTSLMLFAGRFGLAPSANRVATAGPKARDKGFGVADW

SEQ ID NO: 11495 - protein, 133 aa, Catharanthus roseus
ASAIMTSLPQFNGLRPLTFSASPVQGLGQVGAQAQAVKHKGQGALGARCDFIGSPTNLIMVTSTSLMLFAGRFGLAPSANRKATAGLKLEIRDSGLQTGDPAGFTLADTLACGTVGHIIGVGVVLGLKNIGAL

SEQ ID NO: 11496 - protein, 135 aa, Arachis hypogaea
MATTMMTTLPQFNGLRPKFSAAPVQNLVAVQPMRRKGKGALGTRCDFIGSETNLIMVASTTLMLFAGRFGLAPSANRKATAGLKLEVRDSGLQTGDPAGFTLADTLACGTVGHIIGVGIVLGLKIRVPCKLKQEK

SEQ ID NO: 11497 - protein, 132 aa, Antirrhinum majus
MASTVMSSLSLPQFNGLKPQIAPVSPVKSFVAVKSMRGKGQGALGARCDFIGSPTNLIMVTSTSLMLFAGRFGLAPSANRKATAGLKLEVRDSGLQTGDPAGFTLADTLACGVVGHIIGVGVVLGLKNIGAI

SEQ ID NO: 11498 - protein, 132 aa, Cichorium intybus
MATALMSTLPQFTGLKATSPSSSPIKSIVALQPMKPKGKGKGALGVRCDFIGSSTNLIMVTSTTLMLFAGRFGLAPSANRKATAGLKLEARDSGLQTGDPAGFTLADTLACGTVGHIIGVGVVLGLKNIGAI

SEQ ID NO: 11499 - protein, 132 aa, Flaveria ramosissima
MATSVMSSLPQFTGLKAISSSPSTVQNMVALQPMKPKGKGKGALGVRCDFIGSSTNLIMVTSTTLMLFAGRFGLAPSANRKATAGLKLEVRDSGLQTGDPAGFTLADTLACGTVGHIIGVGVVLGLKNIGAI

SEQ ID NO: 11500 - protein, 130 aa, Populus trichocarpa
MAAAAMMTANTLPRFNGLRPSAVPVKSLAAVQPVRRKGNGALGARMDFIGSPTNLIMVTSTSLMLFAGRFGLAPSANRKATAGLKLEVRDSGLQTGDLAGFTLADTLACGAVGHIIGVGVVLGLKNMGAL

SEQ ID NO: 11501 - protein, 131 aa, Papaver somniferum
MASSSAVMTSLPQFSGLRSKPSAPRVDSLVSILPMKRKGNGALGARCDYIGSPTNLIMVTSTTLMLFAGRFGLAPSANRKATAGLKLEGRDSGLQTGDPAGFTLADTLACGSFGHIIGVGVVLGLKGIGAL

SEQ ID NO: 11502 - protein, 130 aa, Quercus alba
MATAVMTSLPQFNGLRPNLSAAPVKSMAAIQPMRRKGKGALGARCEGFIGSPTNLIIVTSTTLMLFAGRFGLAPSANRKSTAGLKLEVRNSGLQTGDPAGFTLADTLACGSLGHIIGVGVVLGLKNLGAL

SEQ ID NO: 11503 - protein, 130 aa, Quercus alba
MATAVMTSLPQFNGLRPNLSAAPVKSMAAILPMRRKGKGALGARCEGFIGSPTNLIIVTSTTLMLFAGRFGLAPSANRKSTAGLKLEVRNSGLQTGDPAGFTLADTLACGSLGHIIGVGVVLGLKNLGAL

SEQ ID NO: 11504 - protein, 131 aa, Camellia sinensis
MATAVMTSLPQFSGLRPKSSSSASPIQTLVAVQPMRRRGKGALGARCDFIGSPTNLIMVFSTSLMLFAGRLGLAPSANRKATAGLKLEIRESGLQTGDPAGFTLADTLACGSFGHIIGVGVVLGLKNIGAL

SEQ ID NO: 11505 - protein, 133 aa, Euphorbia peplus
MAASASLMTSLPQFNGLKPQLPAAASFKSLAAVQGSRRKGNGGALGARMDFIGSPTNLIMVTSTSLMLFAGRFGLAPSANRKATAGLKLEARDSGLQTGDPAGFTLADTLACGTVGHIIGVGVVLGLKNIGAF

SEQ ID NO: 11506 - protein, 104 aa, Quercus alba
MAAIQPMRRKGKGALGARCEGFIGSPTNLIIVTSTTLMLFAGRFGLAPSANRKSTAGLKLEVRNSGLQTGDPAGFTLADTLACGSLGHIIGVGVVLGLKNLGAL

SEQ ID NO: 11507 - protein, 130 aa, Flaveria ramosissima
MATAVMSSLPQFTGLKATSSSPSPVQSMVSLQPMKPKGKRALSVRCDFIGSSTNLIMVTSTTLMLFAGRFGLAPSANRKATAGLKLEMRDSGLQTGDPAGFTLADTLACGTVGHIIGVGVVLGLRTLVPS

SEQ ID NO: 11508 - protein, 125 aa, Flaveria ramosissima
MSSLPQFTGLKATSSSPSPVQSMVSLQPMKPKGKRALSVRCDFIGSSTNLIMVTSTTLMLFAGRFGLAPSANRKATAGLKLEMRDSGLQTGDPAGFTLADTLACGTVGHIIGVGVVLGLKNIGAI

SEQ ID NO: 11509 - protein, 130 aa, Flaveria ramosissima
MATAVMSSLPQFTGLKATSSSPSTVQSMVSLQPMKPKGKRALSVRCDFIGSSTNLIMVTSTTLMLFAGRFGLAPSANRKATAGLKLEMRDSGLQTGDPAGFTLADTLACGTVGHIIGVGVVLGLKNIGAI

SEQ ID NO: 11510 - protein, 104 aa, Flaveria ramosissima
MATALMSSLPQFTGLKATSSSPSPVQSMVSLQPMKPKGKRALSVRCDFIGSSTNLIMVTSTTLMLFAGRFGLAPSANRKATAGLKLEMRDSGLQNRRPCWLHTC

SEQ ID NO: 11511 - protein, 104 aa, Flaveria ramosissima
MATAVMSSLPQFTGLKATSSSPSPVQSMVSLQPMKPKGKRALSVRCDFIGSSTNLIMVTSTTLMLFAGRFGLATIGKQEGDRRAKARDEGLWASNRRPCWLHTC

SEQ ID NO: 11512 - protein, 143 aa, Flaveria ramosissima
FNDHEVRIGYEIGRTSCHVFSSSIHWFKGLLHHHLLQFKAWYHLQPMKPKGKRALSVRCDFIGSSTNLIMVTSTTLMLFAGRFGLAPSANRKATAGLKLEMRDSGLQTGDPAGFTLADTLACGTVGHIIGVGVVLGLKNIGAI

SEQ ID NO: 11513 - protein, 104 aa, Flaveria ramosissima
MATALMSSLPQFTGLKATSSSPSPVQSMVSLQPMKPKGKRALSVRCDFIGSSTNLIMVTSTTLMLFAGRFGLAPSANRKATAGLKLEMRDFWASNRRPCWLHTC

SEQ ID NO: 11514 - protein, 127 aa, Actinidia deliciosa
MATSMMTSLPQFTGLRPKLSPVKCMVGAQPMRRRGNGRLSVRCDFIGSSTNLIMVASTSLMLFAGRFGLAPSANRKATAGLKLENRDSGLQTGDPAGFTLADTLACGTVGHIIGVGVVLGLKNLGAI

SEQ ID NO: 11515 - protein, 130 aa, Olea europaea
MATAVITSLPQFSGLRLKPASASPVKSLVAAQPMKHKGQGALGARCDFIGSPTNLIMVTSTSLMLFAGRFGLAPSANRKGTAGLKLEVRDSGLQTGDPAGFTLADTLACGVVGHIIGVGVVIGLKNIGAI

SEQ ID NO: 11516 - protein, 95 aa, Primula obconica
MAGVMSTIPQFSGLKATVSSTTSVQRLVAVQPMKRRGNGALGARCDFIGSPTNLIMVASTSLMLFAGRFGLAPSANRVATAGLKLETRDSGVADW

SEQ ID NO: 11517 - protein, 627 aa, Brassica rapa
MLKPLLLLQSFLFCLFNVAFVGGRLIGGGYSAQENPFTPKASLVRYWNKEIRSDKSSIRSEFLISKASPLNAVESATFAKLAAQNSLPTRLPDFCSAANLFCFPDLSPSLEQHNADVKFSVYDQKNFTNYGNAAAGGTDSFKTYSKDGNVVTDSFRRYSRNAAGHDDKFTVYGDSSNVVEENFNSYGTFGTGGTGEFTNYQNGVNNPTSRFTAYSDGGNGKAQSFKTYTHEANAGDGQSFTSYGKNGNGVPNEFASYGVSANVIGSGFSNYGEKGNAANDSFTSYGSDGNVPQNNFKNYGASGNAASDTFANYRDKSNVGDDSFSSYAKDSNSGTAKFNNYGQSFNPGSETFTGYGKGAEGHKISFKTYTPNSTFKDYAKNGVGFAKYNVSSTSATLGDGKTVNKWIEPGKFFREASLKEGTVIPMPDIKDKMPKRSFLPRSIISKLPFSTSKLAEINKIFHAGENSTMEKIISDAVTECERSPSVGETKRCVGSAEDMIDFATSVLGRSVVLRTTENVAGSKQKVMIGKVNGINGGKVTKAVSCHQSLYPYLMYYCHSVPKVRVYEADLLDLKSKTKINHGIAICHMDTSSWGPKHGAFLALGSKPGLIEVCHWIFENDMNWAIAD

SEQ ID NO: 11518 - protein, 614 aa, Brassica napus
CLFNVAFVGGRLIGGGYSAQENPFTPKASLVRYWNKEIRSDKSSIRSEFLISKASPLNAVESATFAKLAAQNSLPTRLPDFCSAANLFCFPDLSPSLEQHNADVKFSVYDQKNFTNYGNAAAGGTDSFKTYSKDGNVVTDSFRRYSRNAAGHDDKFTVYGDSSNVVEENFNSYGTFGTGGTGEFTNYQNGVNNPTSRFTAYSDGGNGKAQSFKTYTHEANAGNGQSFTSYGKNGNGVPNEFASYGVSANVIGSGFSNYGEKGNAANDSFTSYGSDGNVPQNNFKNYGASGNAASDTFANYRDKSNVGDDSFSSYAKDSNSGTAKFTNYGQSFNPGSETFTGYGKGAEGHKISFKTYTPNSTFKDYAKNGVGFAKYNVSSTSATLGDGKTVNKWIEPGKFFREASLKEGTVIPMPDIKDKMPKRSFLPRSIISKLPFSTSKLAEINKIFHAGENSTMEKIISDAVTECERSPSVGETKRCVGSAEDMIDFATSVLGRSVVLRTTENVAGSKQKVVIGKVNGINGGKVTKAVSCHQSLYPYLMYYCHSVPKVRVYEADLLDLKSKTKINHGIAICHMDTSSWGPKHGAFLALGSKPGLIEVCHWIFENDMNWAIAD

SEQ ID NO: 11519 - protein, 611 aa, Brassica napus
NVAFVGGRLIGGGYSAQENPFTPKASLVRYWNKEIRSDKSSIRSEFLISKASPLNAVESATFAKLAAQNSLPTRLPDFCSAANLFCFPDLSPSLEQHNADVKFSVYDEKNFTNYGNAAAGGTDSFKTYSKDGNVVTDSFRRYSRNAAGHDDKFTVYGDSSNVVEENFNSYGTFGTGGTGEFTNYQNGVNNPTSRFTAYSDGGNGKAQSFKTYTHEANAGDGQSFTSYGKNGNGVPNEFASYGVSANVIGSGFSNYGEKGNAANDSFTSYGSDGNVPQNNFKNYGASGNAASDTFANYRDKSNVGDDSFSSYAKDSNSGTAKFTNYGQSFNPGSETFTGYGKGAEGHKISFKTYTPNSTFKDYAKNGVGFAKYNVSSTSATLGDGKTVNKWIEPGKFFREASLKEGTVIPMPDIKDKMPKRSFLPRSIISKLPFSTSKLAEINKIFHAGENSTMEKIISDAVTECERSPSVGETKRCVGSAEDMIDFATSVLGRSVVLRTTENVAGSKQKVVIGKVNGINGGKVTKAVSCHQSLYPYLMYYCHSVPKVRVYEADLLDLKSKTKINHGIAICHMDTSSWGPKHGAFLALGSKPGLIEVCHWIFENDMNWAIAD

SEQ ID NO: 11520 - protein, 610 aa, Brassica napus
VAFVGGRLIGGGFSAEENPFTPKASLVRYWNKEIRSDKSSLRSEFLISKASPLNAVESATFAKLAAQNSLPTRLPDFCSAANLFCFPDLSPSLEQHNADVKFSVYDQKNFTNYGNAAAGGADSFKTYSKDGNVVTDSFRRYSRNAAGHDDKFTVYGDSSNVVEENFNSYGTFGTGGTGEFTNYQNGVNNPTSRFTAYSDGGNGKAQSFKTYTHEANAGNGQSFTSYGKNGNGVPNEFASYGVSANVIGSGFSNYGEKGNAANDSFTSYGSDGNVPQNNFKNYGASGNAASDTFANYRDKSNVGDDSFSSYAKDSNSGTAKFTNYGQSFNPGSETFTGYGKGAEGHKISFKTYTPNSTFKDYAKNGVGFAKYNVSSTSATLGDGKTVNKWIEPGKFFREASLKEGTVIPMPDIKDKMPERSFLPRSIISKLPFSTSKLAEINKIFHAGENSTMEKIISDAVTECERSPSVGETKRCVGSAEDMIDFATSVLGRSVVLRTTENVAGSKQKVVIGKVNGINGGKVTKAVSCHQSLYPYLMYYCHSVPKVRVYEADLLDLKSKTKINHGIAICHIDTSSWGPKHGAFLALGSKPGLIEVCHWIFENDMNWAIAD

SEQ ID NO: 11521 - protein, 626 aa, Eutrema parvulum
MLKPLLLLQSFLFCLFNVVFVGGRLIGGGFSAEENPFTPKASLVRYWNKEIRGDKYLRSEFLISKASPLNAVDSATFAKLAAQNSLPTRLPDFCSAANLFCFPDLSPSLEKHNNDVKFSVYDQKNFTNYGNARAGGTDSFMTYSKEGNVVTDSFRRYSRGAAGHNEKFNVYSNNDNVVEENFNSYGTFGTGGAGDFTNYQNGVNNPTSRFTAYSDGGNGRSQTFKTYTHEANAGEGQSFTSYGKNGNGLPNEFASYGVSANVVGSGFSNYGEKGNAANDSFTSYGTDGNVPQNNFKNYGASGNAAVDTFANYRDKANVGDDSFSSYAKDSSSGKVKFTNYGQSFNPGSETFTGYGKGAEGHKVSFKTYTPNSTFKDYAKNGVGFSKYNVSSLSSTVGDGKTVNKWIEPGKFFRESTLKEGTVIPMPDIKDKMPKRSFLPRSIISKLPFATSKLGEIKRIFHAGENSTMEKIISDAVTECERSPSAGETKRCVGSAEDMIDFATSVLGRSVVLRTTENVAGSKQKVVIGKVNGINGGKLTKAVSCHQSLYPYLLYYCHSVPKVRVYEADILELNSKTKINHGIAICHMDTSSWGPNHGAFLALGSKPGRIEVCHWIFENDMNWAIAD

SEQ ID NO: 11522 - protein, 626 aa, Eutrema parvulum
MLKPLLLLQSFLFCLFNVVLVGGRLIGGGFSAEENPFTPKASLVRYWNKEIRSDKYLRSEFLISKASPLNAVDSATFAKLAAQNSLPTRLPDFCSAANLFCFPDLSPSLKKHNNDVKFSVYNQKNFTNYGNARAGGTDSFMTYSKEGNVVTDSFRRYSRGAAGHNEKFNVYSNNDNVVEENFNSYGTFGTGGAGDFTNYQNGVNNPTSRFTAYSDGGNGRSQTFKTYTHEANAGEGQSFTSYGKNGNGLPNEFASYGVSANVVGSGFSNYGEKGNAANDSFTSYGTDGNVPQNNFKNYGASGNAAVDTFANYRDKANVGDDSFSSYAKDSSSGKVKFTNYGQSFNPGSETFTGYGKGAEGHKVSFKTYTPNSTFKDYAKNGVGFSKYNVSSLSSTVGDGKTVNKWIEPGKFFRESTLKEGTVIPMPDIKDKMPKRSFLPRSIISKLPFATSKLGEIKRIFHAGDNSTMENIISDAVKECERPASVGETKRCVGSAEDMIDFATSVLGRSVVLRTTENVAGSKQKVVIGKVNGINGGKLTKAVSCHQSLYPYLLYYCHSVPKVRVYEADLLELNSKTKINHGIAICHMDTSSWGPTHGAFLALGSKPGRIEVCHWIFENDMNWAIAD

SEQ ID NO: 11523 - protein, 627 aa, Eutrema halophilum
MLKPLLLLQSFLFCLFNVVLVGGRLIGGGFSAEENPFTPKASLVRYWNKEIRSDKSLRSEFLISKASPLNAVDSATFAKLAAQNSLPTRLPDFCSAANLFCFPDLTPSLNKHDDDVKFSVYNQKNFTNYGNARAGGADSFKTYSKDGNVVTDSFRRYSRGAAGHDDKFTVYSDNSNVVEENFNSYGTFGTGGAGEFTNYQNGVNNPTSRFTAYSDGGNGRSQSFNSYTHEANAGNGQSFTSYGKNGNGLPNSFSSYGVSANVIGSGFSNYGEKGNAANDSFTNYGNDGNVPQNNFKNYGASGNAAVDTFSNYRDKANVGDDSFSSYAKDSNSGKVNFVNYGQSFNPGSESFTGYGKGAEGHKIGFKTYTPNSTFKDYAKNGVGFSKYNVSSFSAATVGDGKTVNKWIEPGKFFRESTLKEGTVIPMPDIRDKMPKRSFLPRSIISKLPFSTSKIGEIKRIFHAGDNSTMENIISDAVKECERPASVGETKRCVGSAEDMIDFATSVLGRSVVLRTTENVAGSKQKVVIGKVNGINGGKLTKAVSCHQSLYPYLLYYCHSVPKVRVYEADLLELNSKTKINHGIAICHMDTSSWGPTHGAFLALGSKPGRIEVCHWIFENDMNWAIAD

SEQ ID NO: 11524 - protein, 626 aa, Arabidopsis lyrata
MLKQFLLLQSFSFFLFNVVIVGGKLIGGGFSAEENPFTPKASLVRYWNKEIRGESPRSEFLISKASPLNAVDSATFSKLAAANSLPTRFPDFCSAANLFCFPDLGASLEKHDDDVKFSVYDQKNFTNYGNARAGGADSFKNYSRDGNVVTDSFRRYSRNAAGHDDKFTVYGDNSNVVEEGFNSYGTFGTGGAGVFTNYQNNVNNPTSRFTAYSDGGNGRSQSFKTYTHDANAGNGQSFSSYGKNGNGAPNEFASYGVSSNVIGSGFSNYGESGNAANDTFTSYGSDGNVPQNNFKNYGASGNAAVDTFANYRDKANVGDDSFSSYAKDSNSEKVNFVNYGQSFNPGSETFTGYGKGAEGNKISFKTYTPNSTFKDYTKNGVAFAKYNASTITANTVGDGKTVNKWIEPGKFFRESSLKEGTVIPMPDIKDKMPKRSFLPRSIITKLPFSTSKLGEIKRIFHAGENSTMEGIITDAVTECERPPSVGETKRCVGSAEDMIDFATSVLGRSVVLRTTENVAGSKQKVVIGKVNGINGGKLTKAVSCHQSLYPYLLYYCHSVPKVRVYEADLLELNSKKKINHGIAICHMDTSSWGPSHGAFLALGSKPGRIEVCHWIFENDMNWAIAD

SEQ ID NO: 11525 - protein, 626 aa, Arabidopsis thaliana
MLKQFLLLQSFSFFLFNVVIVGGRTFGGGFSAEENPFTPKASLVRYWNKEIRGQSPRSEFLISKASPLNAVDSATFSKLAAANSLPTRFPDFCSAANLFCFPDLGASLEKHDDDVKFSVYDQKNFTNYGNARAGGADSFKNYSKDGNVVTDSFRRYSRNAAGHDDKFTVYGENSNVVEEGFNSYGTFGTGGAGDFTNYQNNVNNPTSRFTAYSDGGNGRSQTFKTYTHEANAGNGQSFTSYGKNGNGVPNEFTSYGVSSNVIGSGFSNYGESGNAANDTFTSYGSDGNVPQNNFNNYGASGNAAVDTFANYRDKANVGDDSFSSYAKDSNSEKVNFVNYGQSFNPGSETFTGYGKGAEGSKLSFKTYTPNSTFKDYAKKGVAFAKYNVSTTTANTVGDGKTVNKWIEPGKFFRESSLKEGTVIPMPDIKDKMPKRSFLPRSIITKLPFSTSKLGEIKRIFHAVENSTMGGIITDAVTECERPPSVGETKRCVGSAEDMIDFATSVLGRSVVLRTTENVAGSKEKVVIGKVNGINGGKLTKAVSCHQSLYPYLLYYCHSVPKVRVYEADLLELNSKKKINHGIAICHMDTSSWGPSHGAFLALGSKPGRIEVCHWIFENDMNWAIAD

SEQ ID NO: 11526 - protein, 82 aa, Brassica napus
MQNEEGQITELYVPRKCSATNRMITSKDHASVQLNIGHLDADGIYTGQFTTFALCGFVRAQGDADSGVDRLWQKQKVEAKQI

SEQ ID NO: 11527 - protein, 82 aa, Raphanus sativus
MQNEEGQITELYVPRKCSATNRMITSKDHASVQLNIGHLDADGVYTGQFTTFALCGFVRAQGDADSGVDRLWQKKKVEAKQI

SEQ ID NO: 11528 - protein, 82 aa, Raphanus sativus
MQNEEGQITELYVPRKCSATNRMITSKDHASVQLNIGHLDADGIYTGQFTTFALCGFVRAQGDADSGVDRLWQKKKVEAKQF

SEQ ID NO: 11529 - protein, 82 aa, Brassica juncea
MQNEEGQTTELYIPRKCSATNRMITSKDHASVQLNIGHLDADGIYTGQFTTFALCGFVRAQGDADSGVDRLWQKKKVEAKQI

SEQ ID NO: 11530 - protein, 164 aa, Brassica juncea
MYVRALPTTDVNRNTEWFTYPGVWTTYILILFFSWLLVLSIFNCSPGMAWTIVHLAHFSVTYHLFHWKKGTPFGDDQGIYNRLTWWEQIDNGKQLTRNRKFLTLVPVVLYLIASHTTDYQNPMLFLNTLAVFIMVVAKFPHMHKVRIFGINAERRGSGHGTLHS

SEQ ID NO: 11531 - protein, 82 aa, Unknown
  Sequence found in Organisms: Brassica napus, Brassica juncea, Brassica rapa, Raphanus sativus
MQNEEGQVTELYIPRKCSATNRMITSKDHASVQLNIGHLDADGIYTGQFTTLALCGFVRAQGDADSGVDRLWQKKKVEAKQI

SEQ ID NO: 11532 - protein, 81 aa, Eutrema halophilum
MQNEEGQITELYIPRKCSATNRLITSKDHASVQLNIGHLDADGIYTGQFTTFALCGFVRAQGDADSGVDRLWQKKKVEAKQ

SEQ ID NO: 11533 - protein, 81 aa, Brassica oleracea
QNEEGQVTELYIPRKCSATNRMITSKDHASVQLNIGHLDADGIYTGQFTTLALCGFVRAQGDADSGVDRLWQKKKVEAKQI

SEQ ID NO: 11534 - protein, 81 aa, Brassica napus
MQNEEGQVTELYIPRKCSATNRMITSKDHASVQLNIGHLDADGIYTGQFTTLALCGFVRAQGDADSGVDRLWQKKVEAKQI

SEQ ID NO: 11535 - protein, 82 aa, Raphanus sativus
MQNEEGQVTELYIPRKCSATNRMITSKDHASVQLNIGHLDADGIYTGQFTTLALCGFVRAQGDADSGVDRLWQKKKVEAKQL

SEQ ID NO: 11536 - protein, 82 aa, Unknown
  Sequence found in Organisms: Eutrema halophilum, Eutrema parvulum
MQNEEGQITELYIPRKCSATNRLITSKDHASVQLNIGHLDADGIYTGQFTTFALCGFVRAQGDADSGVDRLWQKKKVETKQQ

SEQ ID NO: 11537 - protein, 82 aa, Eutrema parvulum
MQNEEGQITELYIPRKCSATNRLITSKDHASVQLNVGHLDADGIYTGQFSTFALCGFVRAQGDADSGVDRLWQKKKVEAKQI

SEQ ID NO: 11538 - protein, 82 aa, Arabidopsis thaliana
MQNEEGQVTELYIPRKCSATNRLITSKDHASVQLNIGHLDANGLYTGQFTTFALCGFVRAQGDADSGVDRLWQKKKVEAKQN

SEQ ID NO: 11539 - protein, 82 aa, Arabidopsis lyrata
MQNEEGQTTELYIPRKCSATNRLITSKDHASVQLNIGHLDANGVYTGQFTTFALCGFVRAQGDADSGVDRLWQKKKVEAKQN

SEQ ID NO: 11540 - protein, 82 aa, Brassica juncea
MQNEEGQVTELYIPRKCSATNRMITSKDHASVQLNIGHLDADGVYTGQFTTLALCGFVRAQGDAGSGVDRLWQKKKVEAKQM

SEQ ID NO: 11541 - protein, 82 aa, Unknown
  Sequence found in Organisms: Brassica juncea, Raphanus sativus
MQNEEGVVTELYIPRKCSATNRLITSKDHASVQLNIGHLDADGIYTGQFTTLALCGFVRAQGDADSGVDRLWQKKKVEAKQQ

SEQ ID NO: 11542 - protein, 82 aa, Eutrema parvulum
MQNEEGVVTELYIPRKCSATNRLITSKDHASVQLNIGHLDADGIYTGQFTTFALCGFVRAQGDADSGVDRLWQKKKVETKQQ

SEQ ID NO: 11543 - protein, 82 aa, Unknown
  Sequence found in Organisms: Eutrema halophilum, Eutrema parvulum
MQNEEGQITELYIPRKCSATNRLITSKDHASVQLNIGHLGPDGVYTGQFTTFALCGFVRAQGDADSGVDRLWQKKKVETKQQ

SEQ ID NO: 11544 - protein, 82 aa, Arabidopsis lyrata
MENEEGKITELYIPRKCSATNRLITSKDHASVQLNIGHLDANGVYTGQFTTFALCGFVRAQGDADSGVDRLWQKKKVEAKQQ

SEQ ID NO: 11545 - protein, 82 aa, Unknown
  Sequence found in Organisms: Brassica napus, Brassica juncea, Brassica oleracea, Brassica rapa, Raphanus sativus
MQNEEGVVTELYIPRKCSATNRLITSKDHASVQLNIGHLDADGIYTGQFTTLALCGFVRAQGDADSGVDRLWQKKKVETKQQ

SEQ ID NO: 11546 - protein, 82 aa, Unknown
  Sequence found in Organisms: Brassica napus, Brassica juncea, Brassica oleracea, Brassica rapa
MQNEEGVVTELYIPRKCSATNRLITSKDHASVQLNIGHLDADGIYTGQFTTLALCGFVRAQGDADSGVDRLWQKKKVETKQL

SEQ ID NO: 11547 - protein, 82 aa, Unknown
  Sequence found in Organisms: Cleome gynandra, Cleome spinosa
MQNEEGQITELYIPRKCSATNRLITSKDHASVQINIGHLDADGIYTGQFTTFALCGFVRAQGDADSAIDRLWQKKKVEARQQ

SEQ ID NO: 11548 - protein, 81 aa, Cleome spinosa
MQNEEGQITELYIPRKCSATNRLITSKDHASVQINIGHLDADGIYTGQFTTFALCGFVRAQGDADSAIDRLWQKKKVEARQ

SEQ ID NO: 11549 - protein, 82 aa, Raphanus sativus
MQNEEGVVTELYIPRKCSATNRLITSKDHASVQLNIGHLDADGIYTAQFTTLALCGFVRAQGDADSGVDRLWQKKKVEAKQQ

SEQ ID NO: 11550 - protein, 82 aa, Raphanus sativus
  misc_feature (79)..(79): Xaa can be any naturally occurring amino acid
MQNEEGVVTELYIPRKCSATNRLITSKDHASVQLNIGHLDADGIYTGQFTTLALCGFVRAQGDADSGVDRLWQKKKVEXKQQ

SEQ ID NO: 11551 - protein, 81 aa, Brassica rapa
MPMVSTLASSPLLLSADSSVLRETQTVASTGSGRRRKSKPNNSEIDRDIESISCCYLLFLACFIEFSLSANSYLCFLIYEK

SEQ ID NO: 11552 - protein, 82 aa, Arabidopsis thaliana
MENDAGQVTELYIPRKCSATNRMITSKDHASVQLNIGHLDANGLYTGQFTTFALCGFVRAQGDADSGVDRLWQKKKVEAKQQ

SEQ ID NO: 11553 - protein, 82 aa, Brassica juncea
MQNEEGVVTELYIPRKCSATNRLITSKDHASVQLNIGHLDADGIYTGQFTTLALCGFVRAQGDADSGVDRLWQKTKVETKQQ

SEQ ID NO: 11554 - protein, 82 aa, Cleome spinosa
MQNEEGQITELYIPRKCSATNRLITSKDHASVQINIGHLDADGIYTGQFTTFALCGFVRAQGDADSAIDRLWQKKKVETRQQ

SEQ ID NO: 11555 - protein, 73 aa, Elaeis guineensis
MLQFSLTLVILMLMVSTLANSPLLLSADLSVLRETQTVAWTGSGRRRRSKLNNSERQSDNVISSCLFFEVSIY

SEQ ID NO: 11556 - protein, 82 aa, Brassica juncea
MQNEEGVVTELYIPRKCSATNRLITSKDHASVQLNIGHLDADGIYTGQFTTLALCGFVRAQGDADSGVDRLWQKTKLETKQQ

SEQ ID NO: 11557 - protein, 82 aa, Cleome spinosa
MQNEEGQITELYIPRKCSATNRLITSKDHASVQINIGHLDADGIYTGQFTTFALCGFVRAQGDADSAIDRLWQKKKAETRQQ

SEQ ID NO: 11558 - protein, 82 aa, Cleome spinosa
MQNEEGQITELYIPRKCSATNRLITSKDHASVQINIGHLDSDGIYTGQFSTFALCGFIRAQGDADSAIDRLWQKKKVEARQQ

SEQ ID NO: 11559 - protein, 85 aa, Brassica rapa
LLKIQNEEGQITELYIPRKCSATNRLVTSKDHASVQLNIGHLDADGIYTGQFTTLALCGFVRAQGDADSGVDRLWQKKEVETKQH

SEQ ID NO: 11560 - protein, 82 aa, Rosa hybrid cultivar
MQNEEGQITELYIPRKCSATNRLITSKDHASVQINIGHLDENGIYTGQFSTFALCGYVRAQGDADSGLDRLWQKKKAEVKQQ

SEQ ID NO: 11561 - protein, 82 aa, Brassica napus
MQNEEGVVTELYIPRKCSATNRLITSKDHASVQLNIGHLDADGIYTGQVPPLLLSADSSVLRETQTVASTGSGRRRSRNQQQ

SEQ ID NO: 11562 - protein, 81 aa, Abies balsamea
MQNEEGQNVDLYIPRKCSATNRLITSKDHASVQLNIGHLDENGIYTGQFTTFALSGFVRAQGDADSGVDRLWQKKKAELGQ

SEQ ID NO: 11563 - protein, 82 aa, Unknown
  Sequence found in Organisms: Cannabis sativa, Humulus lupulus
MQNDEGVITELYIPRKCSATNRLITSKDHASVQINIGHLDENGVYTGQFSTFALCGFVRAQGDADSGIDRLWQKKKVEVKQQ

SEQ ID NO: 11564 - protein, 82 aa, Tropaeolum majus
MQNEEGQNMDLYIPRKCSATNRLITSKDHASVQINIGHLDADGVYTGQFTTFALCGFIRAQGDADSGIDRLWQKKKVEVRQQ

SEQ ID NO: 11565 - protein, 82 aa, Prunus mume
MQNEEGQITELYIPRKCSATNRLITSKDHASVQINIGHLDENGIYTGQFSTFALCGYVRAQGEADSGLDRLWQKKKSEVKQQ

SEQ ID NO: 11566 - protein, 81 aa, Prunus persica
MQNEEGQITELYIPRKCSATNRLITSKDHASVQINIGHLDENGIYTGQFSTFALCGYVRAQGEADSGLDRLWQKKKSEVKQ

SEQ ID NO: 11567 - protein, 81 aa, Picea glauca
MQNEEGQNIDLYIPRKCSATNRLITSKDHASVQLNIGHLDENGIYTGQFTTFALSGFVRAQGDADSGIDRLWQKKKVELGQ

SEQ ID NO: 11568 - protein, 82 aa, Fragaria vesca
MQNEEGQITELYIPRKCSATNRLITSKDHASVQINIGHLDENGNYTGQFSTFALCGYVRAQGDADSGLDRLWQKKKAEVKQQ

SEQ ID NO: 11569 - protein, 82 aa, Citrullus lanatus
MQNEEGKITELYIPRKCSATNRLITSKDHASVQINIGHLDENGIYTGQFSTFALCGFIRAQGDADSGLDRLWQKKKVEVRQQ

SEQ ID NO: 11570 - protein, 90 aa, Tropaeolum majus
MQNEEGQNMDLYIPRKCSATNRLITSKDHASVQINIGHLDADGVYTGQFTTFALCGFIRAQGDADSGIDRLWQKKRLRLDNSERKPFEFR

SEQ ID NO: 11571 - protein, 64 aa, Picea glauca
MQNEEGQNIDLYIPRKCSATNRLITSKDHASVTIKYRASGREWNIHGPVHDLCSLRLCPSTGRC

SEQ ID NO: 11572 - protein, 82 aa, Manihot esculenta
MQNEEGQNMDLYIPRKCSATNRLITSKDHASVQLNIGHLDANGHYTGQFTTFALSGFVRAQGDADSALDRLWQKKKVEHRQQ

SEQ ID NO: 11573 - protein, 82 aa, Unknown
  Sequence found in Organisms: Ricinus communis, Hevea brasiliensis
MQNEEGQNMDLYIPRKCSATNRLITSKDHASVQINIGHLDANGHYTGQFTTFALCGFVRAQGDADSALDRLWQKKKVELRQQ

SEQ ID NO: 11574 - protein, 81 aa, Cedrus atlantica
MQNEEGQNVDLYIPRKCSATNRLITSKDHASVQLNIGHLDENGIYTGQFTTFALSGFVRAQGDADSAIDRLWQKKKVELGQ

SEQ ID NO: 11575 - protein, 82 aa, Humulus lupulus
MQNDEGVITELYIPRKCSATNRLITSKDHASVQINIGHLDENGVYTGQFSTFALCGFIRAQGDADSGIDRLWQKKKVEVKQQ

SEQ ID NO: 11576 - protein, 81 aa, Unknown
  Sequence found in Organisms: Pinus pinaster, Pinus taeda
MQNEEGQNIDLYIPRKCSATNRLITSKDHASVQLNIGHLDENGIYTGQFTTFALSGFVRAQGDADSAFDRLWQKKKVELGQ

SEQ ID NO: 11577 - protein, 82 aa, Cucumis melo
MQNEEGKITELYIPRKCSATNRLITSKDHASVQINIGHLDENGIYTGQFSTFALCGFIRAQGDADSALDRLWQKKKVEVRQQ

SEQ ID NO: 11578 - protein, 82 aa, Tropaeolum majus
MQNEEGQNMDLYIPRKCSATNRLITSKDHASVQINIGHLDSDGVYTGQFTTFALCGFIRAQGDADSGIDRLWQKKKVEVRQQ

SEQ ID NO: 11579 - protein, 82 aa, Cajanus cajan
MQNEEGQITELYIPRKCSATNRLITAKDHASVQINIGHLDENGVYNGQFSTFALCGFIRAQGDADSALDRLWQKKKVEAKQQ

SEQ ID NO: 11580 - protein, 82 aa, Populus trichocarpa
MQNEEGQNMDLYIPRKCSATNRLITSKDHASVQINIGHLDASGHYTGQFTTFALCGFVRAQGDADSAVDRLWQKKKTELRQQ

SEQ ID NO: 11581 - protein, 82 aa, Prunus persica
MQNEEGVITELYIPRKCSATNRLITSKDHASVQINVGHLDENGIYTGQFSTFALCGYVRAQGDADSGLDRLWQKKKDEVKQH

SEQ ID NO: 11582 - protein, 258 aa, Malus domestica
MDSSSSGSTKLDYFDDTWKLQSTATLLSVSKGEDGRTALVLDRTIFYPQGGGQPADTGFIAASDSGVKFVVEDVRSRDGIVYHYGFIENSGEESESKFEKGKEVLLCVDESRRRLNARLHSAGHLLDTCMRNMGLGDLEPTKGYHFPQGPYVEYKGTVPQKDTESKRKELEVEANALISRGGKVSAALLPYEEACKLCGDCLPDYIAKDSTPRIVKLGDSLGCPCGGTHVSDISEIKSITVTQVRTKKGSTKVFYNIG

SEQ ID NO: 11583 - protein, 90 aa, Euphorbia peplus
MQNEEGKITELYIPRKCSATNRLITSKDHASVQINIGHLDENGIYTGQFSTFALCGFIRAQGDADSALDRLWQKKKAEVRQHRKWKFSST

SEQ ID NO: 11584 - protein, 81 aa, Panax ginseng
MQNEEGQNMDLYIPRKCSATNRLITSKDHASVQINIGHLDERGIYTGQFSTFALCGFIRAQGDADSALDRLWQKKKVEARQ

SEQ ID NO: 11585 - protein, 81 aa, Medicago truncatula
MQNEEGQITELYIPRKCSATNRLITAKDHASVQLNIGHLDESGVYNGHFSTFALCGFTRAQGDADSGIDRLWQKKKTELKQ

SEQ ID NO: 11586 - protein, 81 aa, Abies balsamea
MQNEEGQNVDLYIPRKCSATNRLITSKDHASVQLNIGHLDENGVYTGQFTTFALSGFVRAQGDADSGIDRLWQKKKIELSQ

SEQ ID NO: 11587 - protein, 81 aa, Amborella trichopoda
MQNEEGQNMDLYIPRKCSATNRLITSKDHASVQINIGHVDEDGIYRGQFTTFALCGFVRAQGDADSAVDRLWQKKKAELRQ

SEQ ID NO: 11588 - protein, 81 aa, Malus domestica
MQNEEGIITELYIPRKCSATNRLITSKDHASVQINIGHLDEHGIYTGQCSTFALCGYVRAQGEADSGLDRLWQKKKTEVKQ

SEQ ID NO: 11589 - protein, 70 aa, Brassica oleracea
VPRKCSATNRLITSKDHASVQLNIGHLDADGIYTGQFTTFALCGFVRAQGDADSGVDRLWQKQKVEAKQI

SEQ ID NO: 11590 - protein, 82 aa, Cannabis sativa
MQNDEGVITELYIPRKCSATNRLITSKDHASVQVNIGHLDENGVYTGQFTTYALCGFVRAQGDADSAIDRLWQKKKSEVKQQ

SEQ ID NO: 11591 - protein, 82 aa, Catharanthus roseus
MQNEEGQNMDLYIPRKCSATNRLITSKDHASIQMNIGHLDANGLYTGQFTTFALCGFVRAQGDADSALDRLWQKKKVELRQQ

SEQ ID NO: 11592 - protein, 82 aa, Vigna unguiculata
MQNEEGQITELYIPRKCSATNRLITAKDHASVQINIGHVDENGIYNGQFSTFALCGFIRAQGDADSALDRLWQKKKVEVKQQ

SEQ ID NO: 11593 - protein, 82 aa, Unknown
  Sequence found in Organisms: Cucumis sativus, Citrullus lanatus
MQNEEGKITELYIPRKCSATNRLITSKDHASVQINIGHLDENGIYTGQFSTFALCGFIRAQGDADSALDRLWQKKKAEVRQQ

SEQ ID NO: 11594 - protein, 81 aa, Euphorbia peplus
MQNEEGQNMDLYIPRKCSATNRLITSKDHASVQINIGHLDANGHYTGQYTTFALCGFVRAQGDADSALDRLWQKKKVELRQ

SEQ ID NO: 11595 - protein, 81 aa, Flaveria ramosissima
MQNEEGQNMDLYIPRKCSATNRLITSKDHASVQINIGHLDESGRYTGQFSTFALCGFVRAQGDADSALDRLWQKKKVEARQ

SEQ ID NO: 11596 - protein, 81 aa, Lactuca sativa
MQNEEGQNMDLYIPRKCSATNRLITSKDHASVQINVGHLDESGRYTGQFSTFALCGFVRAQGDADSALDRLWQKKKVEAKQ

SEQ ID NO: 11597 - protein, 82 aa, Glycyrrhiza uralensis
MQNEEGQITELYIPRKCSATNRLITSKDHASVQINIGHLDESGVYNGHFSTFALCGFVRAQGDGDSALDRLWQKKKVETKQQ

SEQ ID NO: 11598 - protein, 81 aa, Medicago truncatula
MQNEEGQITELYIPRKCSATNRLITAKDHASVQLNIGHLDESGVYNGHFSTFALCGFTRAQGDADSGIDRLWQKKKAEIKQ

SEQ ID NO: 11599 - protein, 82 aa, Momordica charantia
MQNEEGKITELYIPRKCSATNRLITSKDHASVQINIGHVDENGIYTGQFSTFALCGFIRAQGDADSALDRLWQKKKVEVRQQ

SEQ ID NO: 11600 - protein, 82 aa, Carica papaya
MQNEDGQNMDLYIPRKCSATNRLITAKDHASVQINVGHLDADGVYTGQFTTFALCGFVRAQGDADSALDRLWQKKKVEARQQ

SEQ ID NO: 11601 - protein, 82 aa, Prunus mume
MQNEEGVITELYIPRKCSATNRLITSKDHASVQINVGHLDENGIYTGQFSTFALCGYVRAQGDADGGLDRLWQKKKAEVKQH

SEQ ID NO: 11602 - protein, 82 aa, Salvia sclarea
MQNEEGQNMDLYIPRKCSATNRLITSKDHASVQLNIGHVDERGIYTGQFSTFALCGFIRAQGDADSALDRLWQKKKVEARQQ

SEQ ID NO: 11603 - protein, 82 aa, Fragaria vesca
MQNEEGVITELYIPRKCSATNRLITSKDHASVQINIGHLDENGFYIGQFSTFALCGYVRAQGDADSGLDRLWQKKKVEVRQQ

SEQ ID NO: 11604 - protein, 90 aa, Euphorbia esula
  misc_feature (24)..(24): Xaa can be any naturally occurring amino acid
MQNEEGKITELYIPRKCSATNRLXTSKDHASVQINIGHLDENGIYTGQFSTFALCGFIRAQGDADSALDRLWQKKKAEVRQHRKWKFSST

SEQ ID NO: 11605 - protein, 98 aa, Camellia sinensis
MQNEEGQNMDLYIPRKCSATNRLITAKDHASVQINVGHLDEAGCYTGQFTTFALCGFVRAREMLTVLLIGSGRRRKLKPDNSDSHCQFFVFLIRTLEF

SEQ ID NO: 11606 - protein, 81 aa, Echinacea purpurea
MQNEEGQNMDLYIPRKCSATNRLITSKDHASVQINIGHLDESGRYTGQFSTFALCGFVRAQGDADSALDRLWQKKKVEIRQ

SEQ ID NO: 11607 - protein, 81 aa, Panax ginseng
MQNEEGQNMDLYIPRKCSATNRLITSKDHASVQINVGHLDERGIYTGQFSTFALCGFIRAQGDADSALDRLWQKKKVEARQ

SEQ ID NO: 11608 - protein, 82 aa, Lupinus angustifolius
MQNDEGQITELYIPRKCSATNRLITSKDHASVQINIGHLDESGVYNGNFTTVALSGFVRAQGDADSSVDRLWTKKKVEVKQQ

SEQ ID NO: 11609 - protein, 81 aa, Medicago truncatula
MQNEEGQITELYIPRKCSATNRLITAKDHASVQINVGHLDESGVYNGQFSTFALCGFTRAQGDADSGIDRLWQKKKAEIKQ

SEQ ID NO: 11610 - protein, 82 aa, Malus domestica
MQNEEGIITELYIPRKCSATNRLITSKDHASVQINVGHLDEHGIYTGQFSTFALCGYVRAQGEADGGLDRLWQKKKTEVKQQ

SEQ ID NO: 11611 - protein, 82 aa, Persea americana
MQNEEGQNMDLYIPRKCSATNRLITSKDHASVQINIGHLDESGIYTGHFTTFALCGFVRAQGDADGAVDRLWQKKKAELRQQ

SEQ ID NO: 11612 - protein, 72 aa, Brassica juncea
MQNEEGVVTELYIPRKCSATNRLITSKDHASVQLNIGHLDADGIYTGQFTTLALCGFVRAQGDADSGVDRLW

SEQ ID NO: 11613 - protein, 81 aa, Manihot esculenta
MQNEEGQNMDLYIPRKCSATNRLITSKDHASVQINIGHLDANGHYTGQFSTFALCGFVRAQGDADSALDRLWQKKKAELRQ

SEQ ID NO: 11614 - protein, 82 aa, Chelidonium majus
MMNEEGQNMDLYIPRKCSATNRLITSKDHASVQLNIGHVDENGIYNGQFSTFALCGFVRAQGDADSAIDRLWQKKKVEARQQ

SEQ ID NO: 11615 - protein, 81 aa, Cicer arietinum
MQNEDGQITELYIPRKCSATNRLITAKDHASVQINIGHLDESGVYNGHFSTFALCGYVRAQGDADSGLDRLWQKKKVELKQ

SEQ ID NO: 11616 - protein, 82 aa, Unknown
  Sequence found in Organisms: Citrus clementina, Citrus sinensis
MQNEEGQNMDLYIPRKCSATNRLITSKDHAAVQINIGHVDADGIYTGQFSTFALCGFVRAQGDGDSAIDRLWQKKKVEVRQQ

SEQ ID NO: 11617 - protein, 82 aa, Citrus clementina
MQNEEGQNMDLYIPRKCSATNRLITSKDHAAVQINIGHLDADGIYTGQFSTFALCGFVRAQGDGDSALDRLWQKKKAEVRQQ

SEQ ID NO: 11618 - protein, 82 aa, Coffea canephora
MQNEEGQNMDLYIPRKCSATNRLITSKDHASVQVNVGHLDERGIYTGNFSTFALCGFVRAQGDADSALDRLWQKKKVEARQQ

SEQ ID NO: 11619 - protein, 82 aa, Cucumis sativus
MQNEEGKITELYIPRKCSATNPLITSKDHVSVQINIGHLDENGIYTGQFSTFALCGFIRAQGDADSALDRLWQKKKVEVRQQ

SEQ ID NO: 11620 - protein, 82 aa, Cucurbita pepo
MQNEEGKITELYIPRKCSATNRLITSKDHASVQINVGHLDENGIYTGQFSTFALCGYIRAQGDADSAIDRLWQKKKVEVRQQ

SEQ ID NO: 11621 - protein, 82 aa, Cucurbita pepo
MQNEEGKITELYIPRKCSATNRLITSKDHASVQINVGHLDENGIYTGQFSTFALCGYIRAQGDADSALDRLWQKKKVEVRQQ

SEQ ID NO: 11622 - protein, 82 aa, Cucurbita pepo
MQNEEGKITELYIPRKCSATNRLITSKDHASVQINVGHLDDNGIYTGQFSTFALCGFIRAQGDADSALDRLWHKKKVEVHQQ

SEQ ID NO: 11623 - protein, 82 aa, Solanum melongena
MQNEEGQNMDLYIPRKCSATNRLITSKDHASVQLNVGHLDDRGVYTGSFTTFALCGFIRAQGDADSALDRLWQKKKVEARQE

SEQ ID NO: 11624 - protein, 82 aa, Eschscholzia californica
MQNEEGQNMDLYIPRKCSATNRLITSKDHASVQLNIGHLDENGIYTGQFSTFALCGFVRAQGDADSAIDRLWQKQKAEVGQQ

SEQ ID NO: 11625 - protein, 82 aa, Eschscholzia californica
MQNEEGQNMDLYIPRKCSATNRLITSKDHASVQLNIGHLDENGIYTGSFSTFALCGFVRAQGDADSAIDRLWQKTKVEVRQQ

SEQ ID NO: 11626 - protein, 82 aa, Eschscholzia californica
MQNEEGQNMDLYIPRKCSATNRLITSKDHASVQLNIGHLDENGIYTGTFSTFALCGFVRAQGDADSAIDRLWQKTKVEVQQQ

SEQ ID NO: 11627 - protein, 81 aa, Euphorbia peplus
MQNEEGQNMDLYIPRKCSATNRLITSKDHASVQMNIGHLDANGHYTGQFSTFALCGFVRAQGDADSALDRLWQKKKTELRQ

SEQ ID NO: 11628 - protein, 81 aa, Unknown
  Sequence found in Organisms: Euphorbia peplus, Euphorbia esula
MQNEEGQNMDLYIPRKCSATNRLITSKDHASVQINIGHLDANGLYTGQFSTFALCGFVRAQGDADSALDRLWQKKKTELRQ

SEQ ID NO: 11629 - protein, 81 aa, Flaveria ramosissima
MQNEEGQNMDLYIPRKCSATNRLITSKDHASVQINIGHLDESGRYTSQFSTFALCGFVRAQGDADSALDRLWQKKKVEARQ

SEQ ID NO: 11630 - protein, 81 aa, Flaveria ramosissima
MQNEEGQSMDLYIPRKCSATNRLITSKDHASVQINVGHLDESGRYTGQFSTFALCGFVRAQGDADSALDRLWQKKKVEARQ

SEQ ID NO: 11631 - protein, 81 aa, Linum usitatissimum
MQNEEGQNVDLYIPRKCSATNRLITSKDHASVQINVGHLDANGRYTGQFTTFALCGFVRAQGDGDSGLDRLWQKKKAELRQ

SEQ ID NO: 11632 - protein, 82 aa, Vitis vinifera
MQNEEGQNMDLYIPRKCSATNRLITSKDHASVQINIGHLDESGTYTGQFTTFALCGFVRAQGDADSALDRLWQKKKAEVRQQ

SEQ ID NO: 11633 - protein, 82 aa, Jatropha curcas
MQNDEGQNMDLYIPRKCSATNRLITSKDHASVQINIGHLDANGNYTGQFTTFALCGFVRAQGDADSALDRLWLKKKVELRQQ

SEQ ID NO: 11634 - protein, 82 aa, Momordica charantia
MQNEEGKITELYIPRKCSATNRLITSKDHASVQINIGHVDENGIYTGQFSTFALCGFIRAQGDADSALDRLWQKKKAEVRQQ

SEQ ID NO: 11635 - protein, 81 aa, Nuphar advena
MQNEEGQYMDLYIPRKCSATNRLITSKDHASVQINLGHLDENGIYTGQFTTFALCGFVRAQGDADSALDRLWQKKKAEIRQ

SEQ ID NO: 11636 - protein, 82 aa, Capsicum annuum
MQNEEGQNMDLYIPRKCSATNRLITSKDHASVQLNVGHLDDRGVYTGTFTTFALCGFIRAQGDADSALDRLWQKKKVEARQE

SEQ ID NO: 11637 - protein, 82 aa, Unknown
  Sequence found in Organisms: Solanum tuberosum, Solanum phureja
MQNDEGQNMDLYIPRKCSATNRLITSKDHASVQLNVGHLDDRGIYTGSFTTFALCGFIRAQGDADSAMDRLWQKKKVEARQE

SEQ ID NO: 11638 - protein, 81 aa, Pseudotsuga menziesii
MQNEEGQNIDLYIPRKCSATNRLITSKDHASVQLNIGHVDENGIYTGQFTTFALSGFVRAQGDADSAIDRLWQKKKTELGQ

SEQ ID NO: 11639 - protein, 81 aa, Euphorbia esula
  misc_feature (8)..(8): Xaa can be any naturally occurring amino acid
MQNEEGQXMDLYIPRKCSATNRLITSKDHASVQMNIGHLDANGHYTGQFSTFALCGFVRAQGDADSALDRLWQKKKTELRQ

SEQ ID NO: 11640 - protein, 81 aa, Helianthus annuus
MQNEEGQNMDLYIPRKCSATNRLITSKDHASVQINVGHLDESGLYTGQFSTFALCGFVRAQGDADSALDRLWQKKKVEARQ

SEQ ID NO: 11641 - protein, 81 aa, Helianthus annuus
MQNEEGQNMDLYIPRKCSATNRLITSKDHASVQINVGHLDENGLYTGQFSTFALCGFVRAQGDADSALDRLWQKKKVEARQ

SEQ ID NO: 11642 - protein, 82 aa, Camellia sinensis
MQNEKGQNTDLYIPRKCSATNRLITAKDHASVQINVGHLDENGIYTGQFTTFALCGFVRAQGDADSAVDRLWQKKKTELRQQ

SEQ ID NO: 11643 - protein, 81 aa, Trigonella foenum-graecum
MQNEEGQITELYIPRKCSATNRLITAKDHASVQINIGHLDESGVYNGHFSTFALCGFTRAQGDADSGIDRLWQKKKAEIKQ

SEQ ID NO: 11644 - protein, 81 aa, Valeriana officinalis
MQNDEGQMMDLYIPRKCSATNRLITSKDHASVQLNVGHLDEAGRYTGQFTTFALCGFVRAQGDADSALDRLWQKKKVEIQQ

SEQ ID NO: 11645 - protein, 82 aa, Juglans hindsii x Juglans regia
MQNEEGVITELYIPRKCSATNRLITSKDHASVQINVGHLDENGVYNGHFSTFALCGFVRAQGDADSALDRLWQKKKVEARQQ

SEQ ID NO: 11646 - protein, 81 aa, Zamia vazquezii
MQNEEGQNVDLYIPRKCSATNRLITSKDHGSVQINIGHLDENGIYTGQFTTFALCGFVRAQGDADSAIDRLWQKKKAELGQ

SEQ ID NO: 11647 - protein, 82 aa, Ocimum basilicum
MQNEEGQNMDLYIPRKCSATNRLITSKDHASVQINIGHLDETGRYTGQFSTFALCGFIRAQGDADSALDRLWQKKKVETRQQ

SEQ ID NO: 11648 - protein, 82 aa, Phaseolus vulgaris
MQNEEGQITELYIPRKCSATNRLITAKDHASVQINIGHVDENGIYNGQFSTFALCGYIRAQGDADSALDRLWQKKKAEVKQQ

SEQ ID NO: 11649 - protein, 81 aa, Echinacea purpurea
MQNEEGQNMDLYIPRKCSATNRLITSKDHASVQINVGHLDESGRYTGQFSTFALCGFVRAQGDADSALDRLWQKKKVEVRQ

SEQ ID NO: 11650 - protein, 82 aa, Vitis vinifera
MQNEEGQNMDLYIPRKCSATNRLITSKDHASVQINIGHVDEDGVFTGQFSTFALCGFVRAQGDADSAVDRLWQKKKAEVRQH

SEQ ID NO: 11651 - protein, 82 aa, Vitis vinifera
MQNEEGQNMDLYIPRKCSATNRLITSKDHASVQINVGHLDESGTYTGQFTTFALCGFVRAQGDADSALDRLWQKKKAEVRQQ

SEQ ID NO: 11652 - protein, 82 aa, Glycine max
MQNEEGQITELYIPRKCSATNRLITAKDHASVQVNIGHVDENGVYNGHFSTFALCGFIRAQGDADSALDRLWQKKKVEVKQQ

SEQ ID NO: 11653 - protein, 82 aa, Glycine max
MQNEEGQITELYIPRKCSATNRLITAKDHASVQINIGHVDENGVYNGHFSTFALCGFIRAQGDADSALDRLWQKKKVEVKQQ

SEQ ID NO: 11654 - protein, 82 aa, Solanum lycopersicum
MQNDEGQNMDLYIPRKCSATNRLITSKDHASVQLNVGHLDDRGVYTGSFTTFALCGFIRAQGDADSAMDRLWQKKKVEARQE

SEQ ID NO: 11655 - protein, 82 aa, Acacia harpophylla
MQNEEGQITELYIPRKCSATNRLITAKDHASVQINVGHLDETGVYNGQFFTFALCGFICAQGDADSALDRLWQKKKVEVKQQ

SEQ ID NO: 11656 - protein, 81 aa, Ambrosia trifida
MQNEEGQNMDLYIPRKCSATNRLITSKDHASVQINVGHLDESGRYTGQFSTFALCGFVRAQGDADSALDRLWQKKKVETRQ

SEQ ID NO: 11657 - protein, 81 aa, Antirrhinum majus
MQNEEGQNMDLYIPRKCSATNRLITSKDHASVQINVGHLDETGRYTGQFSTFALCGFVRAQGDADSALDRLWQKKKAEARQ

SEQ ID NO: 11658 - protein, 82 aa, Aristolochia fimbriata
MQNEEGQHMDLYIPRKCSATNRLITSKDHASVQINIGHLDESGVYTGQLSTFALCGFVRAQGDADSALDRLWQKKKAEVKQQ

SEQ ID NO: 11659 - protein, 82 aa, Aristolochia fimbriata
MQNEEGQHMDLYIPRKCSATNRLITSKDHASVQINIGHLDESGIYTGQLSTFALCGFVRAQGDADSALDRLWQKKKAEVRQQ

SEQ ID NO: 11660 - protein, 81 aa, Unknown
  Sequence found in Organisms: Artemisia annua, Parthenium argentatum
MQNEEGQNMDLYIPRKCSATNRLITSKDHASVQINVGHLDESGRYTGQFSTFALCGFVRAQGDADSALDRLWQKKKVETHQ

SEQ ID NO: 11661 - protein, 81 aa, Bupleurum chinense
MMNEEGQNMDLYIPRKCSATNRLITSKDHASVQINVGHLDERGIYTGGFTTFALCGFVRAQGDADGAVDRLWQKKKTELKQ

SEQ ID NO: 11662 - protein, 82 aa, Ricinus communis
MQNEEGVNMDLYIPRKCSATNRLITSKDHASVQINIGHLDDRGIYNGQFTTFALCGFIRAQGDGDSAIDRLWQKKKVEARQQ

SEQ ID NO: 11663 - protein, 81 aa, Unknown
  Sequence found in Organisms: Centaurea maculosa, Cirsium arvense, Flaveria ramosissima
MQNEEGQNMDLYIPRKCSATNRLITSKDHASVQINVGHLDETGRYTGQFSTFALCGFVRAQGDADSALDRLWQKKKVETRQ

SEQ ID NO: 11664 - protein, 81 aa, Cicer arietinum
MQNEDGQITELYIPRKCSATNRLITAKDHASVQINIGHLDESGVYNGHFTTFALCGYTRAQGDADSGLDRLWQKKKTEIKQ

SEQ ID NO: 11665 - protein, 81 aa, Cichorium intybus
MQNEEGQNMDLYIPRKCSATNRLITSKDHASVQINVGHVDESGRYTGQFSTFALCGFVRAQGDADSALDRLWQKKKVEARQ

SEQ ID NO: 11666 - protein, 81 aa, Unknown
  Sequence found in Organisms: Cirsium arvense, Senecio madagascariensis
MQNEEGQNMDLYIPRKCSATNRLITSKDHASVQINVGHVDETGRYTGQFSTFALCGFVRAQGDADSALDRLWQKKKVEARQ

SEQ ID NO: 11667 - protein, 82 aa, Cucurbita pepo
MQNEEGKITELYIPRKCSATNRLITSKDHASVQINVGHLDDNGIYTGQFSTFALCGFIRAQGDADSALDRLWHKKKGEVHQQ

SEQ ID NO: 11668 - protein, 82 aa, Solanum melongena
MQNEEGQNMDLYIPRKCSATNRLITSKDHASVQLNIGHLDESGRYTGQFTTYALCGFIRAQGDADSALDRLWQKKKAEIGQQ

SEQ ID NO: 11669 - protein, 82 aa, Solanum melongena
MQNEEGQNMDLYIPRKCSATNRLITSKDHASVQLNVGHLDESGRYTGQFTTFALCGFIRAQGDADSALDRLWQKKKAEVGQQ

SEQ ID NO: 11670 - protein, 81 aa, Euphorbia peplus
MQNEEGQNMDLYIPRKCSATNRLITSKDHASVQINVGHLDANGHYTGQFSTFALCGFVRAQGDADSALDRLWQKKKTELRQ

SEQ ID NO: 11671 - protein, 80 aa, Euphorbia peplus
QNEEGQNMDLYIPRKCSATNRLITSKDHASVQINIGHLDANGHYTGQFSTFALCGFVRAQGDADSALDRLWQKKKTELRQ

SEQ ID NO: 11672 - protein, 81 aa, Flaveria ramosissima
MQNEEGQNMDLYIPRKCSATNRLITSKDHASVQINVGHLDETGRYTGQFSTFALCGFVRAQGDADSALDRLWQKKKVEIRQ

SEQ ID NO: 11673 - protein, 81 aa, Unknown
  Sequence found in Organisms: Flaveria ramosissima, Guizotia abyssinica
MQNEEGQNMDLYIPRKCSATNRLITSKDHASVQINVGHLDESGRYTGQFSTFALCGFVRAQGDADSALDRLWQKKKVEIRQ

SEQ ID NO: 11674 - protein, 81 aa, Linum usitatissimum
MQNEEGNNVDLYIPRKCSATNRLITSKDHASVQINVGHLDANGRYTGQFTTFALCGFVRAQGDGDSGLDRLWQKKKAELRQ

SEQ ID NO: 11675 - protein, 82 aa, Hevea brasiliensis
MQNEEGQNMDLYIPRKCSATNRLITSKDHASVQINIGHLDANGLYVGQCTTIALCGFVRAQGDADSALDRLWQKKKVEHRQQ

SEQ ID NO: 11676 - protein, 82 aa, Carpinus betulus
MQNEEGVITELYIPRKCSATNRLITSKDHASVQINVGHLDENGVYNGHFSTFALCGFVRAQGDADSGLDRLWQKKKAEIRQQ

SEQ ID NO: 11677 - protein, 81 aa, Lactuca sativa
MQNEEGQNMDLYIPRKCSATNRLITSKDHASVQINVGHLDESGRYTGQFSTFALCGFVRAQGDADSALDRLWQKKKVETQQ

SEQ ID NO: 11678 - protein, 82 aa, Glycyrrhiza uralensis
MQNEEGKLTELYVPRKCSATNRLITSKDHASVQINIGHLDESGVYSGHFSTFALCGFVRAQGDGDSALDRLWQKKKAEVKQH

SEQ ID NO: 11679 - protein, 81 aa, Liriodendron tulipifera
MQNEEGQNMDLYIPRKCSATNRLITSKDHASVQINVGHLDESGMYTGHFTTFALCGFVRAQGDADSALDRLWQKKKVELRQ

SEQ ID NO: 11680 - protein, 81 aa, Liriodendron tulipifera
MQNEEGQNMDLYIPRKCSATNRLITSKDHASVQINVGHLDESGMYTGHFTTFALCGFVRAQGDADSGLDRLWQKKKAEIRQ

SEQ ID NO: 11681 - protein, 82 aa, Quercus alba
MQNEEGVITELYIPRKCSATNRLITAKDHASVQINVGHLDENGVYNGHFSTFALCGFVRAQGDADSGLDRLWQKKKAEARQQ

SEQ ID NO: 11682 - protein, 82 aa, Olea europaea
MQNEEGQNMDLYIPRKCSATNRLITSKDHASVQINVGHLDETGRYTGQFSTFALCGFVRAQGDADSALDRLWQKKKVEVRQQ

SEQ ID NO: 11683 - protein, 82 aa, Citrus sinensis
MQNEEGQNMDLYIPRKCSATNRLITSKDHAAVQINIGHVDADGIYTGQFSTFALCGFVRAQGDGDSALDRLWQKKKAEVRQQ

SEQ ID NO: 11684 - protein, 81 aa, Orobanche aegyptiaca
MQNDEGKNMDLYIPRKCSATNRLITSKDHASVQINIGHLDERGVYTGGFTTFALCGFIRAQGDADSAVDRLWQKKKVEARQ

SEQ ID NO: 11685 - protein, 82 aa, Lippia dulcis
MQNEEGQNMDLYIPRKCSATNRLITSKDHASVQLNVGHVDERGIYTGQFSTFALCGFIRAQGDADSALDRLWEKKKVEARQQ

SEQ ID NO: 11686 - protein, 82 aa, Prunus mume
MQNEEGVFTELYVPRKCSATNRLITSKDHASVQINVGHLDENGIYTGQFSTSALCGYVLAQGDADSGLDRLWQKKKAEVKRH

SEQ ID NO: 11687 - protein, 82 aa, Salvia sclarea
MQNEEGQNMDLYIPRKCSATNRLITSKDHASVQINIGHVDESGRYTGQFSTFALCGFIRAQGDADSALDRLWQKKKVEAQQQ

SEQ ID NO: 11688 - protein, 81 aa, Sarracenia psittacina
MQNEEGQNVDLYIPRKCSATNRLITAKDHASVQINVGHLDENGIYTGQFTTFALCGFVRSQGDADSGLDRLWQKKKAELRQ

SEQ ID NO: 11689 - protein, 81 aa, Helianthus annuus
MQNEEGQNMDLYIPRKCSATNRLITSKDHASVQINVGHLDENGLYTGQFSTFALCGFVRAQGDADSALDRLWQKKKVETRQ

SEQ ID NO: 11690 - protein, 81 aa, Helianthus annuus
MQNEEGQNMDLYIPRKCSATNRLITSKDHASVQINVGHLDESGLYTGQFSTFALCGFVRAQGDADSALDRLWQKKKVETRQ

SEQ ID NO: 11691 - protein, 81 aa, Helianthus annuus
MQNEEGQNMDLYIPRKCSATNRLIPSKDHASVQINVGHLDESGLYTGQFSTFALCGFVRAQGDADSALDRLWQKKKVEARQ

SEQ ID NO: 11692 - protein, 81 aa, Tragopogon dubius
MQNEEGQNMDLYIPRKCSATNRLITSKDHASVQINVGHLDESGRYTGQFSTFALCGFVRAQGDADSALDRLWQKKKVENRQ

SEQ ID NO: 11693 - protein, 81 aa, Trigonella foenum-graecum
MQNDEGQITELYIPRKCSATNRLITAKDHASVQINIGHLDETGVYNGHFSTFALCGFTRAQGDADSGIDRLWQKKKTELKQ

SEQ ID NO: 11694 - protein, 82 aa, Vinca minor
MQNEEGQNMDLYIPRKCSATNRLITSKDHASIQINLGHLDERGIYTGGFSTFALCGFVRAQGDADSAVDRLWQKKKVEVRQQ

SEQ ID NO: 11695 - protein, 541 aa, Centaurea maculosa
MEESKRRMSTLQFCCFLLIGCLISQIYASSEAVFYESFDESFEGSWIASEKEEYSGVWKHSKSEGHDDYGLLVSEKARKYAIVKELEKPVELKDGTIVLQFEVRLQNGLECGGAYLKYLRPQEAGWTAKGFDNESPYSIMFGPDKCGATNKVHFILKHKNPKSGEFVEHHLKFPPSVPSDKLTHVYTAILKPDNEVIILVDGEEKKKANFLSSEDFEPALIPSKTIPDPDDKKPEDWDERAKIPDPEATKPDDWDEDAPMEILDEEAEKPEGWLEDEPEEIDDPEAVKPEDWDDEEDGEWEAPKIDNPKCEAASGCGEWRRPLKRNPAYKGKWHAPLIDNPAYKGIWKPQEIPNPNYFELETPNFEPIAAIGIEIWTMQDGILFDNILIASDEKTAETIRETTWKPKFKVEEEKQKAEEPAGFDGLKGIQKTVFDVLYKIADLPFLGDHKIKVLELIEKAEKQPNITIGVIISIIVVILSVLFKLLFGGKKTAKVNNNVAAAAAKKEEGEEASSTPAEDKEEEKKDEDAAAPRRRTTRRDN

SEQ ID NO: 11696 - protein, 83 aa, Cucurbita pepo
MQNEEGKITELYIPRKCSATNRLITSKDHASVQINVGHLDDNGIYTGQFSTFALCGFIRAQGDADSALDRLWHKRKAKFINNR

SEQ ID NO: 11697 - protein, 62 aa, Carpinus betulus
MPLFRLMLGIWMRTACTMAIFPPLLSVDLFVPREMLTVDWTVSGRRRKLKSDNSRAREKESV

SEQ ID NO: 11698 - protein, 84 aa, Carpinus betulus
MQNEEGVITELYIPRKCSATNRLITSKDHASVQINVGHLDENGVYNGHFSTFALCGFVRAQGDADSGLDRLWQKKKARNPTTGR

SEQ ID NO: 11699 - protein, 64 aa, Carpinus betulus
MQNEEGVITELYIPRKCSATNRLITSKDHASVQINVGHLDENGVYNGLFFHLCSLWICSCSGRC

SEQ ID NO: 11700 - protein, 74 aa, Lippia dulcis
MDLYIPRKCSATNRLITSKDHASVQLNIGHVDERGIYTGQFSTFALCGFIRAQGDADSALDRLWQKKKIEARQQ

SEQ ID NO: 11701 - protein, 161 aa, Papaver somniferum
MATTFTEKQEALVKESWELMKQNIPELSVRFFTTVIEIAPQAKPMFSFLKDTDEIPQNNPKLKAHAMKVFKMTCESAVQLREKGEVVVADSTLAYLGAVHVKKGVIDPHFEVVKEALLRTLESGLGDKWNEEMKCAWSEAYDQLATAIKDEMKEERAKADA

SEQ ID NO: 11702 - protein, 60 aa, Camellia sinensis
MDLYIPRKCSATNRLITAKDHASVQLNVGHWMIVVFIPEPSPPLLLWFRSCSGRCRQRCR

SEQ ID NO: 11703 - protein, 137 aa, Brassica napus
MGCIGLINLTSTNIYRPVLTRTSNKPYITRGPSMAAIRAESVATEKLGIFIEKNPPESKLTQLGVRSWPKWGCPPSKFPWTYDAKETCFLLEGKVKVYPDGSDEGVEIEAGDFVVFPKGMSCTWDVSVAVDKHYQFE

SEQ ID NO: 11704 - protein, 137 aa, Raphanus sativus
MGCIGLIDSASINIYRPVLTRTSNKPYTRRGLSMAAIRAESMATEKLGIFIEKNPPESKLTQLGVRSWPKWGCPPSKFPWTYDAKETCFLLEGKVKVYPNGSDEGVEIEAGDFVVFPKGMSCTWDVSVAVDKHYQFE

SEQ ID NO: 11705 - protein, 167 aa, Raphanus sativus
  misc_feature (13)..(13): Xaa can be any naturally occurring amino acid
  misc_feature (158)..(158): Xaa can be any naturally occurring amino acid
GKQNKVSRAVGNXEIKQNEKKIERYYQRSKMGCIGLIDSASINIYRPVLTRTSNKPYTRRGLSMAAIRAESMATEKLGIFIEKNPPESKLTQLGVRNWPKWGCPPSKFPWTYDAKETCFLLEGKVKVYPDGSDEGVEIEAGDFVVFPKGMSCTWDVSXAVDKHYQFE

SEQ ID NO: 11706 - protein, 161 aa, Raphanus sativus
RAVGNREIKQKRKKKIERYYQRSKMGCIGLIDSASINIYRPVLTRTSNKPYTRRGLSMAASRAESMATEKLGIFIEKNPPESKLTQLGVRSWPKWGCPPSKFPWTYDAKETCFLLEGKVKVYPNGSDEGVEIEAGDFVVFPKGMSCTWDVSVAVDKHYQFE

SEQ ID NO: 11707 - protein, 137 aa, Brassica juncea
MGCIGLIDLTSINIYRPVLTRTSNKPYTRRGLPTAAIRAESMATEKLGIFIEKNPPESKLTQLGVRNWPKWGCPPSKFPWTYDAKETCFLLEGKVKVYPNGSDEGVEIEAGDFVVFPKGMSCTWDVSVAVDKHYQFE

SEQ ID NO: 11708 - protein, 137 aa, Raphanus sativus
MGCIGLIDSASTNIYRPVLTRTSNKPYTRRGLSMAASRAESMATEKLGIFIEKNPPESKLTQLGVRNWPKWGCPPSKFPWTYDAKETCFLLEGKVKVYPDGSDEGVEIEAGDFAVFPKGMSCTWDVSVAVDKHYQFE

SEQ ID NO: 11709 - protein, 152 aa, Raphanus sativus
NKNEKKIERYYQRSKMGCIGLIDSASINIYRPVPTRKSNKPYTRRRLSMAASRAESMATEKLGIFIEKNPPESKLTQLGVRNWPKWGCPPSKFPWTYDAKETCFLLEGKVKVYPNGSDEGVEIEAGDFVVFPKGMSCTWDVSVAVDKHYQFE

SEQ ID NO: 11710 - protein, 141 aa, Raphanus sativus
QRSEMGCIGLIDSASISIYRPVLTRTSNKPYTRRRLSMAATRAESMATEKLGIFIEKNPPESKLTQLGVRNWPKWGCPPSKFPWTYDAKETCFLLEGKVKVYPDGSDEGVEIEAGDFVVFPKGMSCTWDVSVAVDKHYQFE

SEQ ID NO: 11711 - protein, 136 aa, Arabidopsis lyrata
MGCIGVVNLTSINPYLTRTSNKPYNSRRASSMAAAIRAESVATEKLGITIEKNPPESKLTQLGVRNWPRWGCPPSKFPWTYSAKETCYLLEGKVKVYPNGSDEGVEIEAGDFVVFPKGMSCTWDVSVAVDKHYQFE

SEQ ID NO: 11712 - protein, 136 aa, Eutrema halophilum
MGCIGLVNSSSINFYRPVLTKTSHKPYSSRGSMAAIRAESMATEKLGILIEKNPPESKLTQLGVRNWPKWGCPPSKFPWTYSAKETCYLLQGKVKVYPDGSDEGVEIEAGDFVVFPKGMSCTWDVSVTVDKHYQFE

SEQ ID NO: 11713 - protein, 134 aa, Arabidopsis thaliana
MGCIGVVNVTSINPYLTRRSNKPYNSRRPSSMAAAIRAESTEKLGITIEKNPPESKLTQLGVRSWPKWGCPPSKFPWTYSAKETCYLLQGKVKVYPNGSDEGVEIEAGDFVVFPKGMSCTWDVSVAVDKHYQFE

SEQ ID NO: 11714 - protein, 193 aa, Brassica napus
MVSTPFHSIIFLFLAFSGGVKISVADEPKTEPVPAPWPEQFHALMLMNKSGSIEIVDLWYDWINGRNFNIIQKQLGKLTYDLEWNNGTSFYYTLDASKTCRTVHFEVGILRPNWLDGANYLGQRNVSGFLCNVWEKVDFLWYYEDVVTKRPVQWIFYTGREAHVMTFEVGAVLEDEKWQAPVYCFHNENKSSE

SEQ ID NO: 11715 - protein, 200 aa, Brassica oleracea
  misc_feature (183)..(183): Xaa can be any naturally occurring amino acid
GGLEPIDMVSTPFHSIIFLFLAFSGGVKISVADEPKTDPVPAPWPEQFHALMLMNKSGSIEIVDLWYDWINGRNFNIIQKQLGKLTYDLEWNNGTSFYYTLDASKTCRTVHFEVGILRPNWLDGANYLGQRNVSGFLCNVWEKVDFLWYYEDVVTERPVQWIFYTGREAHVMTFEVGAVLEDXKWQAPVYCFHNENKSSE

SEQ ID NO: 11716 - protein, 193 aa, Brassica juncea
MVSTPIHSIIFLFLVFSAGLKISIADKPVTEPVPAPWPEQFHALMLMNKSGSLEIIDLWYDWINGRNFNIIQKQLGKLTYDLEWNNGTSFYYTLDASRTCRTVHLEVGILRPNWLDGANYLGQRNVSGFLCNVWEKVDFLWYYEDVVTKRPVQWIFYTGREAHVMTFEVGAVLEDEKWQAPVYCFHEELKSSE

SEQ ID NO: 11717 - protein, 193 aa, Eutrema parvulum
MASTPIHSLVVLFLVFSARVKISVADEPETEPVPAPWPEQFHALMLMNKSGSLEIVDLWYDWVNGRNFNIIQKQLGKLTYDLEWNNGTSFYYTLDASRTCRTVHFEVGILRPNWLDGANYLGQRHVNGFLCNVWEKVEFLWYYEDVVTKRPVQWIFYTGREAHVMTFEVGAVLEDENWQAPVYCFHNETKNNE

SEQ ID NO: 11718 - protein, 189 aa, Eutrema halophilum
MVSIPILSLIVLFLVFSAGVQFSVADEPVPAPWPEQFHALMLMNKSGSLEIVDLWYDWVNDRNFNIIQKQLGKLTYDLEWNNGTSFYYTLDASRTCRTVHFEVGILRPNWLDGAKYLGQRHVNGFLCNVWEKVDFLWYYEDVVSKRPVQWIFYTGREAHVMTFEVGAVLEDEKWQAPVYCFHNDNKNSE

SEQ ID NO: 11719 - protein, 194 aa, Arabidopsis thaliana
MVLKPIHSFIVILLLVLSVGDKISAGTEPEKEPVPAVWPEQFHALMLMNKSGSLEIVDLWYDWVNGRNFNIIQKQLGKLTYDLEWNNGTSFYYTLDASKTCRTVHFEVGILRPNWLDGAKYMGQRHVNGFLCNVWEKVEFLWYYEDVVTKRPVQWIFYTGREAHVMTFEVGAVLEDEKWQAPVYCFHNEKKEVQ

SEQ ID NO: 11720 - protein, 195 aa, Arabidopsis lyrata
MVSKPLHSFIVILLVLSAGDKTAAVNEPELEMEPVPAVWPEQFHALMLMNKSGALEIVDLWYDWVNGRNFNIIQKQLGKLTYDLEWNNGTSFYYTLDASRTCRTVHFEVGILRPNWLDGAKYLGQRHVNGFLCNVWEKVEFLWYYEDIVTKRPVQWIFYTGREAHVMTFDVGAVLEDEKWQAPVYCFHNEKKEVQ

SEQ ID NO: 11721 - protein, 225 aa, Raphanus sativus
GSGYQRSGHYGGDLNSYYHYLCEPERGFRPIDMVSTPFHSIIFLFFVFSAGVKISVADKPVTQPVPAPWPEQFHALMLMNKSGSIEIVDLWYDWINGRNFNIIQKQLGKVTYDLEWNNGTSFYYTLDASKTCRTVHFEVGILRPNWLDGATYLGQRNVSGFLCNVWEKVDFLWYYEDVVTKRPVQWIFYTGREAHVMTFEVGAVLEDEKWQAPVYCFHNEKKSSE

SEQ ID NO: 11722 - protein, 122 aa, Cajanus cajan
MRLLTHNMLSSNIKGVVNGFPLRIEAEKVVEKTVEMNGEFLKKMFEKIDWKAFVDASRAMGYTELPEEADSSMLDSDEFLNRFHHALLELHLEEGALVCPETGRRFPVNKGIPNMLLHEDEV

SEQ ID NO: 11723 - protein, 122 aa, Glycine max
MRLITHNMLSSNIKGVVNGFPLRIEAEKVVEKTVEMNGEFLKKMFEKIDWKAFVDASRAMGYTELPEEADSSMLDSDEFLNRFHHALLELHLEEGVLVCPETGRRFPVSKGIPNMLLHEDEV

SEQ ID NO: 11724 - protein, 122 aa, Vigna unguiculata
MRLLTHNMLSSNIKGVVNGFPLRIEVEKVVEKTVEMNGEFLKKMFEKVDWKALIDASRAMGYTELPEEADSSMLDSDEFLNRFHHALLEIHLEEGALVCPETGRRFPVNKGIPNMLLHEDEV

SEQ ID NO: 11725 - protein, 122 aa, Lotus japonicus
MRLLTHNMLSSNIKGVVNGFPLRIEAVKVVEKTVEMNGDFLKKMFDKIDWKAFVVASQAMGYTELPEEADSSMLDSNEFLNRFHHALLELHLEEGALVCPETGRRFPVSKGIPNMLLHEDEV

SEQ ID NO: 11726 - protein, 122 aa, Glycine max
MRLITHNMLSSNIKGVVNGFPLRIEAEKVMEKTMEMNSEFLEKMFEKVDWKAFVDASRAMGYTELPEEANSSMLDSDEFLNRFHHALLELDLEEGALVCPETGRRFPVSKGIPNMLLHEDEV

SEQ ID NO: 11727 - protein, 122 aa, Medicago truncatula
MRLLTHNMLSSNIKGVVNGFPLRIEAEKVVEKNVEMNGDFLKKMFEKIEWKAFVEASRGMGYTELPEEADSSMLDSNEFLNRFHHALLELHLEEGALVCPETGRRFPVKKGIPNMLLHEDEV

SEQ ID NO: 11728 - protein, 122 aa, Trigonella foenum-graecum
MRLLTHNMLSSNIKGVVNGFPLRIEAEKVVEKNVEMNGDFLKKMFEKIEWKAFVEASRGMGYTELPEEADSSMLDSDEFLSRFHHALLELHLEEGALVCPETGRRFPIKKGIPNMLLHEDEV

SEQ ID NO: 11729 - protein, 122 aa, Cicer arietinum
MRLLTHNMLSSNIRGVVNGFPLRIEAGKVVEKNVEINGDFLKNMFVKIDWKAFVEASQSMGYTELPEEADSSMLDSDEFLNRFHHALLELHLEEGALVCPETGRRFPVSKGIPNMLLHEDEV

SEQ ID NO: 11730 - protein, 122 aa, Cicer arietinum
MRLLTHNMLSSNIRGVVNGFPLRIEVGKVVEKNVEMNGDFLKNMFVKIDWKAFVEASQSMGYTELPEEADLSMLDSDEFLNRFHHALLELHLEEGALVCPETGRRFPVSKGIPNMLLHEDEV

SEQ ID NO: 11731 - protein, 122 aa, Trigonella foenum-graecum
MKLLTHNMLSSNIRGVVNGFPLRIEAAKVIEKSVEMNSDFLKNMFEKIEWKAFVEASRSMGYTELPEEADSSMLDSDDFLNRFHHALLELHLEEGALVCPETGRRFPVSKGIPNMLLHEDEV

SEQ ID NO: 11732 - protein, 117 aa, Trifolium pratense
HNMLSSNIKGVVNGFPLRIEAEKVVEKNVEMNGDFLKKMFEKIEWKAFVEASRGMGYTELPEEADTSMLDSDEFLSRFHHALLELHLEEGALVCPETGRRFPVKKGIPNMLLHEDEV

SEQ ID NO: 11733 - protein, 122 aa, Medicago truncatula
MGLLTHNMLSSNIRGVVNGFPLRIEAVKVVEKNVEMNTDFLKNMFEKIDWKAFVEASISMGYTELPKEADSSLLDSDDFLNRFHHALLELHLEEGALVCPETRRRFPVSKGIPHMLLHEDEV

SEQ ID NO: 11734 - protein, 129 aa, Phaseolus vulgaris
MRLLTHNMLSSNIKGVVNGFPLRIEAEKVAEKSVEMNREFLKKMFQKVHWKAFVDASRAMGYTELPEKADSSMLNSDEFLNRFHHALLELHLEEGALVCPETGRRFPVNKGIPNMLLPQEEVLLSIIIC

SEQ ID NO: 11735 - protein, 122 aa, Arachis hypogaea
MRLLTHNMLSSNIKGVEKGFPLRIEAEKVVEKPVEMNADFLRKMFEKVEWKAFVEASRSMGYAQLPEEVDSGMLESDEFLSRFHHALLELHLEEGALVCPETGRRFPVNKGIPNMLLHEDEV

SEQ ID NO: 11736 - protein, 122 aa, Fagus grandifolia
MRLLTHNMLSSNIKGVSNGFPLRIEVEKVIEKHVDFNADFLRNMFPKIEWKAFVDAAKTIGYAELPEEADSSMLDSDEFLNKFHHALLELHLEEGGLVCPETGRRFPVSKGIPNMLLHEDEV

SEQ ID NO: 11737 - protein, 122 aa, Arachis hypogaea
MRLLTHNMLSSNIKGVEKGFPLRIEAEKVVEKPVEMNADFLRKMFEKVEWKAFLEASRSMGYAQLPEEVDSGMLESDEFLSRFHHALLELHLEEGALVCPETGRRFPVNKGIPNMLLHEDEV

SEQ ID NO: 11738 - protein, 122 aa, Eucalyptus grandis
MRLLTHNMLSSNIKGVINGFPLGIVVEKVIEKPVEMNPDFLKNMFAKIEWKALVDASRSMGYTELPEQADSSMLDSVDFLQRFHHALLELHLEEGALVCPETGRKFPVNKGIPNMLLHEDEV

SEQ ID NO: 11739 - protein, 123 aa, Lactuca sativa
MRLLTHNMLSSNIKGVINGFPLRIEVEKVVEKQVDFNPDFLKNMFSKIDWKALADASKIMGYAELPEEVPDASVLDSDEFLQKFHHALLELHLEEGALVCPETGRRFPVNKGIPNMLLHEDEV

SEQ ID NO: 11740 - protein, 122 aa, Lupinus angustifolius
MRLLTHNMLSSNIKGVTNGFPLRIEVVKVEEKTVEINADFLKNMFQKIDWKALTEASRSMGYTELPEESEFSLLESDEFLSRFHHALLELHLEEGALVCPESGRRFPVSKGIPNMLLHEDEV

SEQ ID NO: 11741 - protein, 122 aa, Lupinus angustifolius
MRLLTHNMLSSNIKGVTNGFPLRIEVVKVEEKTVEMNTDFLKNMFVKIDWKVLVEASRTLGYAELPEEGDSSFLESDEFLSRFHHALLELHLEEGALICPETGRRFPVTKGIPNMLLHEDEV

SEQ ID NO: 11742 - protein, 123 aa, Cichorium intybus
MRLLTHNMLSSNIKGVINGFPLRIEVEKVVEKQVDFNPDFLKNMFSKIDWKALADASKIMGYAELPDEVPDASVLDSDEFLQKFHHALLELHLEEGALVCPETGRRFPVNKGIPNMLLHEDEV

SEQ ID NO: 11743 - protein, 122 aa, Bruguiera gymnorhiza
MRLLTHNMLSSNIKGVSNGFPLRIEAEKVIEKQVDFNLDFLKNMFSKVEWKALVDAARTLGYAELPDEVDSSMLGSEEFLRRFHHALLELHLEEGALVCPETGRKFPVNKGIPNMLLHEDEV

SEQ ID NO: 11744 - protein, 122 aa, Manihot esculenta
MRLLTHNMLSSNIKGVSNGFPLRIEVEKVIEKEVDCNPDFLINMFAKIEWKALVDAARTMGYAELPEEAESSMLDSDEFLRKFHHALLELHLEEGALVCPETGRKFPVNKGIPNMLLHEDEV

SEQ ID NO: 11745 - protein, 122 aa, Cucurbita pepo
MRLLTHNMLSSNIKGVVNGFPLRIEVEKVVEKQVDFNPDFLKNMFSKIEWKPLVDASCAMGYAELPEEAESSMLDSHDFLQRFHHALLELHLEEGALICPETARRFPVNKGIPNLLLHEDEV

SEQ ID NO: 11746 - protein, 122 aa, Cucurbita pepo
MRLLTHNMLSSNIKGVVNGFPLRIEVEKVVEKQVDFNPDFLKNMFSKIEWKPLVDASRTMGYAELPEEAESSMLDSHDFLQRFHHALLELHLEEGALICPETGRRFPVNKGIPNLLLHEDEV

SEQ ID NO: 11747 - protein, 122 aa, Cucurbita pepo
MRLLTHNMLSSNIKGVVNGFPLRIEVEKVVEKQVDFNPDFLKNMFSKIEWKPLVDASRAMGYAELPEEAESSMLDSHDFLQRFHHALLELHLEEGALICPETARRFPVNKGIPNLLLHEDEV

SEQ ID NO: 11748 - protein, 122 aa, Quercus alba
MRLLTHNMLSSNIKGVSNGFPLRIEVEKVVEKQVDFNADFLRNMFPKIEWKAFVDAAKTVGYAELPEEVESSALESEEFLNKFHHALLELHLEEGALVCPETGRRFPVSKGIPNMLLHEDEV

SEQ ID NO: 11749 - protein, 122 aa, Salvia sclarea
MRLLTHNMLSSNIKGVTNGFPLRIEVEKMVEKEVELNADFLRNMFAKVEWKALVEASKTLGYTELPDNAEPSMLDSDEFLHRFHHALLELHLEEGALVCPETGRKFPVNKGIPNMLLHEDEV

SEQ ID NO: 11750 - protein, 123 aa, Cirsium arvense
MRLLTHNMLSSNIKGVINGFPLRIEAERVVEKQVDFNPDFLKNMFSKIDWKALADASKIMGYAELPDEVPDPSVLDSEEFLQKFHHALLELHLEEGALVCPETGRRFPVNKGIPNMLLHEDEV

SEQ ID NO: 11751 - protein, 122 aa, Antirrhinum majus
MRLLTHNMLSSNIKGVTNGFPLRIEAEKVVEKEVEFNIDFLKNMFAKIEWKPLVEAAKTMGYSELPDNVESSLLDSDEFLHKFHHALLELHLEEGALVCPETGRKFPVSKGIPNMLLHEDEV

SEQ ID NO: 11752 - protein, 122 aa, Malus domestica
MRLLTHNMLSSNIKGVTNGFPLRIEIEKVVEKQVEFNPDFLKNMFPKIEWKALVNASHSMGYVELPEEVEPSRLDSEDFLHKFHHALLELHLEEGALVCPETGRRFPVSKGIPNMLLHEDEV

SEQ ID NO: 11753 - protein, 122 aa, Cannabis sativa
MRLLTHNMLSSNIKGVTNGFPLRIEVVKVVEKEVELNPDFLKSMFSKIDWKALVEAARAIGYTELPNEVDPSMLDSDDFLRRFHHALLQLHLEEGALICPETGRRFPVTKGIPNMLLHEDEV

SEQ ID NO: 11754 - protein, 122 aa, Cucumis sativus
MRLLTHNMLSSNIKGVINGFPLRIEVEKVVEKPVDFNPDFLKNMFSKIEWKPLVDASRTMGYAELPEEADASMLDSHDFLQRFHHALLELHLEEGALFCPETNRRFPVNKGIPNMLLHEDEV

SEQ ID NO: 11755 - protein, 122 aa, Cucumis melo
MRLLTHNMLSSNIKGVINGFPLRIEVEKVVEKPVDFNPDFLKNMFSKIEWKPLVDASRTMGYAELPEEADASMLDSHDFLQRFHHALLELHLEEGALICPETNRRFPVNKGIPNMLLHEDEV

SEQ ID NO: 11756 - protein, 122 aa, Mimulus guttatus
MRLLTHNMLSSNIKGVTNGFPLLIEAVKVVEKEVDFNEDFLKNMFVKVEWKALVEASRTLGYTELPESAEASMLDSDEFLRKFHHALLELHLEDGALVCPETGRKFPVSKGIPNMLLHEDEV

SEQ ID NO: 11757 - protein, 122 aa, Capsicum annuum
MRLLTHNMLSSNIKGVANGFPLKIEVVTVVEKEVEFNIEFLKKMFSKVEWKALAEASRTMGYTELPENADASMLDSDDFLHKFHHALLELHLEEGALVCPETGRKFPVNKGVPNMLLHEDEV

SEQ ID NO: 11758 - protein, 122 aa, Citrullus lanatus
MRLLTHNMLSSNIKGVVNGFPLRIEVEKVVEKQVDFNPDFLKNMFSKIEWKPLVDASRTMGYAELPEEAEASMLDSHDFLQRFHHALLELHLEEGALICPETGRRFPVNKGIPNLLLHEDEV

SEQ ID NO: 11759 - protein, 473 aa, Glycine max
MKTLYSLRRFYHVETLFNGTLALTGRDQETTGFAWWAGNARLINLSGKLLGAHVAHAGLIVFWAGAMNLFEVAHFVPEKPMYEQGLILLPHLATLGWGVGPGGEVIDTFPYFVSGVLHLISSAVLGFGGIYHALLGPETLEESFPFFGYVWKDRNKMTTILGIHLILLGIGAFLLVFKALYFGGIYDTWAPGGGDVRKITNLTLSPSIIFGYLLKSPFGGEGWIVSVDDLEDIIGGHVWLGSICILGGIWHILTKPFAWARRALVWSGEAYLSYSLGALSVFGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDIQPWQERRSAEYMTHAPLGSLNSVGGVATEINAVNYVSPRSWLATSHFVLGFFLFVGHLWHAGRARAAAAGFEKGIDRDFEPVLSMTPLN

SEQ ID NO: 11760 - protein, 473 aa, Cajanus cajan
MKTLYSLRRFYHVETLFNGTLALTGRDQETTGFAWWAGNARLINLSGKLLGAHVAHAGLIVFWAGAMNLFEVAHFVPEKPMYEQGLILLPHLATLGWGVGPGGEVIDTFPYFVSGVLHLISSAVLGFGGIYHALLGPETLEESFPFFGYVWKDRNKMTTILGIHLILLGIGAFLLVFKALYFGGVYDTWAPGGGDVRKITNLTLSPSIIFGYLLKSPFGGEGWIVSVDDLEDIIGGHVWLGSICILGGIWHILTKPFAWARRALVWSGEAYLSYSLGALSVFGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDIQPWQERRSAEYMTHAPLGSLNSVGGVATEINAVNYVSPRSWLATSHFVLGFFLFVGHLWHAGRARAAAAGFEKGIDRDFEPVLSMTPLN

SEQ ID NO: 11761 - protein, 473 aa, Cajanus cajan
MKTLYSLRRFYHVETLFNGTLALTGRDQETTGFAWWAGNARLINLSGKLLGAHVAHAGLIVFWAGAMNLFEVAHFVPEKPMYEQGLILLPHLATLGWGVGPGGEVIDTFPYFVSGVLHLISSAVLGFGGIYHALLGPETLEESFPFFGYVWKDRNKMTTILGIHLILLGIGAFLLVFKALYFGGIYDTWAPGGGDVRKITNLTLSPSIIFGYLLKSPFGGEGWIVSVDDLEDIIGGHVWLGSICIFGGIWHILTKPFAWARRALVWSGEAYLSYSLGALSVFGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDIQPWQERRSAEYMTHAPLGSLNSVGGVATEINAVNYVSPRSWLATSHFVLGFFLFVGHLWHAGRARAAAAGFEKGIDRDFEPVLSMTPLN

SEQ ID NO: 11762 - protein, 353 aa, Unknown
  Sequence found in Organisms: Jatropha curcas, Lotus japonicus
MTIALGKFTKDENDLFDIMDDWLRRDRFVFVGWSGLLLFPCAYFALGGWFTGTTFVTSWYTHGLASSYLEGCNFLTAAVSTPANSLAHSLLLLWGPEAQGDFTRWCQLGGLWTFVALHGAFGLIGFMLRQFELARSVQLRPYNAIAFSGPIAVFVSVFLIYPLGQSGWFFAPSFGVAAIFRFILFFQGFHNWTLNPFHMMGVAGVLGAALLCAIHGATVENTLFEDGDGANTFRAFNPTQAEETYSMVTANRFWSQIFGVAFSNKRWLHFFMLFVPVTGLWMSALGVVGLALNLRAYDFVSQEIRAAEDPEFETFYTKNILLNEGIRAWMAAQDQPHENLIFPEEVLPRGNAL

SEQ ID NO: 11763 - protein, 312 aa, Arachis hypogaea
AYFALGGWFTGTTFVTSWYTHGLASSYLEGCNFLTAAVSTPANSLAHSLLLLWGPEAQGDFTRWCQLGGLWTFVALHGAFALIGFMLRQFELARSVQLRPYNAIAFSGPIAVFVSVFLIYPLGQSGWFFAPSFGVAAIFRFILFFQGFHNWTLNPFHMMGVAGVLGAALLCAIHGATVENTLFEDGDGANTFRAFNPTQAEETYSMVTANRFWSQIFGVAFSNKRWLHFFMLFVPVTGLWMSALGVVGLALNLRAYDFVSQEIRAAEDPEFETFYTKNILLNEGIRAWMAAQDQPHENLIFPEEVLPRGNAL

SEQ ID NO: 11764 - protein, 473 aa, Panax ginseng
MKTLYSLRRFYPVETLFNGTLALAGRDQETTGFAWWAGNARLINLSGKLLGAHVAHAGLIVFWAGGMNLFEVAHFVPEKPMYEQGLILLPHLATLGWGVGPGGEVIDTFPYFVSGVLHLISSAVLGFGGIYHALLGPETLEESFPFFGYVWKDRNKMTTILGIHLILLGIGAFLLVFKALYFGGVYDTWAPGGGDVRKITNLTLSPSIIFGYLLKSPFGGEGWIVSVDDLEDIIGGHVWLGSICILGGIWHILTKPFAWARRALVWSGEAYLSYSLGALSVFGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDIQPWQERRSAEYMTHAPLGSLNSVGGVATEINAVNYVSPRSWLATSHFVLGFFLFVGHLWHAGRARAAAAGFEKGIDRDFEPVLSMTPLN

SEQ ID NO: 11765 - protein, 473 aa, Solanum lycopersicum
MKTLYSLRRFYHVETLFNGTLALAGRDQETTGFAWWAGNARLINLSGKLLGAHVAHAGLIVFWAGAMNLFEVAHFVPEKPMYEQGLILLPHLATLGWGVGPGGEVIDTFPYFVSGVLHLISSAVLGFGGIYHALLGPETLEESFPFFGYVWKDRNKMTTILGIHLILLGIGAFLLVFKALYFGGVYDTWAPGGGDVRKITNLTLSPSIIFGYLLKSPFGGEGWIVSVDDLEDIIGGHVWLGSICILGGIWHILTKPFAWARRALVWSGEAYLSYSLGALAVFGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDIQPWQERRSAEYMTHAPLGSLNSVGGVATEINAVNYVSPRSWLATSHFVLGFFFFVGHLWHAGRARAAAAGFEKGIDRDFEPVLSMTPLN

SEQ ID NO: 11766 - protein, 473 aa, Malus domestica
MKTLYSLRRFYPVETLFNGTLALAGRDQETTGFAWWAGNARLINLSGKLLGAHVAHAGLIVFWAGAMNLFEVAHFVPEKPMYEQGLILLPHLATLGWGVGPGGEVLDTFPYFVSGVLHLISSAVLGFGGIYHALLGPETLEESFPFFGYVWKDRNKMTTILGIHLILLGIGAFLLVFKALYFGGVYDTWAPGGGDVRKITNLTLSPSIVFGYLLKSPFGGEGWIVSVDDLEDIIGGHVWLGSICILGGIWHILTKPFAWARRALVWSGEAYLSYSLGALSVFGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDIQPWQERRSAEYMTHAPLGSLNSVGGVATEINAVNYVSPRSWLATSHFVLGFFLFVGHLWHAGRARAAAAGFEKGIDRDFEPVLSMTPLN

SEQ ID NO: 11767 - protein, 473 aa, Unknown
  Sequence found in Organisms: Theobroma cacao, Gossypium raimondii
MKTLYSLRRFYPVETLFNGTLALAGRDQETTGFAWWAGNARLINLSGKLLGAHVAHAGLIVFWAGAMNLFEVAHFVPEKPMYEQGLILLPHLATLGWGVGPGGEVIDTFPYFVSGVLHLISSAVLGFGGIYHALLGPETLEESFPFFGYVWKDRNKMTTILGIHLILLGIGAFLLVFKALYFGGVYDTWAPGGGDVRKITNLTLSPSVIFGYLLKSPFGGEGWIVSVDDLEDIIGGHVWLGSICIFGGIWHILTKPFAWARRALVWSGEAYLSYSLGALSVFGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDIQPWQERRSAEYMTHAPLGSLNSVGGVATEINAVNYVSPRSWLATSHFVLGFFLFVGHLWHAGRARAAAAGFEKGIDRDFEPVLSMTPLN

SEQ ID NO: 11768 - protein, 473 aa, Eucalyptus grandis
MKTLYSLRRFYPVETLFNGTLALAGRDQETTGFAWWAGNARLINLSGKLLGAHVAHAGLIVFWAGAMNLFEVAHFVPEKPMYEQGLILLPHLATLGWGVGPGGEVIDTFPYFVSGVLHLISSAVLGFGGIYHALLGPETLEESFPFFGYVWKDRNKMTTILGIHLILLGIGAFLLVFKALYFGGVYDTWAPGGGDVRKITNLTLSPSVIFGYLLKSPFGGEGWIVSVDDLEDIIGGHVWLGSICILGGIWHILTKPFAWARRALVWSGEAYLSYSLAALSVFGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDIQPWQERRSAEYMTHAPLGSLNSVGGVATEINAVNYVSPRSWLATSHFVLGFFLFVGHLWHAGRARAAAAGFEKGIDRDFEPVLSMTPLN

SEQ ID NO: 11769 - protein, 473 aa, Panax ginseng
MKTLYSLRRFYPVETLFNGTLALAGRDQETTGFAWWAGNARLINLSGKLLGAHVAHAGLIVFWAGGMNLFEVAHFVPEKPMYEQGLILLPHLATLGWGVGPGGEVIDTFPYFVSGVLHLISSAVLGFGGIYHALLGPETLEESFPFFGYVWKDRNKMTTILGIHLILLGIGAFLLVFKALYFGGVYDTWAPGGGDVRKITNLTLSPSIIFGYLLKSPFGGEGWIVSVDDLEDIIGGHVWLGSICILGGIWHILTKPFAWARRALVWSGEAYLSYSLGALSVFGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDLQPWQERRSAEYMTHAPLGSLNSVGGVATEINAVNYVSPRSWLATSHFVLGFFLFVGHLWHAGRARAAAAGFEKGIDRDFEPVLSMTPLN

SEQ ID NO: 11770 - protein, 473 aa, Prunus mume
MKTLYSLRRFYPVETLFNGTLALAGRDQETTGFAWWAGNARLINLSGKLLGAHVAHAGLIVFWAGAMNLFEVAHFVPEKPMYEQGLILLPHLATLGWGVGPGGEVLDTFPYFVSGVLHLISSAVLGFGGIYHALLGPETLEESFPFFGYVWKDRNKMTTILGIHLILLGIGAFLLVFKALYFGGVYDTWAPGGGDVRKITNLTLSPSIVFGYLLKSPFGGEGWIVSVDDLEDIIGGHVWLGSICILGGIWHILTKPFAWARRALVWSGEAYLSYSLAALSVFGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDIQPWQERRSAEYMTHAPLGSLNSVGGVATEINAVNYVSPRSWLATSHFVLGFFLFVGHLWHAGRARAAAAGFEKGIDRDFEPVLSMTPLN

SEQ ID NO: 11771 - protein, 353 aa, Unknown
  Sequence found in Organisms: Castanea mollissima, Coffea canephora
MTIALGKFTKDENDLFDIMDDWLRRDRFVFVGWSGLLLFPCAYFALGGWFTGTTFVTSWYTHGLASSYLEGCNFLTAAVSTPANSLAHSLLLLWGPEAQGDFTRWCQLGGLWTFVALHGAFGLIGFMLRQFELARSVQLRPYNAIAFSAPIAVFVSVFLIYPLGQSGWFFAPSFGVAAIFRFILFFQGFHNWTLNPFHMMGVAGVLGAALLCAIHGATVENTLFEDGDGANTFRAFNPTQAEETYSMVTANRFWSQIFGVAFSNKRWLHFFMLFVPVTGLWMSALGVVGLALNLRAYDFVSQEIRAAEDPEFETFYTKNILLNEGIRAWMAAQDQPHENLIFPEEVLPRGNAL

SEQ ID NO: 11772 - protein, 473 aa, Vitis vinifera
MKTLYSLRRFYPVETLFNGTLALAGRDQETTGFAWWAGNARLINLSGKLLGAHVAHAGLIVFWAGAMNLFEVAHFVPEKPMYEQGLILLPHLATLGWGVGPGGEVIDTFPYFVSGVLHLISSAVLGFGGIYHALLGPETLEESFPFFGYVWKDRNKMTTILGIHLILLGIGAFLLVFKALYFGGVYDTWAPGGGDVRKITNLTLSPSVIFGYLLKSPFGGEGWIVSVDDLEDIIGGHVWLGSICIFGGIWHILTKPFAWARRALVWSGEAYLSYSLGALAVFGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDIQPWQERRSAEYMTHAPLGSLNSVGGVATEINAVNYVSPRSWLATSHFVLGFFLFVGHLWHAGRARAAAAGFEKGIDRDFEPVLSMTPLN

SEQ ID NO: 11773 - protein, 473 aa, Cannabis sativa
MKTLYSLRRFYPVETLFNGTLALAGRDQETTGFAWWAGNARLINLSGKLLGAHVAHAGLIVFWAGAMNLFEVAHFVPEKPMYEQGLILLPHLATLGWGVGPGGEVLDTFPYFVSGVLHLISSAVLGFGGIYHALLGPETLEESFPFFGYVWKDRNKMTTILGIHLILLGIGAFLLVFKALYFGGVYDTWAPGGGDVRKITNLTLSPSIVFGYLLKSPFGGEGWIVSVDDLEDIIGGHVWLGSICILGGIWHILTKPFAWARRALVWSGEAYLSYSLGALSVFGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDIQPWQERRSAEYMTHAPLGSLNSVGGVATEINAVNYVSPRSWLATSHFVLGFFLFVGHLWHAGRARAAAAGFEKGIDRDLEPVLFMTPLN

SEQ ID NO: 11774 - protein, 473 aa, Lactuca sativa
MKTLYSLRRFYPVETLFNGTLALAGRDQETTGFAWWAGNARLINLSGKLLGAHVAHAGLIVFWAGAMNLFEVAHFVPEKPMYEQGLILLPHLATLGWGVGPGGEVIDTFPYFVSGVLHLISSAVLGFGGIYHALLGPETLEESFPFFGYVWKDRNKMTTILGIHLILLGIGAFLLVFKALYFGGVYDTWAPGGGDVRKITNLTLSPSIIFGYLLKSPFGGEGWIVSVDDLEDIIGGHVWLGSICILGGIWHILTKPFAWARRALVWSGEAYLSYSLAAISVFGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDIQPWQERRSAEYMTHAPLGSLNSVGGVATEINAVNYVSPRSWLATSHFVLGFFFFVGHLWHAGRARAAAAGFEKGIDRDFEPVLSMTPLN

SEQ ID NO: 11775 - protein, 473 aa, Medicago truncatula
MKTLYSLRRFYHVETLFNGTLALTGRDQETTGFAWWAGNARLINLSGKLLGAHVAHAGLIVFWAGAMNLFEVAHFVPEKPMYEQGLILLPHLATLGWGVGPGGEVIDTFPYFVSGVLHLISSAVLGFGGIYHALLGPETLEESFPFFGYVWKDRNKMTTILGIHLILLGIGAFLLVFKASYFGGIYDTWAPGGGDVRKITNLTLSPSIILGYLLKSPFGGEGWIVSVDDLEDIIGGHVWLGSICILGGIWHILTKPFAWARRALVWSGEAYLSYSLAALSLFGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDIQPWQERRSAEYMTHAPLGSLNSVGGVATEINAVNYVSPRSWLATSHFVLGFFLFVGHLWHAGRARAAAAGFEKGIDRDSEPVLFMTPLN

SEQ ID NO: 11776 - protein, 203 aa, Juglans hindsii x Juglans regia
MKTLYSLRRFYPVETLFNGTLALSGRDQETTGFAWWAGNARLINLSGKLLGAHVAHAGLIVFWAGAMNLFEVAHFVPEKPMYEQGLILLPHLATLGWGVGPGGEVIDTFPYFVSGVLHLISSAVLGFGGIYHALLGPETLEESFPFFGYVWKDRNKMTTILGIHLILLGIGAFLLVFKALYFGGVYDTWAPGGGDEENYQLDP

SEQ ID NO: 11777 - protein, 473 aa, Unknown
  Sequence found in Organisms: Arabidopsis thaliana, Arabidopsis lyrata, Brassica rapa
MKTLYSLRRFYHVETLFNGTLALAGRDQETTGFAWWAGNARLINLSGKLLGAHVAHAGLIVFWAGAMNLFEVAHFVPEKPMYEQGLILLPHLATLGWGVGPGGEVIDTFPYFVSGVLHLISSAVLGFGGIYHALLGPETLEESFPFFGYVWKDRNKMTTILGIHLILLGVGAFLLVFKALYFGGVYDTWAPGGGDVRKITNLTLSPSVIFGYLLKSPFGGEGWIVSVDDLEDIIGGHVWLGSICIFGGIWHILTKPFAWARRALVWSGEAYLSYSLAALSVCGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDIQPWQERRSAEYMTHAPLGSLNSVGGVATEINAVNYVSPRSWLSTSHFVLGFFLFVGHLWHAGRARAAAAGFEKGIDRDFEPVLSMTPLN

SEQ ID NO: 11778 - protein, 473 aa, Amborella trichopoda
MKTLYSLRRFYPVETLFNGTLALAGRDQETTGFAWWAGNARLINLSGKLLGAHVAHAGLIVFWAGAMNLFEVAHFVPEKPMYEQGLILLPHLATLGWGVGPGGEVIDTFPYFVSGVLHLISSAVLGFGGIYHALLGPETLEESFPFFGYVWKDRNKMTTILGIHLILLGVGAFLLVFKALYFGGVYDTWAPGGGDVRKITNLTLSPSVIFGYLLKSPFGGEGWIVSVDDLEDIIGGHVWLGFICILGGIWHILTKPFAWARRAFVWSGEAYLSYSLGALSIFGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDIQPWQERRSAEYMTHAPLGSLNSVGGVATEINAVNYVSPRSWLATSHFVLGFFLFVGHLWHAGRARAAAAGFEKGIDRDFEPVLSMTPLN

SEQ ID NO: 11779 - protein, 353 aa, Arabidopsis lyrata
MTIALGKFTKDEKDLFDIMDDWLRRDRFVFVGWSGLLLFPCAYFALGGWFTGTTFVTSWYTHGLASSYLEGCNFLTAAVSTPANSLAHSLLLLWGPEAQGDFTRWCQLGGLWAFVALHGAFALIGFMLRQFELARSVQLRPYNAIAFSGPIAVFVSVFLIYPLGQSGWFFAPSFGVAAIFRFILFFQGFHNWTLNPFHMMGVAGVLGAALLCAIHGATVENTLFEDGDGANTFRAFNPTQAEETYSMVTANRFWSQIFGVAFSNKRWLHFFMLFVPVTGLWMSALGVVGLALNLRAYDFVSQEIRAAEDPEFETFYTKNILLNEGIRAWMAAQDQPHENLIFPEEVLPRGNAL

SEQ ID NO: 11780 - protein, 86 aa, Solanum phureja
MKTLYSRRRFYHVETLFNGTLALAGRDQETTGFAWWAGNARLINLSGKLLGAHVAHAGLIVFWAGAMNLFEVAHFVPEKPHCMNKD

SEQ ID NO: 11781 - protein, 292 aa, Ricinus communis
MKTLYSPRRFYHVETLFNGTLSLAGRDQETTGFTWWARNARLINLSGKLLGAHVAHAGLIVFWAGAMNLFEVAHFVLEKPMYEQGLILLPHLATLGWGVGPGGEVIDTFPYFVSGVLHLISSAVLGFGGIYHALLGPETLEESFPFFGYVWKDRNKMTTILGIHLILLGIGAFLLVFKALYFGGVYDTWAPGGGDVRKITNLTLSPSVIFGYLLKSPFGGEGWIVSVDDLEDIIGGHVWLGSICILGGIWHILTKPFAWARRALVWSGEAYLSYSLGVYCFWFHCLLLCLVQ

SEQ ID NO: 11782 - protein, 473 aa, Physcomitrella patens
MKILYSQRRFYHVETLFNGTLALSGRDQETTGFAWWAGNARLINLSGKLLGAHVAHAGLIVFWAGAMNLFEVAHFVPEKPMYEQGLILLPHLATLGWGVGPGGEVIDTFPYFVSGVLHLISSAVLGFGGIYHALIGPETLEESFPFFGYVWKDKNKMTTILGIHLILLGAGAFLLVFKALYFGGIYDTWAPGGGDVRKITNLTLSPGVIFGYLLKSPFGGEGWIVSVDNLEDIIGGHVWLGSICIFGGIWHILTKPFAWARRALVWSGEAYLSYSLGAIAVFGFIACCFVWFNNTAYPSEFYGPTGPEASQAQAFTFLVRDQRLGANVGSAQGPTGLGKYLMRSPTGEIIFGGETMRFWDLRAPWLEPLRGPNGLDLSKLKKDIQPWQERRSAEYMTHAPLGSLNSVGGVATEINAVNYVSPRSWLATSHFVLGFFFFVGHLWHAGRARAAAAGFEKGIDRDFEPVLSMTPLN

SEQ ID NO: 11783 - protein, 473 aa, Oryza sativa
MKILYSLRRFYHVETLFNGTFVLAGRDQETTGFAWWAGNARLINLSGKLLGAHVAHAGLIVFWAGAMNLFEVAHFVPEKPMYEQGLILLPHLATLGWGVGPGGEVLDTFPYFVSGVLHLISSAVLGFGGIYHALLGPETLEESFPFFGYVWKDRNKMTTILGIHLILLGIGAFLLVLKALYFGGIYDTWAPGGGDVRKITNLTLSPGVIFGYLLKSPFGGEGWIVSVDDLEDIIGGHVWLGFICVFGGIWHILTKPFAWARRAFVWSGEAYLSYSLGALSVFGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDIQPWQERRSAEYMTHAPLGSLNSVGGVATEINAVNYVSPRSWLATSHFVLGFFFFVGHLWHAGRARAAAAGFEKGIDRDLEPVLYMTPLN

SEQ ID NO: 11784 - protein, 474 aa, Citrus sinensis
MKTLYSLRRFYPVETLFNGTLAVAGRDQETTGFAWWAGNARLINLSGKLLGAHVAHAGLIVFWAGAMNLFEVAHFVPEKPMYEQGLILLPHLATLGWGVGPGGEVIDTFPYFVSGVLHLISSAVLGFGGIYHALLGPETLEESFPFFGYVWKDRNKMTTILGIHLILLGIGAFLLVFKALYFGGVYDTWAPGGGEMLRKITNLTLSPSVIFGYLLKSFFGGEGWIVSVDDLEDIIGGHVWLGSICIFGGIWHILTKPFAWARRALVWSGEAYLSYSLGALAVFGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDIQPWQERRSAEYMTHAPLGSLNSVGGVATEINAVNYVSPRTWLSTSHFVLGFFFFVGHLWHAGRARAAAAGFEKGIDRDFEPVLSMTPIN

SEQ ID NO: 11785 - protein, 473 aa, Unknown
  Sequence found in Organisms: Sorghum bicolor, Panicum virgatum
MKILYSLRRFYHVETLFNGTFVLAGRDQETTGFAWWAGNARLINLSGKLLGAHVAHAGLIVFWAGAMNLFEVAHFVPEKPMYEQGLILLPHLATLGWGVGPGGEVLDTFPYFVSGVLHLISSAVLGFGGIYHALLGPETLEESFPFFGYVWKDRNKMTTILGIHLILLGLGAFLLVLKALYFGGVYDTWAPGGGDVRKITNLTLSPGVIFGYLLKSPFGGEGWIVSVDDLEDIIGGHVWLGSICVLGGIWHILTKPFAWARRAFVWSGEAYLSYSLGALSVFGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDIQPWQERRSAEYMTHAPLGSLNSVGGVATEINAVNYVSPRSWLATSHFVLGFFFFVGHLWHAGRARAAAAGFEKGIDRDLEPVLYMTPLN

SEQ ID NO: 11786 - protein, 353 aa, Saccharum officinarum
MTIAVGRVTKEENDLFDIMDDWLRRDRFVFVGWSGLLLFPCAYFALGGWFTGTTFVTSWYTHGLASSYLEGCNFLTAAVSTPANSLAHSLLLLWGPEAQGDFTRWCQLGGLWTFVALHGAFALIGFMLRQFELARSVQLRPYNAISFSGPIAVFVSVFLIYPLGQSGWFFAPSFGVAAIFRFILFFQGFHNWTLNPFHMMGVAGVLGAALLCAIHGATVENTLFEDGDGANTFRAFNPTQAEETYSMVTANRFWSQIFGVAFSNKRWLHFFMLFVPVTGLWMSAIGVVGLALNLRAYDFVSQEIRAAEDPEFETFYTKNILLNEGIRAWMAAQDQPHENLIFPEEVLPRGNAL

SEQ ID NO: 11787 - protein, 300 aa, Oryza sativa
MKILYSLRRFYHVETLFNGTFVLAGRDQETTGFAWWAGNARLINLSGKLLGAHVAHAGLIVFWAGAMNLFEVAHFVPEKPMYEQGLILLPHLATLGWGVGPGGEVLDTFPYFVSGVLHLISSAVLGFGGIYHALLGPETLEESFPFFGYVWKDRNKMTTILGIHLILLGIGAFLLVLKALYFGGIYDTWAPGGGDVRKITNLTLSPGVIFGYLLKSPFGGEGWIVSVDDLEDIIGGHVWLGFICVFGGIWHILTKPFAWARRAFVWSGEAYLSYSLGALSVFGFIACCFVWFNNTAYPSE

SEQ ID NO: 11788 - protein, 473 aa, Oryza sativa
MKILYSLRRFYHVETLFNGTFVLAGRDQETTGFAWWAGNARLINLSGKLLGAHVAHAGLIVFWAGAMNLFEVAHFVPEKPMYEQGLILLPHLATLGWGVGPGGEVLDTFPYFVSGVLHLISSAVLGFGGIYHALLGPETLEESFPFFGYVWKDRNKMTTILGIHLILLGIGAFLLVLKALYFGGIYDTWAPGGGDVRKITNLTLSPGVIFGYLLKSPFGGEGWIVSVDDLEDIIGGHVWLGFICVFGGIWHILTKPFAWARRAFVWSGEAYLSYSLGALSVFGFIACCFVWFNNTAYPSEFYGPTGPEASQAQAFTFLVRDQRLGANVGSAQGPTGLGKYLMRSPTGEVIFGGETMHFWDLRAPWLEPLRGPNGLDLSRLKKDIQPWQERRSAEYMTHAPLGSLNSVGGVATEINAVNYVSPRSWLATSHFVLGFFFFVGHLWHAGRARAAAAGFEKGIDRDLEPVLYMTPLN

SEQ ID NO: 11789 - protein, 480 aa, Raphanus sativus
MAAQDQPHETLYSLRRFYHVETLFNGTLALAGRDQETTGFAWWAGNARLINLSGKLLGAHVAHAGLIVFWAGAMNLFEVAHFVPEKPMYEQGLILLPHLATLGWGVGPGGEVIDTFPYFVSGVLHLISSAVLGFGGIYHALLGPETLEESFPFFGYVWKDRNKMTTILGIHLILLGVGAFLLVFKALYFGGVYDTWAPGGGDVRKITNLTLSPSVIFGYLLKSPFGGEGWIVSVDDLEDIIGGHVWLGSICIFGGIWHILTKPFAWARRALVWSGEAYLSYSLAALSVCGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDIQPWQERRSAEYMTHAPLGSLNSVGGVATEINAVNYVSPRSWLSTSHFVLGFFLFVGHLWHAGRARAAAAGFEKGIDRDFEPVLSMTPLN

SEQ ID NO: 11790 - protein, 473 aa, Zamia vazquezii
MKTLYSLRRFYPVETLFNGTLALAGRDQETTGFAWWAGNARLINLSGKLLGAHVAHAGLIVFWAGAMNLFEVAHFVPEKPMYEQGLILLPHLATLGWGVGPGGEVVDTFPYFVSGVLHLISSAVLGFGGIYHALIGPETLEESLPFFGYVWKDRSKMTTILGIHLILLGVGAFLLVLKALYFGGVYDTWAPGGGDVRKITNPTLSPSVIFGYLLESPFGGEGWIVSVDNLEDIIGGHVWLGSICIFGGIWHILTKPFAWARRAFVWSGEAYLSYSLGALSVFGFIACCFVWFNNTAYPSEFYGPTGPEASQAQAFTFLVRDQRLGANVGSAQGPTGLGKYLMRSPTGEIIFGGETMRFWDLRAPWLEPLRGPNGLDLSRLKKDIQPWQERRSAEYMTHAPLGSLNSVGGVATEINAVNYVSPRSWLATSHFVLGFFFFVGHLWHAGRARAAAAGFEKGIDRDFEPVLSMNPLN

SEQ ID NO: 11791 - protein, 353 aa, Cycas rumphii
MTVALGKSSKEEKNLFDIADDWLRRDRFVFVGWSGLLLFPCAYFALGGWFTGTTFVTSWYTHGLASSYLEGCNFLTAAVSTPANSLAHSLLLLWGPEAQGDFTRWCQLGGLWTFVAFHGGFGLIGFMLRQFELARSVQLRPYNAIAFSAPIAVFVSVFLIYPLGQSGWFFAPSFGVAAIFRFILFFQGFHNWTLNPFHMMGVAGVLGAALLCAIHGATVENTLFEDGDGANTFRAFNPTQAEETYSMVTANRFWSQIFGVAFSNKRWLHFFMLFVPVTGLWMSAIGVVGLALNLRAYDFVSQEIRAAEDPEFETFYTKNILLNEGIRAWMAAQDQPHENLIFPEEVLPRGNAL

SEQ ID NO: 11792 - protein, 473 aa, Hordeum vulgare
MKILYSLRRFYHVETLFNGTFVLAGRDQETTGFAWWAGNARLINLSGKLLGAHVAHAGLIVFWAGAMNLFEVAHFVPEKPMYEQGLILLPHLATLGWGVGPGGEVLDTFPYFVSGVLHLISSAVLGFGGIYHALLGPETLEESFPFFGYVWKDRNKMTTILGIHLILLGLGAFLLVLKALYFGGVYDTWAPGGGDVRKITNLTLSPSVIFGYLLKSPFGGEGWIVSVDDLEDIIGGHVWLGFICVFGGIWHILTKPFAWARRAFVWSGEAYLSYSLAALSVFGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDIQPWQERRSAEYMTHAPLGSLNSVGGVATEINAVNYVSPRSWLSTSHFVLGFFFFVGHLWHAGRARAAAAGFEKGIDRDLEPVLYMNPLN

SEQ ID NO: 11793 - protein, 473 aa, Marchantia polymorpha
MKILYSQRRFYPVETLFNGTLALGGRDQETTGFAWWAGNARLINLSGKLLGAHVAHAGLIVFWAGAMNLFEVAHFVPEKPMYEQGLILLPHLATLGWGVGPGGEIVDTFPYFVSGVLHLISSAVLGFGGIYHALIGPETLEESFPFFGYVWKDKNKMTTILGIHLILLGAGAFLLVFKALYFGGIYDTWAPGGGDVRKITNLTLSPGVIFGYLLKSPFGGEGWIVSVDNLEDIIGGHVWLGSICIFGGIWHILTKPFAWARRALVWSGEAYLSYSLGAIAVFGFIACCFVWFNNTAYPSEFYGPTGPEASQAQAFTFLVRDQRLGANVGSAQGPTGLGKYIMRSPTGEIIFGGETMRFWDLRAPWLEPLRGPNGLDLSKLKKDIQPWQERRSAEYMTHAPLGSLNSVGGVATEINAVNYVSPRSWLATSHFVLGFFFFVGHLWHAGRARAAAAGFEKGIDRDFEPVLSMTPLN

SEQ ID NO: 11794 - protein, 473 aa, Brachypodium distachyon
MKILYSLRRFYHVETLFNGTFVLAGRDQETTGFAWWAGNARLINLSGKLLGAHVAHAGLIVFWAGAMNLFEVAHFVPEKPMYEQGLILLPHLATLGWGVGPGGEVLDTFPYFVSGVLHLISSAVLGFGGIYHALLGPETLEESFPFFGYVWKDRNKMTTILGIHLILLGLGAFLLVLKALYFGGVYDTWAPGGGDVRKITNLTLSPGVIFGYLLKSPFGGEGWIVSVDDLEDIIGGHVWLGFICVFGGIWHILTKPFAWARRAFVWSGEAYLSYSLAALSVFGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDIQPWQERRSAEYMTHAPLGSLNSVGGVATEINAVNYVSPRSWLSTSHFVLGFFFFVGHLWHAGRARAAAAGFEKGIDRDLEPVLYMNPLN

SEQ ID NO: 11795 - protein, 473 aa, Zea mays
MKILYSLRRFYHVETLFNGTFVLAGRDQETTGFAWWAGNARLINLSGKLLGAHVAHAGLIVFWAGAMNLFEVAHFVPEKPMYEQGLILLPHLATLGWGVGPGGEVLDTFPYFVSGVLHLISSAVLGFGGIYHALLGPETLEESFPFFGYVWQDRNKMTTLLGIHLILLGLGAFLLVLKALYFGGVYDTWAPGGGDVRKITNLTLSPGVIFGYLLKSPFGGEGWIVSVDDLEDIIGGHVWLGSICVLGGIWHILTKPFAWARRAFVWSGEAYLSYSLGALSVFGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDGQPWQERRSGEYMTHAPLGSLNSVGGVATEINAVNYVSPRSWLATSHFVLGFFFFVGHLWHAGRARAAAAGFEKGIDRDLEPVVYMTPLN

SEQ ID NO: 11796 - protein, 461 aa, Solanum tuberosum
VETLFNGTLALAGRDQETTGFAWWAGNARLINLSGKLLGAHVAHAGLIVFWAGAMNLFEVAHFVPEKPMYEQGLILLPHLATLGWGVGPGGEVIDTFPYFVSGVLHLISSAVLGFGGIYHALLGPETLEESFPFFGYVWKDRNKMTTILGIHLILLGIGAFLLVFKALYFGGVYDTRAPGGGDVRKITNLTLSPSIIFGYLLKSPFGGEGWIVSVDDLEDIIGGHVWLGSICILGGIWHILTKPFAWARRALVWSGEAYLSYSLGALAVFGFIACCFVWFNNTAYPSEFYGPTGPEASQAQAFTFLVRDQRLGANVGSAHGPTGLGKYLMRSPTGEVIFGGETMRFWDLRAPWLEPLRGPNGLDLTRLKKDIQPWQERRSAEYMTHAPLGSLNSVGGVATEINAVNYVSPRSWLATSHFVLGFFFFVGHLWHAGRARAAAAGFEKGIDRDFEPVLFMTPLN

SEQ ID NO: 11797 - protein, 258 aa, Arabidopsis lyrata
MKTLYSLRRFYHVETLFNGTLALAGRDQETTGFAWWAGNARLINLSSKLLGAHVAHAGLIVFWAGAMNLFEVAHFVPEKPMYEQGLILLPHLATLGWGVGPGGEVIDTFPYFVSRVLHLISSAVLGFGGIYHALLGPKTLEESFPFFGYVWKDRNKMTTILGIHLILLGVGAFLLVFKALYFGGVYDTWAPGGGDVRKITNLTLSPSVIFGYLLKSPFGGEGWIVSVDDLEHIIGGHVWLGSICIFGGIWHILTKPFA

SEQ ID NO: 11798 - protein, 82 aa, Artemisia annua
MTIALGKFTKDEKDLFDIMDDWLRRDRFVFVGWSGLLLFPCAYFAVGLVHGYNLCNFMVYPWISQFLFGRLQFLNCRSFYSC

SEQ ID NO: 11799 - protein, 191 aa, Setaria italica
MMGVAGVLGAALLCAIHGATVENTLFEDGDGANTFRAFNPTQAEETYSMVTANRFWSQIFGVAFSNKRWLHFFMLFVPVTGLWMSAIGVVGLALNLRAYDFVSQEIRAAEDPEFETFYTKNILLNEGIRAWMAAQISLMKILYSLRRFYHVETLFNGTFVLAGRDQETTGFAWWAGNARLINLSGNYLELM

SEQ ID NO: 11800 - protein, 793 aa, Medicago truncatula
MTIALGKFTKDENDLFDIMDDWLRRDRFVFVGWSGLLLFPCAYFAVGGWFTGTTFVTSWYTHGLASSYLEGCNFLTAAVSTPANSLAHSLLLLWGPEAQGDFTRWCQLGGLWTFVALHGAFGLIGFMLRQFELARSVQLRPYNAIAFSGPIAVFVSVFLIYPLGQSGWFFAPSFGVAAIFRFILFFQGFHNWTLNPFHMMGVAGVLGAALLCAIHGATVENTLFEDGDGANTFRAFNPTQAEETYSMVTANRFWSQIFGVAFSNKRWLHFFMLFVPVTGLWMSALGVVGLALNLRAYDFVSQEIRAAEDPEFETFYTKNILLNEGIRAWMAAQDQPHENLIFPEEVLPQTTGFAWWAGNARLINLSGKLLGAHVAHAGLIVFWAGAMNLFEVAHFVPEKPMYEQGLILLPHLATLGWGVGPGGEVIDTFPYFVSGVLHLISSAVLGFGGIYHALLGPETLEESFPFFGYVWKDRNKMTTILGIHLILLGIGAFLLVFKASYFGGIYDTWAPGGGDVRKITNLTLSPSIILGYLLKSPFGGEGWIVSVDDLEDIIGGHVWLGSICILGGIWHILTKPFAWARRALVWSGEAYLSYSLAALSLFGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDIQPWQERRSAEYMTHAPLGSLNSVGGVATEINAVNYVSPRSWLATSHFVLGFFLFVGHLWHAGRARAAAAGFEKGIDRDSEPVLFMTPLN

SEQ ID NO: 11801 - protein, 353 aa, Citrus clementina
MTIALGKFTKEEKDLFDIMDDWLRRDRFVFVGWSGLLLFPCAYFALGGWFTGTTFVTSWYTHGLASSYLEGCNFLTAAVSTPANSLAHSLLLLWGPEAQGDFTRWCQLGGLWTFVAFHGAFRLIGFMLRQFELARSVQLRPYNAIAFSAPIAFFVSVFLIYPLGQSGWFFAPSFGVAAIFRFILFFQGFHNWTLNPFHMMGVAGVLGAALLCAIHGATVENTLFEDGDGANTLRVFNPTQAEKTYSMVTANRFWSQIFGVAFSNKRWLHFFMLFVPVTGLWMSALGVVGLAQNLRAYDFISQEICAAEDPEFETFYTKNILLNEGIRAWMAAQDQPHENLIFPEEVLPRGNAL

SEQ ID NO: 11802 - protein, 487 aa, Sorghum bicolor
MRVFVRGWQLRISLMKILYSLRRFYHVETLFNGTFVLAGRDQETTGFAWWAGNARLINLSGKLLGAHVAHAGLIVFWAGAMNLFEVAHFVPEKPMYEQGLILLPHLATLGWGVGPGGEVLDTFPYFVSGVLHLISSAVLGFGGIYHALLGPETLEESFPFFGYVWKDRNKMTTILGIHLILLGLGAFLLVLKALYFGGVYDTWAPGGGDVRKITNLTLSPGVIFGYLLKSPFGGEGWIVSVDDLEDIIGGHVWLGSICVLGGIWHILTKPFAWARRAFVWSGEAYLSYSLGALSVFGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDIQPWQERRSAEYMTHAPLGSLNSVGGVATEINAVNYVSPRSWLATSHFVLGFFFFVGHLWHAGRARAAAAGFEKGIDRDLEPVLYMTPLN

SEQ ID NO: 11803 - protein, 353 aa, Adiantum capillus-veneris
MTIAIGKSSKEPKDLFDSMDDWLRRDRFVFVGWSGLLLFPTAYFALGGWFTGTTFVTSWYTHGLASSYLEGCNFLTAAVSTPANSLAHSLLLLWGPEAQGDFTRWCQLGGLWTFVALHGSFALIGFMLRQFELARSVQLRPYNAVAFSGPIAVFVSVFLIYPLGQSGWFFAPSFGVAAIFRFILFFQGFHNWTLNPFHMMGVAGVLGAALLCAIHGATVENTLFEDGDGANTFRAFNPTQSEETYSMVTANRFWSQIFGVAFSNKRWLHFFMLFVPVTGLWMSAIGVVGLALNLRAYDFVSQEIRAAEDPEFETFYTKNILLNEGIRAWMAAQDQPHENLVFPEEVLPRGNAL

SEQ ID NO: 11804 - protein, 353 aa, Pteridium aquilinum
MTIAIGKSSKEPKDLFDSMDDWLRRDRFVFVGWSGLLLFPTAYFALGGWFTGTTFVTSWYTHGLASSYLEGCNFLTAAVSTPANSLAHSLLLLWGPEAQGDFTRWCQLGGLWTFVALHGSFALIGFMLRQFELARSVQLRPYNAIAFSGPIAVFVSVFLIYPLGQSGWFFAPSFGVAAIFRFILFFQGFHNWTLNPFHMMGVAGVLGAALLCAIHGATVENTLFEDGDGANTFRAFNPTQSEETYSMVTANRFWSQIFGVAFSNKRWLHFFMLFVPVTGLWMSAIGVVGLALNLRAYDFVSQEIRAAEDPEFETFYTKNILLNEGIRAWMAAQDQPHENLVFPEEVLPRGNAL

SEQ ID NO: 11805 - protein, 432 aa, Camellia sinensis
LINLSGKLLGAHVAHAGLIVFWAGAMNLFEVAHFVPEKPMYEQGLILLPHLATLGWGVGPGGEVIDTFPYFVSGVLHLISSAVLGFGGIYHALLGPETLEESFPFFGYVWKDRNKMTTILGIHLILLGIGAFLLVFKALYFGGVYDTWAPGGGDVRKITNLTLSPSIIFGYLLKSPFGGEGWIVSVDDLEDIIGGHVWLGSICILGGIWHILTKPFAWARRALVWSGEAYLSYSLGALSVCGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDIQPWQERRSAEYMTHAPLGSLNSVGGVATEINAVNYVSPRSWLSTSHFVLAFFLFVGHLWHAGRARAAAAGFEKGIDRDFEPVLSMTPFN

SEQ ID NO: 11806 - protein, 107 aa, Eutrema halophilum
MHSPTGEVIFGGETMHFWDLRAPWLEPLRGPNGLDLSRLKKDIQPWQERHSAEYMTHAPLGSLNSVGGVANEINAVNYVSPRSWLSTSHFVLGFFIFVVHLWHAGRA

SEQ ID NO: 11807 - protein, 424 aa, Tamarix hispida
  misc_feature (23)..(23): Xaa can be any naturally occurring amino acid
GGAHVAHAGLIVFWAGAMNLFEXAHFVPEKPMYEQGLILLPHLATLGWGVGPGGEVIDTFPYFVSGVLHLISSAVLGFGGIYHALLGPETLEESFPFFGYVWKDRNKMTTILGIHLILLGIGAFLLVFKALFFGGVYDTWAPGGGDVRKITNLTLSPSIIFGYLLKSPFGGEGWIVSVDDLEDIIGGHVWLGSICILGGIWHILTKPFAWARRALVWSGEAYLSYSLGALSVFGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDIQPWQERRSAEYMTHAPLGSLNSVGGVATEINAVNYVSPRSWLATSHFVLGFFLFVGHLWHAGRARAAAAGFEKGIDRDFEPVLSMTPLN

SEQ ID NO: 11808 - protein, 418 aa, Liriodendron tulipifera
MKTLYSLRRFYPVETLFNGTLSLAGRDQETTGFAWWAGNARLINLSGKLLGAHVAHAGLIVFWAGAMNLFEVAHFVPEKPMYEQGLILLPHLATLGWGVGPGGEVVDTFPYFVSGVLHLISSAVLGFGGIYHALLGPETLEESFPFFGYVWKDRNKMTTILGIHLILLGIGAFLLVLKALYFGGVYDTWAPGGGDVRKITNLTLSPSVIFGYLLKSPFGGEGWIVSVDDLEDIIGGHVWLGSICILGGIWHILTKPFAWARRAFVWSGEAYLSYSLGALSVFGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDIQPWQERRSAEYMTHAPLGSLNSVGGVATEINAVN

SEQ ID NO: 11809 - protein, 424 aa, Glycine max
MKTLYSLRRFYHVETLFNGTLALTGRDQETTGFAWWAGNARLINLSGKLLGAHVAHAGLIVFWAGAMNLFEVAHFVPEKPMYEQGLILLPHLATLGWGVGPGGEVIDTFPYFVSGVLHLISSAVLGFGGIYHALLGPETLEESFPFFGYVWKDRNKMTTILGIHLILLGIGAFLLVFKALYFGGIYDTWAPGGGDVRKITNLTLSPSIIFGYLLKSPFGGEGWIVSVDDLEDIIGGHVWLGSICILGGIWHILTKPFAWARRALVWSGEAYLSYSLGALSVFGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDIQPWQERRSAEYMTHAPLGSLNSVGLISSSQLRNTFLLEVG

SEQ ID NO: 11810 - protein, 418 aa, Ananas comosus
MKTLYSLRRFYHVETLFNGTLALAGRDQETTGFAWWAGNARLINLSGKLLGAHVAHAGLIVFWAGAMNLFEVAHFVPEQPMYEQGLILLPHLATLGWGVGPGGEVIDTFPYFVSGVLHLISSAVLGFGGIYHALLGPETLEESFPFFGYVWKDRNKMTTILGIHLILLGIGAFLLVLKALYFGGVYDTWAPGGGDVRKITNLTLSPSVIFGYLLKSPFGGEGWIVSVDALEDIIGGHVWIGSICILGGIWHILTKPFAWARRAFVWSGEAYLSYSLGALSVFGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDIQPWQERRPPQYMTHAPLGSLNSVGGVPTDINAVN

SEQ ID NO: 11811 - protein, 425 aa, Nuphar advena
MKTLYSLRRFYPVETLFNGTLALAGRDQETTGFAWWAGNARLINLSGKLLGAHVAHAGLIVFWAGAMNLFEVAHFVPEKPMYEQGLILLPHLATLGWGVGPGGEVVDTFPYFVSGVLHLISSAVLGFGGIYHALLGPETLEESFPFFGYVWKDRNKMTTILGIHLILLGLGAFLLVFKALYFGGVYDTWAPGGGDVRRITNLTLSPSIIFGYLTKVSLWGLKSPFGGEGWIVSVDDLEDIIGGHVWLGSICILGGIWHILTKPFAWARRAFVWSGEAYLSYSLGALSVFGFIACCFVWFNNTAYPSEFYGPTGPEASQAQAFTFLVRDQRLGANVGSAQGPTGLGKYLMRSPTGEIIFGGETMRFWDLRAPWLEPLRGPNGLDLSRLKKDIQPWQERRSAEYMTHAPLGSLNSVGGVATEINAVN

SEQ ID NO: 11812 - protein, 407 aa, Chlamydomonas reinhardtii
MNLFEVSHFVPEKPMYEQGLILLPHIATLGYGVGPGGEIIDTFPYFVSGVLHLISSAVLGFGGVYHSLIGPETLEESYPFFGYVWKDKNKMTNILGYHLIMLGLGAWLLVWKAMYFGGVYDTWAPGGGDVRVITNPTTNAAVIFGYLVKSPFGGDGWICSVDNMEDIIGGHIWIGTLEILGGIWHIYTTPWPWARRAFVWSGEAYLSYSLGAIGVMGFIACCMSWFNNTAYPSEFYGPTGPEASQSQAFTFLVRDQRLGANVASAQGPTGLGKYLMRSPTGEIIFGGETMRFWDFRGPWLEPLRGPNGLDLNKLKNDIQPWQERRAAEYMTHAPLGSLNSVGGVATEINAVNFVSPRSWLACSHFCLGFFFFIGHLWHAGRARAAAAGFEKGIDRFDEPVLSMRPLD

SEQ ID NO: 11813 - protein, 407 aa, Sorghum bicolor
MNLFEVAHFVPEKPMYEQGLILLPHLATLGWGVGPGGEVLDTFPYFVSGVLHLISSAVLGFGGIYHALLGPETLEESFPFFGYVWKDRNKMTTILGIHLILLGLGAFLLVLKALYFGGVYDTWAPGGGDVRKITNLTLSPGVIFGYLLKSPFGGEGWIVSVDDLEDIIGGHVWLGSICVLGGIWHILTKPFAWARRAFVWSGEAYLSYSLGALSVFGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDIQPWQERRSAEYMTHAPLGSLNSVGGVATEINAVNYVSPRSWLATSHFVLGFFFFVGHLWHAGRARAAAAGFEKGIDRDLEPVLYMTPLN

SEQ ID NO: 11814 - protein, 411 aa, Arabidopsis lyrata
MKTLYSLRRFYHVETLFNGTLALAGRDQETTGFAWWAGNARLINLSSKLLGAHVAHAGLIVFWAGAMNLFEVAHFVPEKPMYEQGLILLPHLATLGWGVGPGGEVIDTFPYFVSRVLHLISSAVLGFGGIYHALLGPKTLEESFPFFGYVWKDRNKMTTILGIHLILLGVGAFLLVFKALYFGGVYDTWAPGGGDVRKITNLTLSPSVIFGYLLKSPFGGEGWIVSVDDLEHIIGGHVWLGSICIFGGIWHILTNEFYGPTGPEASQAQAFTFLVRDQRLGANVGSAQGPTCLGKYLMRSPTGEVIFGGETMRFWDMLKKDIQPWQERRSAKYMTHAPLGSLNSVGGVATEINAVNYVSPRSWLSTSHFFLGLFLFVGHLWHAGRARAAAAGFEKGIDRDFEPVLSMTPLN

SEQ ID NO: 11815 - protein, 161 aa, Vigna unguiculata
MEAPPEGYRRNVGICLMNAHKKIFAASRLDIPNAWQMPQGGIDEGEDPRNAAIRELREETGVNSAEVIAEVPYWLTYDFPPKVREKLNIQWGSDWKGQAQKWFLLRFTGQDQEINLLGDGTEKAEFGEWSWISPEQVIDLAVDFKKPVYKEVLAEFAPYFQ

SEQ ID NO: 11816 - protein, 161 aa, Glycine max
MEAPPEGYRRNVGICLMSNHKKIFAASRLDIPNSWQMPQGGIDEGEDPRNAAIRELREETGVNSAEVIAEVPYWLTYDFPPKVREKLNIQWGSDWKGQAQKWFLFKFTGQDQEINLLGDGTEKAEFGEWSWISPEQVIELAVDFKKPVYKEVLAVFAPYFQ

SEQ ID NO: 11817 - protein, 161 aa, Glycine max
MEAPPEGYRRNVGICLMNNHKKIFAASRLDIPNAWQMPQGGIDEGEDPRNAAIRELREETGVNSVEVIAEVPYWLTYDFPPKVREKLNIQWGSDWKGQAQKWFLFKFTGQDQEINLLGDGTEKAEFGEWSWISPEQVIELAVDFKKPVYKEVLAVFAPHFQ

SEQ ID NO: 11818 - protein, 161 aa, Cajanus cajan
MEAPPEGYRKNVGICLMNNQKKIFAASRLDIPNAWQMPQGGVDEGEDPRNAAIRELREETGVSSAEVIAEVPFWLTYDFPPKVREKLNAQWGSDWKGQAQKWFLFKFIGQDQEINLLGDGTEKAEFGEWSWISPEQIIELAVDFKKPVYKEVLAVFAPYLQ

SEQ ID NO: 11819 - protein, 438 aa, Glycine max
MAAATNLLATLGDLERDSFVALLSKLIAESKYVQNNPPELIPQEDRVVKHVLDVLLPFSTTTGGGPLLVNHVTYHAGRGNLIVEYPGTVPGKILSFVGCHMDVVTANPNDWDFDPFSLSVDGDKLRGRGTTDCLGHVALVTELMRKLGETKPNLKSSVVAVFIANEENSAITGVGVDALVKDGLLNKLKDGPLYWIDTADKQPCVGTGGMIPWKLHVTGRLFHSGLAHKAINALELAMDALKEIQLRFYSDFPPHPQEQVYGFATPSTLKPTQWSYPGGGINQIPGECTISGDVRLTPFYNVKDVMKKLQEYVDDINESAQKLESRGPVSKYVLPDENIRGRLTLSFDEALSGVACDLNSRGFHVLCKATEEVVGYVKPYSITGSLPLIRELQEEGFDVQTSGYGLMATYHAQNEYCLFTDMSQGYRVFARIISQLEE

SEQ ID NO: 11820 - protein, 440 aa, Cajanus cajan
MASTTNLLATLGDLERESFVSLLSKLIGESKHVQNNPPELIPQEDRVVKHVLDSLLPFSTSTGGGPLLLNHVAYLPGRGNLIVEYPGTVPGKILSFVGCHMDVVTANPDDWDFDPFTLSIDGDKLRGRGTTDCLGHVALVTQLMKKLGETKPKLKSTVVAVFIANEENSAITGVGVDALVNNGLLNKLKDGPLFWIDTADKQPCVGTGGMIPWKLNVTGKLFHSGLAHKAINALELAMDALKEIQLRFYHDFPPHPREQVYGFATPSTMKPTQWSYPGGGINQIPGECTISGDVRLTPFYNVKDVMKKLQEYVNNINENIQKLETRGPVSKYVLPDENIKGSLTLTFDEALSGVACDLNSRGFHVLCKATEEVVGHVKPYSITGSLPLIRELQDEGFDVQTSGYGLMVTYHAKNEYCLFTDMSQGYGVFARIISQLEDSE

SEQ ID NO: 11821 - protein, 432 aa, Cicer arietinum
MATSKKLLETLGDLERDSFVPLLSKLIGESKHVQNNPPELIPEEDRVVKHVLNSLLPFSTTTGGGPLILNHVTYFPGRGNLIVEYPGTVPGKILSFVGCHMDVVTANPNDWDFDPFSLSIDGDKLRGRGTTDCLGHVALVTELMRKLGETKPNLKSTVVAVFIANEENSSITGVGIDALVQDGLLSKLKDGPLFWIDTADKQPCVGTGGMIPWKLHVTGKLFHSGLAHKAINPLELAMDAIKEIQLRFYRDFPPHPQEQVYGFATPSTMKPTQWSYPGGGINQIPGECTISGDVSVKDVMKKLQEYVADINENIQKLESRGPVSKYVLSDANLRGSLTLTFDEATSGVACDLNSRGFHVLCKATEEIVGHVKPYSITGSLPLIRELQDGGFDVQTCGYGLMATYHAQNEYCLFTDMSQGYRVFASIVAQLED

SEQ ID NO: 11822 - protein, 435 aa, Lupinus angustifolius
MADLKETLGDLNRDSFVPLLSKLIGESKYVQNNPPDLIPQEDRVVNHVLDALRPFSTTTGGGPLILNHVAYFPGRGNLIVQYPGTVPGKILSFVGCHMDVVTANPNDWDFDPFSLSIEGDKLKGRGTTDCLGHVALVTELMRKLGQTKPKLKSTVVAVFIANEENSAISGVGVDALVKDGLLDNLKQGPLFWVDTADKQPCVGTGGMIPWKLHVTGKLFHSGLAHKAINPLELAMEALKEIQLRFYRDFPPHPQEQVYGFATPSTMKPTQWSYPGGGINQIPGECTISGDVRLTPFYNVKNVMEKLQEYVDDINKNIEKIESRGPVSKYVLPDENLRGSLTLTFDEASSGVACDLNSRGFHVLCKATEEVVGHVKPYSITGTLPLIRDLKDEGFDVQTCGYGLMATYHAKNEYCLFTDMSQGYGVFVSIISQLED

SEQ ID NO: 11823 - protein, 436 aa, Arachis hypogaea
MAKVKEILGDLQRDSFVELLSKLIGESKYVQNNPPELIPEEDRVVKHVLDSLLPLSTTTGGGPLILNHVTYFPGRGNLIVEYPGTSPDKILSFVGCHMDVVTANPNDWDFDPFTLSIDGDKLRGRGTTDCLGHVALVTELFRKLGETKPSLKSSVVAVFIANEENSAITGVGVDALVKDGLLNKLKKGPLFWIDTADKQPCIGTGGMIPWKLHVTGKLFHSGLAHKAINPLELAMDALKEIQSRFYEDFPPHPQEQIYGFATASTMKPTQWSYPGGGINQIPGECTISGDVRLTPFYNVKDVVTKLQEYVDDINLNIHKLETRGPVSKYVLPDDDLRGSLTLTFDEANSGVACDLNSRGYHVLCKATEEVVGHVKPYSITGSLPLIRELQDEGFDVQTAGYGLMATYHAQNEYCLFTDMSQGYRVFASIIAQLEED

SEQ ID NO: 11824 - protein, 437 aa, Lotus japonicus
MAAATTLLETLGDLDRDSFVPLLSKLIGESKHLQNNPPELIPEEDRAVKHVMDVLLPFSTTTGGGPLILNHVTYFPGRGNLIVEYPGTHPSKVLSFVGCHMDVVTANPNDWDFDPFTLSVDGDKLRGRGTTDCLGHVALVTELMRKLGETKPNLKSTVVAVFIANEENSAITGVGVDALVKDGLLNKLKNGPLFWIDTADKQPCVGTGGMIPWKLHVTGKLFHSGLAHKAINPLELAMDAMKEIQLRFYRDFPPHPQEQVYGFATPSTMKPTQWSYPGGGINQIPGECTISGDCSNTLFSVKDVMKKLQEYVGDINENISKLEARGPVSKYVLSDENLRGSLTITFDEAMSGVACDLNSRGFHVLCKATEEVVGHVKPYSMTGSLPLIRELQDEGFDVQTSGYGLMATYHAQNEYCLFNDMSQGYRVFTSVISQLED

SEQ ID NO: 11825 - protein, 438 aa, Prunus mume
MASSTDLKKILGDLNKDSFISLLSKLIGESKYLQNNPPELIPQEDRAVKHVLDSLLPLSTTTGGGPLVINHVTYFPGRGNVIVEYPGTVPGKILSFVGCHMDVVTANPNDWEFDPFSLSIDGDKLRGRGTTDCLGHVALVAELMRRLAETKPKLKSTVVAVFIANEENSAISGVGVDALVKDGLLSKLREGPLFWIDTADKQPCVGTGGMIPWKLHVTGKLFHSGLAHKAINPLELAMEALKEIQSRFYRDFPPHPKEEVYGFATPSTMKPTQWSYPGGGINQIPAECTISGDVRLTPFYNVKDVMEKLQEYVDDINENIGKLDSRGPVSKYVLPDENLRGSLTLSFDETSSGVACDLNSRGFHVLCKATEEVVGHVKPYSITGSLPLIRELQDEGFDVQTSGYGLMATYHAKNEYCLFSDMRQGYQVFVSIISQLED

SEQ ID NO: 11826 - protein, 439 aa, Medicago truncatula
MTTPTKNLLETLGNLEKDSFIPLLTNLIGESRHVQNNPPELIPEEDRVVKHVLNSLLPLSTTTGGGPLIINHVTYFPGRGNLIVEYPGTVPGKILSFVGCHMDVVTANPNDWDFDPFTLSIDGDKLKGRGTTDCLGHVALVTELMKKLGETKPNLKSTVVAVFIANEENSAITGVGVDALVQDGLLNKLKEGPLFWIDTADKQPCVGTGGMIPWKLHVTGKMFHSGLAHKAINPLELAMDAIKEIQLKFYNDFPPHPQEQVYGFATPSTMKPTQWSYPGGGINQIPGECTISGDVRLTPFYNVKDVMKKLQEYVDEINENIHKLESRGPVSKYALSDENLRGSLTLTFDEANSGVACNLDSRGFHVLCKATEEIVGHVKPFSITGSLPLIRELKDEGFDVQCCGYGLMATYHAQNEYCLFTDMCQGYRVFASIIAQLED

SEQ ID NO: 11827 - protein, 438 aa, Trigonella foenum-graecum
MATTKNLLETLGNLEKDSFIPLLSNLIDQSRHVQNNPPELIPEEDRVVDHVLNSLLPVSTTTGGGPLIINHVTYFPGRGNLIVEYPGTVPGKILSFVGCHMDVVTANPNDWDFDPFSLSIDGDKLRGRGTTDCLGHVALVTELMKKLGETKPNLKSTVVAVFIANEESSAITGVGIDALVQDGLLNKLKEGPLFWIDTADKQPCVGTGGMIPWKLHVTGKMFHSGLAHKAINPLELAMDAIKEIQLKFYQDFPPHPQEQVYGFATPSTMKPTQWSYPGGGINQIPGECTISGDVRLTPFYNVKDVMKKLQDYVDDINENIHKLEGRGPVSKYALSDENLRGSLTLTFDEANSGVACDLNSRGFHVLCKATEEIVGHVKPFSITGSLPLIRELKDEGFDVQCCGYGLMATYHAQNEYCLFTDMCQGYRVFASIIAQLED

SEQ ID NO: 11828 - protein, 439 aa, Quercus alba
MASSSAHVKETLGELNKESFVSLLSKLIGEAKYVQNNPPDLIPEEDRVAKHVLDSLLPYSTTTGGGPLIVNHVTYHQGRGNIIVEYPGTVPGNVLSFVGCHMDVVTANPNDWEFDPFSLSIDGDKLRGRGTTDCLGHVALVTELMKRLGETKPKLKSTVVAVFIANEENSAISGVGVDALVKDGLLNKLKDGPLFWIDTADKQPCVGTGGMIPWKLKVTGKLFHSGLAHKAINPLELAMEALKEIQSRFYRDFPPHPKEQVYGFATPSTMKPTQWSYPGGGINQIPAECTISGDVRLTPFYNVKDVMSKLQEYVDDINENVDKLDSRGPVSKYVLPDENLRGSLTLSFDETMSGVACDLNSRGFHVLCKATEEVVGHVKPYSITGSLPLIRELQDEGFDVQTSGYGLMATYHAKNEYCLLSDMCQGYQVFVSIISQLED

SEQ ID NO: 11829 - protein, 438 aa, Prunus persica
MASSTDLKKILGDLNKESFISLLSKLIGESKYLQNNPPELIPQEDRAVKHVLDSLLPLSTTTGGGPLVINHVTYFPGRGNVIVEYPGTVPGKTLSFVGCHMDVVTANPNDWEFDPFSLSIDGDKLRGRGTTDCLGHVALVAELMRRLAETKPKLKSTVVAVFIANEENSAISGVGVDALVKDGLLSKLREGPLFWIDTADKQPCVGTGGMIPWKLHVTGKLFHSGLAHKAINPLELAMEALKEIQLRFYRDFPPHPKEEVYGFATPSTMKPTQWSYPGGGINQIPAECTISGDVRLTPFYNVKDVMEKLQEYVDDINENIGKLDSRGPVSKYVLPDENLRGSLTLSFDETSSGVACDLNSRGFHVLCKATEEVVGHVKPYSITGSLPLIRELQDEGFDVQTSGYGLMATYHAKNEYCLFSDMHQGYQVFVSIISQLED

SEQ ID NO: 11830 - protein, 178 aa, Fagus grandifolia
MASSHVKQTLGELDKDSFVTLLSKLIGEAKYVQNNPPELIPEEDRVVKHVLEALLPYSTTTGGGPLVINHVTYYQGRGNIIVEYPGTVPGNILSFVGCHMDVVTANPNDWEFDPFSLSIDGDKLRGRGTTDCLGHVALVTELMKKLGETKPKLKSTVVAVFIANEENSAISGVVWMHS

SEQ ID NO: 11831 - protein, 439 aa, Castanea mollissima
MASSSAHVKETLGELNKESFVSLLSKLIGEAKYVQNNPPDLIPEEDRVVKHVLDSLLPYSTTTGGGPLIINHVTYYQGRGNIIVEYPGTLPGNVLSFVGCHMDVVTANPNDWEFDPFSLSIDGDKLRGRGTTDCLGHVALVTELMKRLGETKPKLKSTVVAVFIANEENSAISGVGVDALVKDGLLNKLKDGPLFWIDTADKQPCVGTGGMIPWKLKITGKLFHSGLAHKAINPLELAMDALKEIQSRFYRDFPPHPKEKVYGFATPSTMKPTQWSYPGGGINQIPAECTVSGDVRLTPFYNVKDVMSKLQEYVDDINENVDKLDSRGPVSKYVLPDENLRGSLTLSFDEAMSGVACDLNSRGFHVLCKATEEVVGHVKPYSITGSLPLIRELQDEGFDVQTSGYGLMATYHAKNEYCLLSDMCQGYQVFVSIISQLED

SEQ ID NO: 11832 - protein, 436 aa, Gossypium raimondii
MATSNLKQTLGDLNKESFISLLTKIIGESKFLQNNPPELIPEEDRVIKHVLDCLLPYSTTTGGPLIVNHVTYFPGRGNLIVEYPGTQPGKILSFVGMHMDVVTANPNDWDFDPFSLSIDGDKLRGRGTTDCLGHVALVTELMKRLAETKPKLESTVVAVFIANEENSAITGVGVDALVKDGLLDKLKGGPLFWIDTADKQPCIGTGGMIPWKLQVTGKLFHSGLPHKAINALELGMEALKEIQLRFYKDFPPHPDEQVYGFATPSTMKPTQWNYPGGGINQIPGECTISGDVRLTPFYNVKDVMSKLQEYVDYINENLNKLDTRGPVSKYILHDENLRGSLTLTFDEAMSGVACDLNSRGFHVLCKATEEAVGHVKPYSITGSLPLIRELQDEGFDVQTAGYGLMATYHAKNEYCLLSDMCQGYHVFTGIIAQLED

SEQ ID NO: 11833 - protein, 436 aa, Gossypium hirsutum
MATSNLKQTLGDLNKESFISLLTKIIGESKFLQNNPPELIPEEDRVIKHVLDCLLPYSTTTGGPLIVNHVTYFPGRGNLIVEYPGTQPGKILSFVGMHMDVVTANPNDWDFDPFSLSIDGDKLRGRGTTDCLGHVALVTELMKRLAETKPKLESTVVAVFIANEENSAITGVGVDALVKDGLLDKLKGGPLFWIDTADKQPCIGTGGMIPWKLQVTGKLFHSGLPHKAINALELGMEALKEIQLRFYKDFPPHPDEQVYGFATPSTMKPTQWNYPGGGINQIPGECTISGDVRLTPFYNVKDVMSKLQEYVDYINENLNKLDTRGPVSKYILHDENLRGSLTLTFDEATSGVACDLNSRGFHVLCKATEEAVGHVKPYSITGSLPLIRELQDEGFDVQTAGYGLMATYHAKNEYCLLSDMCQGYHVFTGIIAQLED

SEQ ID NO: 11834 - protein, 436 aa, Gossypium raimondii
MATSNLKQTLGDLNKESFISLLTKIIGESKFLQNNPPELIPEEDRVIKHVLDCLLPYSTTTGGPLIVNHVTYFPGRGNLIVEYPGTQPGKILSFVGMHMDVVTANPNDWDFDPFSLSIDGDKLRGRGTTDCLGHVALVTELMKRLAETKPKLESTVVAVFIANEENSAITGVGVDALVKDGLLDKLKGGPLFWIDTADKQPCIGTGGMIPWKLQVTGKLFHSGLPHKAINALELGMEALKEIQLRFYKDFPPHPDEQVYGFATPSTMKPTQWNYPGGGINQIPGECTISGDVRLTPFYNVKDVMNKLQEYVDYINENLNKLDTRGPVSKYILHDENLRGSLTLTFDEAMSGVACDLNSRGFHVLCKATEEAVGHVKPYSITGSLPLIRELQDEGFDVQTAGYGLMATYHAKNEYCLLSDMCQGYHVFTGIIAQLED

SEQ ID NO: 11835 - protein, 438 aa, Malus domestica
MASSTDVKKIVGDLDKESFVSLLSKLIGESKYLQNNPPELIPQEDLAVKHVLDSLLPHSTTTGGGLLVIKHVTYFPGRGNVIVEYPGTVPGKILSFVGCHMDVVTANPNDWEFDPFSLSIDGDKLRGRGTTDCLGHVALVTELMRRLAETKPKLKSTVVAVFIANEENSAISGVGVDALVKDGLLSRLKDGPLFWIDTADKQPCIGTGGMIPWKLHVTGKLFHSGLAHKAINPLELAMEALKEIQLRFYRDFPPHPKEEVCGFATPSTMKPTQWSYPGGGINQIPAECTISGDVRLTPFYNVKDVMKKLQEYVDDINENIGNVESRGPVSKYILPDENLRGSLTLSFDEAMSGVACDLNSRGFHVLCKATEEVVGHVKPYSITGSLPLIRELQDEGFDVQTAGYGLMATYHAKNEYCLFSDMRQGYQVFVSVISQLED

SEQ ID NO: 11836 - protein, 436 aa, Gossypium hirsutum
MATSNLKQTLGDLNKESFISLLTKIIGESKFLQNNPPELIPEEDRVIKHVLDCLLPYSTTTGGPLIVNHVTYFPGRGNLIVEYPGTQPGKILSFVGMHMDVVTANPNDWDFDPFSLSIDGDKLRGRGTTDCLGHVALVTELMKRLAETKPKLESTVVAVFIANEENSAISGVGVDALVKDGLLDKLKGGPLFWIDTADKQPCIGTGGMIPWKLQVTGKLFHSGLPHKAINALELGMEALKEIQLRFYKDFPPHPDEQVYGFATPSTMKPTQWNYPGGGINQIPGECTISGDVRLTPFYNVKDVMNKLQEYVDYINENLNKLDTRGPVSKYILHDENLRGSLTLTFDEAMSGVACDLNSRGFHVLCKATEEAVGHVKPYSITGSLPLIRELQDEGFDVQTAGYGLMATYHAKNEYCLLSDMCQGYHVFTGIIAQLED

SEQ ID NO: 11837 - protein, 439 aa, Malus domestica
MASSSTDVKKIVGDLDKESFISLLSKLIGESKYLQNNPPDLIPQEDRVVKHVLDSLLPLSTTTGGGPLVINHVTYFPGRGNVIVEYPGTVPGKILSFVGCHMDVVTANPKDWEFDPFSLSIEGDKLRGRGTTDCLGHVALLTELMRRLAETKPKLKSTMVAVFIANEENSSISGVGVDALVKDGLLSKLKDGPLFWIDTADKQPCIGTGGMIPWKLHVTGKLFHSGLPHKAINPLELAMEALKEIQLRFYRDFPPHPKEEAYGFATPSTMKPTQWTYPGGGINQIPAECTISGDVRLTPFYNVKDVMEKLQEYVDDINENIEKLESRGPVSKYVLPDENLRGSLTLSFNEATSGVACDLNSRGFHVLCKATEEVVGHVKPYSITGSLPLIRELQDEGFDVQTAGYGLMATYHAKNEYCLFTDMSQGYQVFISVIAQLED

SEQ ID NO: 11838 - protein, 437 aa, Theobroma cacao
MATSNVKQTLGNLNKDSFVSLLTKVIGESKFLQNNPPELIPEEDRVVKHVLDCLVPYSTTTGGGPLVVNHVTCFPGRGNLIVEYPGTEPGKILSFVGMHMDVVTANPNDWDFDPFSLSIDGDKLRGRGTTDCLGHVALVTELMRKLGERKPKLKSTVVAVFIANEENSAITGVGVDALVKDGLLDKLKGGPLFWIDTADKQPCIGTGGMIPWKLHVTGKLFHSGLAHKAINPLELGMEALKEIQLRFYKDFPPHPNEQVYGFATPSTMKPTQWSYPGGGINQIPGECTLSGDVRLTPFYNVKDVMEKLQEYVDDINENIDELDTQGPVSKYILHDENLRGSLTLTFDEAMSGVACDLDSRGFHVLCKATEEAVGYVKPYSITGTLPLIRELQDEGFDVQTAGYGLMATYHAKNEYCLLSDMCQGYDVFTSIISQLEN

SEQ ID NO: 11839 - protein, 438 aa, Eucalyptus grandis
MGSSSDVKATLGDLERESFTALLSKLIGEARYVQNNPPDLIPQEDRIVRHVLDSLLPLSTSTGGGPLVVNHVNYHPNRGNLIVEYPGTVPGKILSFVGMHMDVVTADPSAWEFDPFSLSIDGDKLCGRGTTDCLGHVALVTELMKRLGETKPNLKSTVVAVFIASEENSSIPGVGVDALVKDGLLNKLKDGPLFWIDTADKQPCIGTGGMIPWKLKATGKLFHSGLAHKAINPLELAMEALKEIQTRFYNDFPPHAKEQVYGFATPSTMKPTQWSYPGGGINQIPAECTISGDVRLTPFYNVTDVVKKLQEYVDDINANIEKLDSRGPVSKYVLPDENLRGRLSISFDEASSGVACDLNSRGYHVLCKATEEVVGHVKPYSITGTLPLIRELQDEGFDVQTSGYGLMATYHAKNEYCLFSDMSQGYRVFASVISQLED

SEQ ID NO: 11840 - protein, 433 aa, Vitis vinifera
MVKDTVGDLNTDSFVKLLSKLIGESEYVQNNPPDLIPQEDRIVRHVLDALLPYSTQTGGGPLIVNHVTYFPGRGNVIVEYPGTVPGKILSFVGMHMDVVTANPNDWDFDPFTLSIDGDKLRGRGTTDCLGHVALITELMRRLGETKPKLKSTVVAVFIANEENSAISGVGVDALVKDGLLNKLKEGPLYWIDTADKQPCIGTGGMIPWKLRVTGKLFHSGLPHKAINPLELAMDAVKEIQLRFYRDFPPHPKEQIYGFATPSTMKPTQWHYPGGGINQIPAECTISGDVRLTPFYNVIDVMKKLQEYVDDINNHIERLESRGPVSKYVLPDEDLRGSLTISFDEAMSGVACDLKSHGFHVLSKATEEVVGYVKPYSITGSLPLIRELQDEGFDVQTSGYGLMATYHAKNEYCLLSDMCQGYQVFVSIISQLED

SEQ ID NO: 11841 - protein, 435 aa, Populus trichocarpa
MTDIEQILGDLNKDSFVSLLKNIIGESKYVQNNPPELIPEEDRVVTHVLNSLLPYSTTTRGGPLIVNHVSCFPKRGNLIVEYPGTEPGKILSFVGMHMDVVTANPNDWEFDPFSLSIDGEKLRGRGTTDCLGHVALVTELMKKLGETKLKLKSTVVAVFIANEENSSITGVGVDALVKDGLLNKLKGGPLFWIDTADKQPCIGTGGMIPWKLHFTGKLFHSGLPHKAINPLELGMEALKEIQSRFYEDFPPHKEEQVYGFATPSTMKPTQWSYPGGGINQIPAECTISGDVRLTPFYSVKDVMDKLQEYVDEINENIEKLDTRGPVSKYVLPEENLRGSLTVTFNEASSGVACDLKSRGFEVLCKATEKVVGHVKPYSITGTLPLIRELKDEGFDVQTTGYGLMATYHAKNEYCLLSDMCQGYQIFSSIISQLEA

SEQ ID NO: 11842 - protein, 435 aa, Populus trichocarpa
MADIEQVLGDLNKDSFVSLLTNLIGESKYVQNNPPELIPEEDRVVKHVLNSLLPYSTTTGGGPLIVNHVSYFPQRGNLIVEYPGTEQGKILSFVGMHMDVVTANPNDWEFDPFSLSIDGEKLRGRGTTDCLGHVALVTELMKKLGETKPKLKSTVVAVFIANEENSAITGVGVDALVKDGLLNKLKGGPLYWIDTADKQPCIGTGGMIPWKLHVTGKLFHSGLPHKAINPLELGMEALKEIQSRFYRDFPPHKEEQVYGFATPSTMKPTQWSYPGGGINQIPAECTISGDVRLTPFYSVEDVMSKLQKHVDDINENIEKLGTRGPVSKYVLPEENLRGSLAVTFDEASSGVACNLKSRGFEVLCKATEKIVGHVKPYSITGTLPLIRELKDEGFDVQTAGYGLMATYHAKNEYCLLSDMCQGYQIFTSIISQLEN

SEQ ID NO: 11843 - protein, 435 aa, Manihot esculenta
MANVEEILGELDKESFVTLLRKIIGESKHVQNNPPELIPEEDRVVKHVLDSLLPYSTTSGGGPLIVNHVSYFPGRGNLIVEYPGTEPGKILSFVGMHMDVVTANPNDWEFDPFSLTINGDKLCGRGTTDCLGHVAVVTELMKMLAEKKPKLKSTVVAVFIANEENSAITGVGVDALVQDGLLDKLKGGPLFWIDTADKQPCIGTGGMIPWKLHVTGKLFHSGLAHKAINSLELAMEALKEIQSRFYKDFPPHPKEQNYGFATASTMKPTQWNYPGGGINQIPAECTISGDVRLTPFYNVTDVKKKLQEYVDDINENIEKLDTRGPVSKYVLPDENLRGSLTLTFDEAMSGVACDLDSRGFHVLCKATEKIVGHVKPYSITGSLPLIRELQDEGFDVQTTGYGLMATYHAKNEYCLLSDMCQGYKVFVSIISQLED

SEQ ID NO: 11844 - protein, 437 aa, Heritiera littoralis
MATSNVEQALGNLNKESFVSLLTKIIGESKFLQNNPPELIPEEDRVVKHVLDCLLPYSTTTGAGPLVVNHVTYFPGRGNLIVEYPGTEPGKIVSFVGMHMDVVTANPNDWDFDPFSLSIDGDKLRARGTTDCLGHVVLVTELMRKLAETKPKLKSTVVAVFIANEENSAITGVGIDALVKDGLLDKLKGGPLFWIDTADKQPCIGTGGMIPWKLHVTGKLFHSGLAHKAINALELGMEALKEIQLQFYKDFPPHPKEQVYGFATPSTMKPTQWSYPGGGINQIPGECTIAGDVRLTPFYNVKDVMEKLQEYVDDINENIDKLDTRGPVSKYILHDENLRGSLTLTFDEAMSGVACDLDSRGFHVLCKATVEAVGHVKPYSITGSLPLIRELQDEGFDVQTAGYGLMATYHARNEYCLLSDLCQGYHVFTSIISLLED

SEQ ID NO: 11845 - protein, 107 aa, Euonymus alatus
MATSQIKQTLGDMDKESFVSLLRSLIGESRYVQNNPPELIPEEDRVVKHVMNSLLPYSTTSGGGPLILNHVAYFPNEGQSHCGIPWHCSWESSLLCWDAHGCCHCKS

SEQ ID NO: 11846 - protein, 435 aa, Ricinus communis
MANVEEILGELDKESFVTLLRKIIGESKHVQNNPPELIPEEDRVVKHVLDSLLPYSTTSGGGPLIVNHVSYFPGRGNLIVEYPGTEPGKILSFVGMHMDVVTANPNDWEFDPFSLTINGDKLCGRGTTDCLGHVAVVTELMKMLAEKKPKLKSTVVAVFIANEENSAITGVGVDALVQDGLLDKLKGGPLFWIDTADKQPCIGTGGMIPWKLHVTGKLFHSGLAHKAINALELAMDALQEMQSRFYKDFPPHPREQVYGFATASTMKPTQWSYPGGGINQIPGECTISGDVRLTPFYNLVDVKNMLQEYVDDINENIEKLGTRGPVSKYVLPDENLRGSITLTFEEAMSGVACNLDSRGFHVLCKATEKVVGHVKPYSITGSLPLIRELQEEGFDVQTAGYGLMATYHAKNEYCLLSDMCQGYRVFVSIISQLED

SEQ ID NO: 11847 - protein, 434 aa, Fragaria vesca
MDVKKTLGDLDKESFITLLSKLIGEAKFVQNNPPDLIPQEDRVVKHVLDSLLPLSTTTGGGPLLINHVTYYPGRGNVIIEYPGTVPGKVLSFVGCHMDVVTANPEDWEFDPFSLSIDGDKLCGRGTTDCLGHVALVTELMKRLAETKLKLKSTVVVVLIANEENSAISGVGVDALVKDGLLNKLKDGPLFWIDTADKQPCIGTGGSIPWKLHVTGKLFHSGLVHKAINPLELAMEALKEIQSRFYRDFPPHEKEKVYEYATPSTMKPTQWSYPGGGINQIPGECTISGDVRLTPFYDVKDVMKKLQEYVDDINENITKLDTRGPVSKYALPDENLRGRLTISFDEASSGVACDLESCGFHVLCKATEEVVGHVKPYSITGTLPLIRELQDEGFDVQTSGYGLMSTYHAKNEYCLFSDMAQGYRVFASVISQLED

SEQ ID NO: 11848 - protein, 438 aa, Carica papaya
MPSCNALRETLGFLNKESFLCLLTKLIGESKYVQNNPPELIPEEDRVVKHVLDSLLPYSTTTGGGPLVVNHVSYFPCRGNLIVEYPGTVPDKILSFVGMHMDVVTANPNDWEFDPFSLSIDGDKLRGRGTTDCLGHVALVTELMRTLGEKKPQLKSSVVAVFIANEENSAITGVGVDALVKDGLLDKLKEGPLFWIDTADKQPCIGTGGMIPWKLHVTGKLFHSGLAHKAINSLELAMEALKEIQSRFYKDFPPHPKEEVYGFATPSTMKPTQWSYPGGGINQIPAECTISGDVRLTPFYNVKDVMQKLQEYVDDINENIHQLDTRGPVSRYTLPDENLRGSLTIIFEEAMSGVACNLDSRGFHVLCKATEEAVGHVKPYSITGSLPLIRELQEEGFDVQTAGYGLMATYHAKNEYCLLSDMCQGYDVFVKIISDLEE

SEQ ID NO: 11849 - protein, 237 aa, Vaccinium corymbosum
IFSTASPSVKEALGDLNKESFVTLLSKLIGESKYVQNNPPELIPEEDRIVRHVLDVLLPLSTTTGGGPLICNHVAYHPNRGNLIVEYPGTEPDKILSFVGMHMDVVTANPSDWDFDPFSLGIDGDKLSGRGTTDCLGHVALVTELMRRLGETKPKLKSTVVAVFIASEENSSITGVGVDALVKDGLLNKLKDGPLFWIDTADKQPCIGTGGMIPWKLHVMGKLFHSGLPHKAINPWN

SEQ ID NO: 11850 - protein, 438 aa, Tropaeolum majus
MASSDVVRKMLGSLDKESFVSLMTKVIGESKYVQNNPPDLIPEEDRVVKHVMDSLLPYSTTTGGGPLVINHVSYFPGRGNLIVEYPGTVPGKILSFVGMHMDVVTANPNDWEFDPFALSIDGDKLRGRGTTDCLGHVALVTELMKKLGETKPKLKSTVVAVFIASEENSSIMGVGVDGLVNDGLLDKLKGGPLYWIDTANKQPCIGTGGMVPWKLHVTGKLFHSGLAHKAINPLELAMDAVKDIQTRFYQDFPPHPKEQIYGYETPSTMKPTQWSYPGGGINQIPAECTISGDVRLTPFYDVKDVMKKLQEYVDEINENIQKFDSRGPVSKYSLPDEGLRGSLTITFDEANSGVACDLDSRGFHVLCKATEEVVGHVKPYSITGSLPLIRELQDQGFDVQTSGYGLMETYHAKNEYCLLSDMCQGYDVFASIITQLED

SEQ ID NO: 11851 - protein, 369 aa, Lippia dulcis
MELSLLSLSPKPPTTAPFWSRPGGLNNHFVTPMDVMKKRRTREYCVVRAEGNGGEAVESRERESGGGYRASAMEVTTFNQSFNDAADFPVWEKIGAIVRLGYGIGIYGAMALAGRFICSISGIDCNGGFDLTLDAIVEGLGYAAPPIMALLFILDDEVVKLSPYARAIRDVEDEELRSFFYGMSPWQFMLIVAASSVGEELFYRAAVQGALAEIFLKSSDLVADARGMASLTGVLPPFVPFAQAFAAVITAALTGSLYYMAASPKDPTYVVAPVLKSRSGREDLKKLFSAWYERRQMKKIYSPLLEATLALYLGFEWIQTNNILAPIITHGIYSCVILGHGLWKIHDHQRRLRRRVRKLKTEGKVSRKL

SEQ ID NO: 11852 - protein, 436 aa, Amsonia hubrichtii
MASSVKQTLGDLDKESFVTLLSKLIGEAEYVQNNPPELIPEEDRIVKHVLEKLLPFSTTTGGGPLIINHVTYKPNRGNLIVEYPGTVPNKILSFVGMHMDVVTASRSDWEFDPFSLSIDGDKLRGRGTTDCLGHVALVAELMRKLGETKPQLKSTVVAVFIASEENSSIPGVGVDALVKHGLLNKLKNGPLFWIDTADKQPCIGTGGMIPWKLHVTGKLFHSGLAHKAINPLELAMEALKVIQSRFYKDFPPHPKEQVYGFATPSTMKPTQWSYPGGGINQIPAECSISGDVRLTPFYNVSDVMKKLQEYVEDLNQNIEKLDTRGPVSKYVLHEENLRGRIAISFDEPNSGVACDLESHGFKVLCKATEEVVGHVKPYSITGSLPLIRELQDEGFDVQTAGYGLMATYHAKNEYCLLSDMCQGYGVFASIISQLED

SEQ ID NO: 11853 - protein, 437 aa, Tripterygium wilfordii
MATSQIKQTLGDMDKESFVSLLRNLIGESRYVQNNPPELIPEEDRVVKHVMNSLLPYSTTTGGGPLILNHVAYFPNRGNLIVEYPGTVPGKVFSFVGMHMDVVTANPNDWEFDPFSLSIDGDKLRGRGTTDCLGHVALVTELLKRLGETKPKLKSSVVAVFIASEENSSIPGVGVDALVRQGLLDKLKGGPLFWIDTADKQPCIGTGGMIPWKLHVTGKLFHSGLAHKAINPLELGMDVLKEIQSRFYRDFPPHPKEQVYGFATPSTMKPTQWSYPGGGINQIPGECTISGDVRLTPFYSVTDVIKILKEYVDDINENIEKLETRGPVSKYILPDENLRGSLTITFDEANSGVACDLDSRGFHVLCKATKEVVGHVKPYSITGSLPLIRELQDEGFDVQTAGYGLMATYHAKNEYCLLSDMCQGYQIFVSIIDQLED

SEQ ID NO: 11854 - protein, 435 aa, Utricularia gibba
AVGVKGTLGELDRDSFVALLGKLIGESKYVQNNPPELIPEEDRIVGHVLQVLRPYSTATGGGPLVINHVAYKPNRGNLIVEYPGTEPGKILSFVGMHMDVVTANPDDWDFDPFTLSIDGDKLRGRGTTDCLGHVALVAELMKKLGETKPKLKSTVVAVFIASEENSSIPGVGVDALVKQGLLDKLKHGPLYWIDTADKQPCIGTGGMIPWKLHVTGKLFHSGLAHKAINPLELAMEALKEIQLRFYKDFPPHPKEKVYGFATPSTMKPTQWSYPGGGINQIPAECTICGDVRLTPFYGVADVMKKLQEYVEDLNTNIENLETRGLVSKYVLPEENLRGRIFISFDEAMSGVACDLESPGFQVLCKATEEVVGHVKPYSITGSLPLIRELKDEGFDVQTSGYGLMATYHAKKRYCLFSDMCQGYAVFVNIISQLED

SEQ ID NO: 11855 - protein, 437 aa, Panax ginseng
MAASSLKETLGDLNKDSFVTLLSKLIGESKFVQNNPPELIPEEDRIVKHVLDAVIPFSTTTGGGPLIVNHVTYIPKRGNLIVEYPGTEPGKILSFVGMHMDVVTANPDDWTFDPFALSIEGDKLRGRGTTDCLGHVALVAELMRRLGETKPKLKSTVVAVFIASEENSSIPGVGVDALVKDGLLNKLKQGPLFWIDTADKQPCIGTGGMIPWKLHVTGKLFHSGLPHKAINPLELAMEVLKVIQLRFYKDFPPHAKEEVYGFATPSTMKPTQWSYPGGGINQIPAECTISGDVRLTPFYNISDVMKKLQEYVDELNINIEKIDSRGPVSKYVLPDENLRGSIKISFDEAFPGVACDLDSRGFHVLCKATEHVVGHVKPYSITGSLPLIRDLQDEGFDVQTSGYGLMATYHAKNEYCLLSDMCQGYQVFVSVIGQLED

SEQ ID NO: 11856 - protein, 437 aa, Beta vulgaris
MASSEIKQIIGELNKESFVDLLTKLIGESKYLQNNPPELIPEEDRVVNHLLEILSPLSTTTGGGPLIINHATYYPKRGNLIVEYPGTQPGKVLSFVGCHMDVVTANPTDWDFDPFSLSIDGDKLRGRGTTDCLGHVALIAELMKKLGETKPKLKSTVVAVFIANEENSAITGIGVDALGKDGLLDKLKDGPLFWIDTADKQPCIGTGGVIPWKLQGHGKLFHSGLAHKGINAMEMTMEALKEIQLRFYKDFPPHPQEEVYGFATPSTMKPTQWTYPGGGINQIPGECTISGDVRLTPFYDVTDCMKKLQEYVDDMNSNIEKLDTRGPVSKYVLPDENISGRLVITFDEANNGVACDLNSRGFHVLCKATEEVVGHVKPYSITGSLPLIRDLQDDGFDVQTAGYGLMATYHARNEYCLLSDMCQGYQIFASIIAQLED

SEQ ID NO: 11857 - protein, 434 aa, Fagopyrum esculentum
MDSNGTRLLGELDKDSFVSLLRKLIGESNTSDNPPELIPEEDRVVKHVLDYLLPFSTSNGGPLIVNHVTYHANRGNLIVEYPGTEPDRVLSFVGCHMDVVTANPDDWEFDPFSLSIDGDKLCGRGTTDCLGHVALIAQLMKKLGETKPKLKSSVVAVFIANEENSDITGVGVDALVKDGLLNKLKNGPLFWIDTADKQPCIGTGGMIPWKLHVTGKLFHSGLAHKAVNSLELAMEALKVIQLRFYTDFPPHPQEKVYEFATPSTMKPTQWSYPGGGINQIPGECVISGDVRLTPFYSVTDVMNKLKQYVDDINANIEKLDTRGPVSKYVLPEENIRGRLSISFEEALSGVACDLNSRGFHVLCKATEEVVGHVKPYSITGSLPLIRELKDEGFDVQTSGYGLMATYHAKNEYCLLSDMCQGYSVFVSIISQLEE

SEQ ID NO: 11858 - protein, 229 aa, Panax ginseng
MIPWKLHVTGKLFHSGLPHKAINPLELAMEVLKVIQLRFYKDFPPHAKEEVYGFATPSTMKPTQWSYPGGGINQIPAECTISGDVRLTPFYDISDVMKKLQEYVDELNINIEKIDSRGPVSKYVLPDENLRGSIKISFDESFPGVACDLDSRGFHVLCKATEHVVGHVKPYSITGSLPLIRDLQDEGFDVQTSGYGLMATYHAKNEYCLLSDMCQGYQVFVSVIGQIED

SEQ ID NO: 11859 - protein, 438 aa, Solanum tuberosum
MATSASVKQILGDLNKDSFVTLLGKLIGESKYVQNNPPELIPEEDRIVNHVLDTLLPYSTTTGGGPLIINHVTYKPNRGNLIVEYPGTQPGKILSFVGMHMDVVTANPDDWEFDPFSLSIDGDKLRGRGTTDCLGHVALVSELMRRLGETKPQLKSTVVAVFIASEENSSIPGVGVDALVKDGLLDKLKQGPLFWIDTADKQPCIGTGGSIPWKLHVTGKLFHSGLPHKAINPLELAMEALKEIQSRFYIDFPAHPKEQVYEFATPSTMKPTQWFYPGGGINQIPGECTVSGDVRLTPFYNVSDAMKKLQEYVDDLNANIEKLDGRGPVSKYVLPDENLRGRITISFDEASSGVACDLNSRGFHVLCKATKEEVGHVKPYSITGTLPLIRDLQDEGFDVQTSGYGLMATYHAKNEYCLLSDMCQGYRVFASIIAQLED

SEQ ID NO: 11860 - protein, 438 aa, Solanum lycopersicum
MATTASVKQILGDLNKDSFVTLLGKLIGESKYVQNNPPELIPEEDRIVNHVLDTLLPYSTTTGGGPLIINHVTYKPNRGNLIVEYPGTQPGKILSFVGMHMDVVTANPDDWEFDPFSLSIDGDKLRGRGTTDCLGHVALVSELMRRLGETKPQLKSTVVAVFIASEENSSIPGVGVDALVKDGLLDKLKKGPLFWIDTADKQPCIGTGGSIPWKLHVTGKLFHSGLPHKAINPLELAMEALKEIQSRFYRDFPAHPKEQVYEFATPSTMKPTQWFYPGGGINQIPGECTVSGDVRLTPFYSVSDAMKKLQEYVDDLNANIEKLDGRGPVSKYVLPDENLRGRITITFDEASSGVACDLNSRGFHVLCKATKEEVGHVKPYSITGTLPLIRDLQDEGFDVQTSGYGLMATYHAKNEYCLLSDMCQGYRVFASVIAQLED

SEQ ID NO: 11861 - protein, 438 aa, Ocimum basilicum
MAAAVVKQTLGDLNKDSFVPLLSKLIGESKFVQNNPPELIPEEDRIVSHVLDVLRPYSTATGGGPLLINHATYKPRRGNLIVEYPGTQPGKILSFVGMHMDVVTANPSDWEFDPFSLSIDGDKLRGRGTTDCLGHVALVTELMRRLGETKPQLKHTVVAVFIASEENSSIPGVGVDALVKEGLLNKLKEGPLFWIDTADKQPCIGTGGMIPWKLHATGKLFHSGLAHKAINPIELAMEALKVIQKRFYEDFPPHPKEQVYGFATPSTMKPTQWFYPGGGINQIPAECTVSGDVRLTPFYSVTDVIKKLQEYVEDLNTNIEKLDTRGPVSKYVLPDENLRGRLAISFDEAMSGVACNLESRGFHVLCKATEEVVGHVKPYSITGSLPLIRELQEEGFDVQTAGYGLMATYHAKNEYCLFSDMCQGYRVFASIISQLEEE

SEQ ID NO: 11862 - protein, 432 aa, Euphorbia peplus
SLGDLNKESYVSLLKKIIGESKYVQNNPPELIPEEDRVVKHVLDSLLPLSTSSGGGPLIVNHVSYFPKRGNLIVEYPGTQPGKIVSFVGMHMDVVTANPNDWEFDPFSLSIEGDKLRGRGTTDCLGHVALVTELMKRLAETKPKLKSTVVAVFIASEENSTITGVGVDALVRDKLLDKLKGGPLFWIDTADKQPCIGTGGMIPWKLHVTGKLFHSGLAHKAINPLELAMESLKEIQSRFYKDFPPHAKEQVYGFATPSTMKPTQWSYPGGGINQIPAECTISGDVRLTPFYNVLDVKNKLQEYVDDINENIEKLDRRGPVSKYCLPDENMKGSLTLTFEEAMNGVACDLDSRGFHVLCKATEKVVGHVKPYSITGSLPLIRELQDEGFDVQTAGYGLMATYHAKNEYCLLTDMCQGYRVFVSIIAQLESLSE

SEQ ID NO: 11863 - protein, 438 aa, Solanum lycopersicum
MTTTASVKQILGDLNKDSFVTLLGKLIGESKYVQNNPPELIPEEDRIVNHVLDTLLPYSTTTGGGPLIINHVTYKPNRGNLIVEYPGTQPGKILSFVGMHMDVVTANPDDWEFDPFSLSIDGDKLRGRGTTDCLGHVALVSELMRRLGETKPQLKSTVVAVFIASEENSSIPGVGVDALVKDGLLDKLKKGPLFWIDTADKQPCIGTGGSIPWKLHVTGKLFHSGLPHKAINPLELAMEALKEIQSRFYRDFPAHPKEQVYEFATPSTMKPTQWFYPGGGINQIPGECTVSGDVRLTPFYSVSDAMKKLQEYVDDLNANIEKLDGRGPVSKYVLPDENLRGRITITFDEASSGVACDLNSRGFHVLCKATKEEVGHVKPYSITGTLPLIRDLQDEGFDVQTSGYGLMATYHAKNEYCLLSDMCQGFRVFASVIAQLED

SEQ ID NO: 11864 - protein, 438 aa, Chenopodium quinoa
MAPSSELDQTLGELNKESFVNLLTKLIGESKYLQNNPPELIPEEDRVVNHLLEILSPLSTTTGGGPLIINHATYYPKRGNLIVEYPGTEPGKVVSFVGCHMDVVTANPSDWDFDPFSLSIDGDKLRGRGTTDCLGHVALVAALMKKLGEAKPKLKSTVVAVFIANEENSAITGIGVDALGKDGLLDKLKGGPLFWIDTADKQPCIGTGGVIPWKLQGVGKLFHSGLAHKAVNAMEMTMEALKEIQLRFYKDFPPHPEEKRYGFATPSTMKPTQWVYPGGGINQIPGECTISGDVRLTPFYDVNDCMKKLQEYVDDINSNIEKLDTRGPVSKYVLPDENIRGRLTITFDEANNGVACDLDSRGFHVLCKATEEVVGHVKPYSITGSLPLIRDLKDDGFDVQTAGYGLMATYHAKNEYCLLSDMCQGYRVFASVIAQLED

SEQ ID NO: 11865 - protein, 436 aa, Triphysaria pusilla
MAASSVTETLGNLNKDSFVSLLSKLIGESKHVQNNPPELIPEEDRIVRHVLDVLSPFSSANGGPLLINHVAYKPNRGNLIVEYPGTQPGKILSFVGMHMDVVTANPSDWDFDPFTMSIDGDKLRGRGTTDCLGHVALVAELMRRLGETKPQLKSTVVAVFIASEENSSIPGVGVDALVKDGLLDKLKHGPLFWIDTADKQPCIGTGGMIPWKLNVTGKLFHSGLAHKAINPFELAMEALKVIQSRFYTDFPAHPKEEVYGFATPSTMKPTQWSYPGGGINQIPADCTVCGDVRLTPFYSVTDVIKKLQEYVEDLNANIEKLDTRGPVSKYTLPDENLRGSLTITFDEASSGVACNLDSRGFHVLCKATEEVVGHVKPYSITGTLPLIRELQDEGFDVQTSGYGLMATYHAKNEYCLLSDMCQGYGVFVRVISQLED

SEQ ID NO: 11866 - protein, 436 aa, Triphysaria pusilla
MAASSVTQTLGNLNKDSFVSLLSKLIGESKHVQNNPPELIPEEDRIVRHVLDVLSPFSSANGGPLLINHVAYKPNRGNLIVEYPGTQPGKILSFVGMHMDVVTANPSDWDFDPFTMSIDGDKLRGRGTTDCLGHVALVAELMRRLGETKPQLKSTVVAVFIASEENSSIPGVGVDALVKDGLLDKLKHGPLFWIDTADKQPCIGTGGMIPWKLNVTGKLFHSGLAHKAINPFELAMEALKVIQSRFYTDFPAHPKEEVYGFATPSTMKPTQWSYPGGGINQIPADCTVCGDVRLTPFYSVTDVIKKLQEYVEDLNANIEKLDTRGPVSKYTLPDENLRGSLTITFDEASSGVACNLDSRGFHVLCKATEEVVGHVKPYSITGTLPLIRELQDEGFDVQTSGYGLMATYHAKNEYCLLSDMCQGYGVFVRVISQLED

SEQ ID NO: 11867 - protein, 441 aa, Aquilegia formosa
MGSSSSLKEIIGDLNRDSFVPLLSKLIGESKFLQNNPPELIPEENRVAKHVLDVLLPYSTTSNGGPLIINHVTYIQGRGNLIVEYPGTVPGKIVSFVGMHMDVVTANPQDWDFDPFSLTVDGDKLQGRGTTDCLGHVALVTELMRRLGETKPALRSSVVAVFIANEENSSIAGIGVDMLVKDGLLDKLKKGPLFWIDTADKQPCIGTGGMVSWNLHATGKLFHSGLAHKAINPLELAMEALQEIQLRFYRDFPPHPKEEIYGFATPSTIKPTQWSYPGGGVNQIPGECTISGDVRLTPFYNIEDVTKKLQEYVDDINANIEKLGTRGPVSKYVLPDENLRGRLTISYGEAPMTGVACNLDSRGFHVLCKATKDVVGHVKPYSITGSLPLIRELQDEGFDVQTAGYGLMATYHAKNEYCLFSDMSQGFEVFVSVISQLEDDN

SEQ ID NO: 11868 - protein, 441 aa, Arabidopsis lyrata
MASYSKALVEFIGSLDKDSYVSLLSKLIGESKFVQNNPPELIPQEDLIVKHVLESLRPYSTETGGGPLVINHVAYHSGRGNLIVEYPGSVPGKILSFVGMHMDVVTANPDDWEFDPFSLSIDGDKLRGRGTTDCLGHVALVTELMKRLGQTKPSLKSTVVAVFIASEENSSIPGVGVDMLVKDKLLDKLKSGPLYWIDTADKQPCVGTGGMIPWKIHFTGKLFHSGLAHKAINAMELAMEGLKEIQARFYRDFPPHPQEKVYGFATPSTMKPTQWSYPAGGINQIPGECTVSGDVRLTPFYEVKEVITKLQEYVDDINGNIEKLETRGPVSKYVLPDENLRGRLTLSFDEASAGVACNLDSPGFHVLCKATEEVVGHVKPYSITGTLPLIRDLKDEGFDVQTSGYGLMATYHAKNEYCLLTDMCQGFDVFVRIISQLEEQD

SEQ ID NO: 11869 - protein, 322 aa, Chenopodium quinoa
MAPSSELDQTLGELNKESFVNLLTKLIGESKYLQNNPPELIPEEDRVVNHLLEILSPLSTTTGGGPLIINHATYYPKRGNLIVEYPGTEPGKVVSFVGCHMDVVTANPSDWDFDPFSLSIEGDKLRGRGTTDCLGHVALVAELMKKLGEAKPKLKSTVVAVFIANEENSAITGIGVDALGKDGLLDKLKGGPLFWIDTADKQPCIGTGGVIPWKLQGVGKLFHSGLAHKAVNAMEMTMEALKEIQLRFYKDFPPHPEEKRYGFATPSTMKPTQWVYPGGGINQIPGECTISGDVRLTPFYDVTDCMKKLQEYVDDINSNMRS

SEQ ID NO: 11870 - protein, 440 aa, Arabidopsis thaliana
MASSSKALIESIGSLDKDSYVSLLSKLIGESKFVQNNPPELIPQEDLIVKHVLDSLRPYSTETGGGPLVINHVAYHSGRGNLIVEYPGSVPGKILSFVGMHMDVVTANPDDWEFDPFSLSIDGDKLRGRGTTDCLGHVALVTELMKKLGQAKPALKSTVVAVFIASEENSSIPGVGVDMLVKDKLLDKLKSGPLYWIDTADKQPCVGTGGMIPWKLQFTGKLFHSGLAHKAINAMELAMEGLKEIQARFYRDFPPHPQEEVYGFATPSTMKPTQWCYPAGGINQIPGECTVSGDVRLTPFYDVKEVITKLQEYVDDINGNIERLETRGPVSKYVLPDENLRGRLTLSFDEASAGVACNLDSPGFHVLCKATEEVVGHVKPYSITGTLPLIRDLQDEGFDVQTSGYGLMATYHAKNEYCLLTDMCQGFDVFIRIISQLEQV

SEQ ID NO: 11871 - protein, 441 aa, Aristolochia fimbriata
MASSASLNSLLGELNRDSFVTLLGKIIGEAKHVQNNPPELVPREDRVARHVLDALLPLSTSTGGGPLIVNHVSYVEGRGNVIVEYPGTVPGKILSFVGCHMDVVTANPQDWDFDPFSLSIDGDKLRGRGTTDCLGHVALVTELMRKLGETKPVLKSTVVAVLIANEENSSVAGVGVDALVKDGLLDKLKKGPLFWIDTADKQPCIGTGGMIAWKLRASGKLFHSGLPHKAINPLELLMEAFQEIQLRFYRDFPPHPKEQVYGFATPSTMKPTQWSYPGGGVNQIPAECTISGDVRLTPFYNVADVEKKLREYVDDINGNIEKLPTRGPVSKYDLPDENLKGRLTLSFDESMMSGVACSLESPGFRVLCKATEEVVGHVKPYSITGSLPLIRELQDEGFDVQTAGYGLMSTYHAKNEYCLFSDMCQGFKVFVSIISQLEEHE

SEQ ID NO: 11872 - protein, 442 aa, Eutrema halophilum
MSSSSSSNAMIESIGSLNKDSFVSLLSKLIGESKFVQNNPPELIPQEDRIVNHVLDSLRPYSTETGGGRLVINHVAYHSGRGNLIVEYPGSVPGKILSFVGMHMDVVTANPDEWEFDPFSLSIDGDKLRGRGTTDCLGHVALVTELMKRLGETKPALKSSVVAVFIASEENSSIPGVGVDMLVKDKLLDKLKSGPLFWIDTADKQPCIGTGGMIPWKLHVTGKLFHSGLAHKAINALELGMEGLKEIQSRFYRDFPPHPQEKVYGFATPSTMKPTQWSYPGGGINQIPGECTVSGDVRLTPFYDVKEVMKKLQEYVEDINSNIEKLATRGPVSKYVLPDESLRGRLTLSFDEASAGVACNLDSRGFHVLCKATEDVVGHVKPYSITGTLPLIRDLKDEGFDVQTSGYGLMATYHAKNEYCLLTDMCQGFDVFVRIISQLEQD

SEQ ID NO: 11873 - protein, 439 aa, Brassica juncea
MASSSSMIESLGSLNKDSFVSLLSKLIGESKFVQNNPPELIPQEDRIVNHVLDSLRPYSTESGGGPLVINHVAYHSGRGNLIVEYPGSVPGKIVSFVGMHMDVVTANPDEWEFDPFSLSIDGDKLRGRGTTDCLGHVALVTELMKRLGETKPALKSSVVAVFIASEENSSIPGVGVDMLVKDKLLDKLKSGPLFWIDTADKQPCIGTGGMIPWKLHVTGKLFHSGLAHKAINAMELGMEGLKEIQSRFYRDFPPHEQEKVYGFATPSTMKPTQWSYPGGGINQIPGDCTVSGDVRLTPFYDVKEVMKKLQEYVDDINTNIEKLATRGPVSKYVLPEENLRGRLTFSFDEASAGVACNLDSRGFHVLCKATEEVVGHVKPYSITGTLPLIRDLKDEGFDVQTSGYGLMATYHAKNEYCLLSDMCQGFDVFVRIISQLEQD

SEQ ID NO: 11874 - protein, 437 aa, Brassica rapa
MASSMIESLGSLNKDSFVSLLSKLIGESKFVQNNPPELIPQEDRIVNHVLDSLRPYSTESGGGPLVINHVAYHSGRGNLIVEYPGSVPGKIVSFVGMHMDVVTANPDEWEFDPFSLSIDGDKLRGRGTTDCLGHVALVTELMKRLGETKPALRSSVVAVFIASEENSSIPGVGVDMLVKDKLLDKLKAGPLFWIDTADKQPCIGTGGMIPWKLHVTGKLFHSGLAHKAINAMELGMEGLKEIQSRFYRDFPPHEQEKVYGFATPSTMKPTQWSYPGGGINQIPGDCTVSGDVRLTPFYDVKEVMKKLQEYVDDINANIEKLATRGPVSKYVLPEENLRGRLTLSFDEASAGVACNLDSRGFHVLCKATEEVVGHVKPYSITGTLPLIRDLKDEGFDVQTSGYGLMATYHAKNEYCLLSDMCQGFDVFVKIISQLEQD

SEQ ID NO: 11875 - protein, 437 aa, Brassica napus
MASSMIESLGSLNKDSFVSLLSKLIGESKFVQNNPPELIPQEDRIVNHVLDSLRPYSTESGGGPLVINHVAYHSGRGNLIVEYPGSVPGKIVSFVGMHMDVVTANPDEWEFDPFSLSIDGDKLRGRGTTDCLGHVALVTELMKRLGETKPVLKSSVVAVFIASEENSSIPGVGVDMLVKDKLLDKLKSGPLFWIDTADKQPCIGTGGMIPWKLHVTGKLFHSGLAHKAINAMELGMEGLKEIQSRFYRDFPPHEQEKVYGFATPSTMKPTQWSYPGGGINQIPGDCTVSGDVRLTPFYDVKEVMKKLQEYVDDINTNIEKLSTRGPVSKYVLPEENLRGRLTLSFDEASAGVACNLDSRGFHVLCKATEEVVGHVKPYSITGTLPLIRDLKDEGFDVQTSGYGLMATYHAKNEYCLLTDMCQGFDVFVKIISQLEQD

SEQ ID NO: 11876 - protein, 437 aa, Brassica napus
MASSMIESLGSLNKDSFVSLLSKLIGESKFVQNNPPELIPQEDRIVNHVLDSLRPYSTESGGGPLVINHVAYHSGRGNLIVEYPGSVPGKIVSFVGMHMDVVTANPDEWEFDPFSLSIDGDKLRGRGTTDCLGHVALVTELMKRLGETKPALRSSVVAVFIASEENSSIPGVGVDMLVKDKLLDKLKSGPLFWIDTADKQPCIGTGGMIPWKLHVTGKLFHSGLAHKAINAMELGMEGLKEIQSRFYRDFPPHEQEKVYGFATPSTMKPTQWSYPGGGINQIPGDCTVSGDVRLTPFYDVKEVMKKLQEYVDDINANIEKLATRGPVSKYVLPEENLRGRLTLSFDEASAGVACNLDSRGFHVLCKATEEVVGHVKPYSITGTLPLIRDLKDEGFDVQTSGYGLMATYHAKNEYCLLSDMCQGFDVFVKIISQLEQD

SEQ ID NO: 11877 - protein, 440 aa, Elaeis guineensis
MAASVKDVLGELDRDSYVSLLTKIVGEARHVQNNPPDLIPKEDRVARHVLDALLPLSTTTGGGPLIVSHVVYAEGRGNVIVEYPGSAPGKILSFVGCHMDVVTANPTDWDFDPFSLSVDGDKLRGRGTTDCLGHVALVTELMRRLGQTRPELKNTVVAVFIANEENSSVLGIGVDALVKDGLLDKLKAGPLFWIDTADKQPCIGTGGMIAWRLRATGKLFHSGLAHKAINPLELAMEALKEIQSRFYRDFPPHPKEEVYGFATPSTMKPTQWSYPGGGVNQIPAECTISGDVRLTPFYSTTDVVKKLQEYVDDINANIEKLDSRGLVSKYVLPDENLRGRLTITFDEAVMSGVACNLDSRGFHVLCKATEEVVGYVKPYSITGSLPLIRELQDEGFDVQTSGYGIMATYHARNEYCLFSDMCQGFRVFVSIISQLEEDSN

SEQ ID NO: 11878 - protein, 437 aa, Centaurea maculosa
MVGSGVKETLGELNKDSFVTLLGKLIGESKYVQNNPPDLIPEEDRIVRHVLDVLRPLSTTTAGGPLIVNHATYKPNRGNLIVEYPGTEPGKIISFVGMHMDVVTANPSEWDFDPFSLSIDGEKLRGRGTTDCLGHVALVTELMKKLGQTKPKLKSTVVAVFIASEENSSIPGVGVDALVKDGLLDKLKHGPLFWIDTADKQPCIGTGGMIPWKLHVTGKLFHSGLAHKAINPFELAMEALKEIQTRFYRDFPPHSKEQVYGFATPSTMKPTQWSYPGGGINQIPADCTISGDVRLTPFYNVPDVIKKLKEYVEDLNSNIEKLDTRGPVSKYVLPDENLRGRIEISFDEASSGVACNLESRGFHVLCQATKDAVGHVKPYSITGTLPLIRELQDEGFDVQTAGYGLMATYHAKNEYCLLSDMCQGYQVFTGIIAQLEE

SEQ ID NO: 11879 - protein, 450 aa, Brassica oleracea
  misc_feature (72)..(72): Xaa can be any naturally occurring amino acid
FPQQKKKHLRCATMASSMIESLGSLNKDSFVSLLSKLIGESKFVQNNPPELIPQEDRIVNHVLDSLRPYSTXSGGGPLVINHVAYHSGRGNLIVEYPGSVPGKIVSFVGMHMDVVTANPDEWEFDPFSLSIDGDKLRGRGTTDCLGHVALVTELMKRLGETKPVLKSSVVAVFIASEENSSIPGVGVDMLVKDKLLDKLKSGPLFWIDTADKQPCIGTGGMIPWKLHVTGKLFHSGLAHKAINAMELGMEGLKEIQSRFYRDFPPHEQEKVYGFATPSTMKPTQWSYPGGGINQIPGDCTVSGDVRLTPFYDVKEVMKKLQEYVDDINTNIEKLSTRGPVSKYVLPEENLRGRLTLSFDEASAGVACNLDSRGFHVLCKATEEVVGHVKPYSITGTLPLIRDLKDEGFDVQTSGYGLMATYHAKNEYCLLTDMCQGFDVFVKIISQLEQD

SEQ ID NO: 11880 - protein, 432 aa, Brassica rapa
MESLGSLNKDSFVSLLSKLIGESKFVQNNPPELIPQEDRIVNHVLDSLRPYSTETGGGPLVINHVAYHSGRGNLIVEYPGSVPGKILSFVGMHMDVVTANPDEWEFDPFSLSIDGDKLRGRGTTDCLGHVALVTELMKRLGETKPALKSSVVAVFIASEENSSIPGVGVDMLVKDKLLDKLKSGPLFWIDTADKQPCIGTGGMIPWKLHLTGKLFHSGLAHKAINAMELGMEGLKEIQSRFYRDFPPHPQEKVYGFATPSTMKPTQWSYPGGGINQIPGECTISGDVRLTPFYDVTEVMKKLQEYVDGINTNIENLATRGPVSKYVLPDENLRGRLTLSFDEASAGVACNLDSRGYHVLCNATKEVVGHVKPYSITGTLPLIRDLKDEGFDVQTSGYGLMATYHAKNEYCLLTDMCQGFDVFVRIISQLEQD

SEQ ID NO: 11881 - protein, 432 aa, Catharanthus roseus
KQTLGDLDKESFVTLLSKLIGESKYVQNNPPELIPEEDRIVNHVLEKLQPFSTANGGPLIINHVAYKPKRGNLIVEYPGTVPNKILSFVGMHMDVVTANPSDWEFDPFSMSIDGDKLRGRGTTDCLGHVALVAELMRKLGETKPQLKSTVVAVFIASEENSSIPGVGVDALVKDGLLNKLKHGPLFWIDTADKQPCIGTGGMIPWKLHFSGKLFHSGLPHKAINPLELAMEAFKEIQLRFYKDFPSHPKEQLYGFATPSTMKPTQWSYPGGGINQIPAECTISGDVRLTPFYNVSDVIKKLEEYVEDLNQNIEKLDTRGPVSKYVLPEENLRGRIGITFDGANSGVACNLESNGFKVLCKATEEVVGHVKPYSITGSLPLIRELQDEGFDVQTAGYGLMATYHAKNEYCLLSDMCQGYQIFASIISQLEDLS

SEQ ID NO: 11882 - protein, 440 aa, Eutrema parvulum
MASSSKAMIESLGSLNKDSFVSLLSKLIGESKFVQNNPPELIPQEDRIVNHVLDSLRPYSTETGGGPLLINHVAYHSGRGNLIVEYPGSVPGKILSFVGMHMDVVTANPDEWEFDPFSLSVDGDKLRGRGTTDCLGHVALVTELMKRLGETKPALKSSVVAVFIASEENSSIPGVGVDMLVKDKLLDKLKSGPLFWIDTADKQPCIGTGGMIPWKLHFTGKLFHSGLAHKAINALELGMEGLKEVQSRFYKDFPPHPQEKVYGFATPSTMKPTQWSYPVGGINQIPGECTVSGDVRLTPFYDVKEVMTKLQEYVDDINTNIENLATRGPVSKYVLPDENLRGRLTLSFDEASAGVACNLDSRGFHVLCKATEEVVGHVKPYSITGTLPLIRDLKDEGFDVQTSGYGLMATYHAKNEYCLLTDMCQGFDVFVRIISQLEED

SEQ ID NO: 11883 - protein, 435 aa, Plantago ovata
MATVKQILGDLNKESFVSLLSKLIGESKFVQNNPPELIPEEDRIVNHVLDVLKPFSTATGGGPLVINHVAYKPNRGNLIVEYPGTQPGKIMSFVGMHMDVVTANPSDWDFDPFTLGIEGDKLKGRGTTDCLGHVALVAELMRRLGETKPKLTSTVVAVFIASEENSSIPGVGVDALVKDGLLDSLKQGPLFWIDTADKQPCIGTGGMVPWKLHISGKLFHSGLAHKAINPLELAMEAFKEIQLRFYRDFPPHAKEELYGFATPSTMKPTQWSYPGGGINQIPAECTLCGDVRLTPFYSVTDVISKLKEYVDDLNANIEKLDTRGPVSKYVLPDENLTGRLSISFDEANSGVACSLDSRGFHVLCKATEEVVGHVKPYSITGSLPLIRELQDEGFDVQTCGYGLMATYHAKNEYCLLSDMCQGYGVFVSIISQLED

SEQ ID NO: 11884 - protein, 431 aa, Tabernaemontana elegans
KQALGDLNKESFVTLLSKLIGESEHVQNNPPELIPEEDRIVKHVKEKLLPFSTTTCGGPLIINHVTYKPNRGNLIVEYPGTEPNKIVSFVGMHMDVVTANRSDWEFDPFSLSIDGDKLRGRGTTDCLGHVALVAELMRKLGETKPQLKSTVVAVFIASEENSSIPGVGVDALVKHGLLNKLKNGPLFWIDTADKQPCIGTGGMIPWKLHVTGKLFHSGLPHKAINPLELAMEALKEIQLRFYKDFPPHPKEQVYGFATPSTMKPTQWSYPGGGINQIPFDCTISGDVRLTPFYNVSDVIKKLQGYVEDLNQNIEKLDTRGPVSKYVLPEENLRGRIDISFDEANSGVACDLESRGFKVLCKATEEVVGHVKPYSITGSLPLIRELQDEGFDVQTAGYGLMATYHARNEFCLLSDMCQGYKIFASVISQLED

SEQ ID NO: 11885 - protein, 437 aa, Centaurea maculosa
MVGSGVKETLGELNKDSFVTLIGKLIGESKYVQNNPPDLIPEEDRIVRHVLDVLRPLSTTTGGGPLIVNHVTYKPNRGNLIVEYPGTEPGKIISFVGMHMDVVTANPSEWDFDPFSLSIDGEKLRGRGTTDCLGHVALVTELMKKLGQTKPKLKSTVVAVFIASEENSSIPGVGVDALVKDGLLDKLKHGPLFWIDTADKQPCIGTGGMIPWKLHVTGKLFHSGLAHKAINPFELAMEALKEIQTRFYRDFPPHSKEQVYGFATPSTMKPTQWSYPGGGINQIPADCTISGDVRLTPFYNVPDVIKKLKEYVEDLNSNIEKLATRGPVSKYVLPDENLRGRIEISFDEASSGVACNLESRGFHVLCQATKEAVGHVKPYSITGTLPLIRELQDEGFDVQTAGYGLMATYHAKNEYCLLPDMCQGYQVFTGIIAQLEE

SEQ ID NO: 11886 - protein, 341 aa, Brassica napus
MHMDVVTANPDEWEFDPFSLSIDGDKLRGRGTTDCLGHVALVTELMKRLGETKPALRSSVMAVFIASEENSSIPGVGVDMLVKDKLLDKLKAGPLFWIDTADKQPCIGTGGMIPWKLHVTGKLFHSGLAHKAINAMELGMEGLKEIQSRFYRDFPPHEQEKVYGFATPSTMKPTQWSYPGGGINQIPGDCTVSGDVRLTPFYDVKEVMKKLQEYVDDINTNIEKLSTRGPVSKYVLPEENLRGRLTLSFDEASAGVACNLDSRGFHVLCKATEEVVGHVKPYSITGTLPLIRDLKDEGFDVQTSGYGLMATYHAKNEYCLLSDMCQGFDVFVKIISQLEQD

SEQ ID NO: 11887 - protein, 438 aa, Raphanus sativus
MASSTIESSLGSLNKDSFVSLLSKLIGESKFVQNNPPDLIPQEDRIVNHVLDSLRPYSTESGGGPLLINHVAYHSGRGNLIVEYPGSVPGKIVSFVGMHMDVVTANPDEWEFDPFSLSIDGDKLRGRGTTDCLGHVALVTELMKRLGETKPVLKQSVVAVFIASEENSSIPGVGVDMLVKDKLLDKLKSGPLFWIDTADKQPCIGTGGMIPWKLHVTGKLFHSGLAHKAINAMELGMEGLKEIQSRFYRDFPPHEQEKVYGFATPSTMKPTQWSYPGGGINQIPGDCTVSGDVRLTPFYDVKEVMKKLQEYVDDINTNIEKLATRGPVSKYVLPEENLRGRLTLSFDEASAGVACNLDSRGFHVLCKATEEVVGHVKPYSITGTLPLIRDLKDEGFDVQTSGYGLMATYHAKNEYCLLTDMCQGFDVFVKIISQLEQD

SEQ ID NO: 11888 - protein, 437 aa, Tragopogon dubius
MVASAVKETLGDLNKDSFVTLLTKLIGESKYVQNNPPDLIPEEDRIVRHVRDVLLPHSTATGGGPLIINHVTYKPNRGNLIVEYPGTESGKILSFVGMHMDVVTANPSEWDFDPFSMSIDGDKLRGRGTTDCLGHVALVAELMKKLGQTKPKLKSTVVAVFIASEENSSIPGVGVDALVKDGLLDKLKYGPLFWIDTADKQPCIGTGGMIPWKLHVIGKLFHSGLAHKAINPFELAMEALKEIQTRFYKDFPPHSKEEVYGFATPSTMKPTQWTYPGGGINQIPSDCTISGDVRLTPFYNVPDVIKKLNEYVEDLNTNIQKIATRGPVSKYVLPDENLRGKIEISFDEASSGVACNLESRGFHVLCDATKDAVGHVKPYSITGTLPLIRELQDEGFDVQTAGYGLMATYHAKNEYCLLSDMCQGYQVFTGIIARLEE

SEQ ID NO: 11889 - protein, 192 aa, Glycine max
MAAESSEGEEETKLSGGNQLLIVDDDLTEMGKKAAWSVSSCKPGNGVSSLRDDNLETYWQSDGGQPHLVNIQFQKKVRLQLIVLYVDFKLDESYTPSKVSIRAGDGFHNLKEIKTVELVKPTGWVYLSLSGVDPRDTFVNTFMLQIAVLSNHLNGRDTHVRQIKVYGPRPNPIPHQPFQFTSREFITYSSIR

SEQ ID NO: 11890 - protein, 192 aa, Vigna unguiculata
MAAESSEGEEETKLSGGNQLLTVDDDLTEMGKKAAWSVSSCKPGNGVSSLRDDNLETYWQSDGAQPHLVNVQFQKKVRLQLIVLYVDFKLDESYTPSKVSIRAGDGFHNLKEIKTVELVKPTGWVYLSLSGVDPRDTFVNTFMLQIAVLSNHLNGRDTHVRQIKVYGPRPNPIPHQPFQFTSREFITYSSIR

SEQ ID NO: 11891 - protein, 192 aa, Glycine max
MAAESSEGEEETKLSGGSLLLTVDDDLTEMGKKAAWSVSSCKPGNGVSSLRDDNLETYWQSDGGQPHLVNIQFQKKVRLQLIVLYVDFKLDESYTPSKVSIRAGDGFHNLKEIKTVELVKPTGWVYLSLSGVDPRDTFVNTFMLQIAVLSNHLNGRDTHVRQIKVYGPRPNPIPHQPFQFTSREFITYSSIR

SEQ ID NO: 11892 - protein, 192 aa, Lupinus angustifolius
MAAESSEGEEEGKVTGGNQILMIDDDLREMGKKAAWSVSSCKPGNGVISLRDDNLETYWQSDGAQPHLVNIQFQKKVRLQLIVLYVDFKLDESYTPSKISIRAGDGFHNLKEIKTVELVKPTGWVYLSLSGADPRETFVNTFMLQIAVLSNHLNGRDTHVRQIKIYGPRPNPIPHQPFQFTSREFITYSSIR

SEQ ID NO: 11893 - protein, 192 aa, Glycyrrhiza uralensis
MAAESSEGEEDGKLSGGNQLLMVDDELTELGKKAAWSVSSCKPGNGVSSLRDDNLDTYWQSDGAQPHLVNIQFQKKVRLQLVVLYVDFKLDESYTPSKVSIRAGDGFHNLKEIKSAELVKPTGWVYLSLSGVDPRETFVNTFMLQIAVLSNHLNGRDTHVRQIKVYGPRPNPIPHQPFEFTSREFITYSCIR

SEQ ID NO: 11894 - protein, 192 aa, Cicer arietinum
MAAESSEGEEEGKLSGGNQVLIVDDELRELGKKAAWSVSSCKPGNGVSSLRDDNLETYWQSDGAQPHFVNIQFQKKVRLQLVVLYVDFKLDESYTPSKISIRAGDGFHNLKEIKAVELVKPTGWLYLSLSGIDPRDTFVNTFMLQIAVLSNHLNGRDTHVRQIKVYGPRPNPIPQQPFQFTSEEFITYSTIR

SEQ ID NO: 11895 - protein, 192 aa, Cajanus cajan
MAAESSEGEEETKLSGSYQLLTIPDDLTEMGKKAAWSVSSCKPGNGVSSLRDDNFDTYWQSDGAQPHLVNIQFQKKVRLQLIVMYVDFKLDESYTPSKISIRAGDGFHNLKEIRIVEIVKPVGWVYISLSGFDPRETFVNTFMLQIAVLSNHLNGRDTHVRQIKVYGPRPNPIPHQPFQFTSREFITYSSIR

SEQ ID NO: 11896 - protein, 192 aa, Medicago truncatula
MAAESSEGEEEGKLSGGNQVLIVDEDLRELGKKAAWSVSSCKTGNGVSSLRDDNLETYWQSDGAQPHFVNIQFQKKVRLQLVVLYVDFKLDESYTPSKISIRAGDGFHNLKEIKAVELVKPTGWLYLSLSGLDPRETFVNTFMLQIAVLSNHLNGRDTHVRQIKVYGPRPNPIPQQPFQFTSTEFITYSTIR

SEQ ID NO: 11897 - protein, 80 aa, Trigonella foenum-graecum
MAAESSEGEEEGKLSGGNQILIIDDDLRELGKKAAWSVSSCKTGNGVLLFVTTISKPTGNLMELNLILLTSNSKRKSDYN

SEQ ID NO: 11898 - protein, 192 aa, Medicago truncatula
MAAESSEGEEEGKLSGGNQVLIVDEDLRELGKKADWSVSSCKTGNGVSSLRDDNLETYWQSDGAQPHFVNIQFQKKVRLQLVVLYVDFKLDESYTPSKISIRAGDGFHNLKEIKAVELVKPTGWLYLSLSGLDPRETFVNTFMLQIAVLSNHLNGRDTHVRQIKVYGPRPNPIPQQPFQFTSTEFITYSTIR

SEQ ID NO: 11899 - protein, 192 aa, Ricinus communis
MATESSEGEEEGKITGGNQHLVVDDDLREMGKKAAWSVSSCKPGNGVSSLRDDNLDSFWQSDGAQPHLVNIQFQKKVKLQLVLLYVDFKLDESYTPSKISIRAGDGFHNLKEIKTVELVKPTGWVYLSLSGNDPRETFVNTFMLQIAVLSNHLNGRDTHVRQIKVYGPRLNPIPHQPFQFTSREFITYSSVR

SEQ ID NO: 11900 - protein, 192 aa, Gossypium hirsutum
MATESSESEEEGKITGGNQHLIVEDDLREMGKKAAWSVSSCKTGNGVSSLRDDNLETYWQSDGAQPHLVNIQFQKKVKLQLVVLYVDFKLDESYTPSKISIRAGDGFHNLKEIKTVELVKPTGWVYLSLSGNDPRETFVNTFMLQIVVLSNHLNGRDTHVRQIKVYGPRPNPIPHQPFQFTSREFITYSTVR

SEQ ID NO: 11901 - protein, 192 aa, Cucumis sativus
MATESSEGEEDVKLTGGNQVLVVEDDLREMGKKAAWSVSSCKPGNGVSALRDDNLETYWQSDGVQPHLVNIQFQKKVKLQLVVLYVDFKLDESYTPSKISIRAGDGFHNLKEIKTVELVKPTGWVYLLLSGNDPKDTFVNTFMLQIAVLSNHLNGRDTHVRQIKIYGPRPNPIPHQPFQFTSREFITYSIIR

SEQ ID NO: 11902 - protein, 192 aa, Theobroma cacao
MATESSESEEEGKITGGNQHLIVEDDLREMGKKAAWSVSSCKTGNGVSSLRDDNLETYWQSDGAQPHLVNIQFQKKVKLQLVVLYVDFKLDESYTPSKICIRAGDGFHNLKEIKTVELVKPTGWVYLSLSGNDPRETFVNTFMLQIAVLSNHLNGRDTHVRQIKVYGPRLNPIPHQPFQFTSREFITYSTVR

SEQ ID NO: 11903 - protein, 192 aa, Gossypium raimondii
MATESSESEEEGKITGGNQHLIVEDDLREMGKKAAWSVSSCKTGNGVSSLRDDNLETYWQSDGAQPHLVNIQFQKKVKLQLVVLYVDFKLDESYTPSKISIRAGDGFHNLKEIKTVELVKPTGWVYLSLSGNDPRETFVSTFMLQIVVLSNHLNGRDTHVRQIKVYGPRPNPIPHQPFQFTSREFITYSTVR

SEQ ID NO: 11904 - protein, 192 aa, Manihot esculenta
MATESSEGEEEGKITGGNQHLIVDDDLREMGKKAAWSVSSCKPGNGVSSLRDDNLDSFWQSDGAQPHLVNIQFQKKVKLQLVVLYVDFKLDESYTPSKISICAGDGFHNLKEIKTVELVKPTGWVYLSLSGTDPRETFVSTFMLQIAVLSNHLNGRDTHIRQIKVYGPRPNPIPHQPFQFTSREFITYSSVR

SEQ ID NO: 11905 - protein, 192 aa, Tropaeolum majus
MATESSESEEEGKIKGGNEKLTVDDDLREMGKKAAWSVSSCKPGNGVSSLHDDNLETYWQSDGPQPHLVNIQFQKKVKLQLVVLYVDFKLDESYTPSKISIRAGDGFHNLKEIKTVELVKPTGWVYLSLSGTDPRETFVNTFMLQIAVLSNHLNGRDTHVRQIKVYGPRPNPIPHQPFQFTSTEFITYSTVR

SEQ ID NO: 11906 - protein, 191 aa, Sesamum indicum
MAESSEGEEEGKLTGGNQQLMVDDDLREMGKKAAWSVSSCKPGNGVASLRDDNLDTYWQSDGAQPHLVNIQFQKKVKLQLVVLYVDFKLDESYTPSKISIRAGDGFHNLKEIKAVELAKPTGWMYISLSGSDPRETFVNTFMLQIAVLSNHLNGRDTHVRQIKVYGPRPNPIPHQPFQFTSTEFITYSTLR

SEQ ID NO: 11907 - protein, 192 aa, Citrullus lanatus
MATESSEGEDDVKLTGGNQVLVVEDDLREMGKKAAWSVSSCKPGNGVSALRDDNLETYWQSDGVQPHLVNIQFQKKVKLQLVVLYVDFKLDESYTPSKISIRAGDGFHNLKEIKTVELVKPTGWVYLSLSGNDPKDTFVNTFMLQIAVISNHLNGRDTHVRQIKIYGPRPNPIPHQPFQFTSREFITYSIIR

SEQ ID NO: 11908 - protein, 191 aa, Amsonia hubrichtii
MAESSEGEEEGKLTGGNQQLVVDDDLREMAKKAAWSVSSCKPGNGVLALRDDNLDTYWQSDGAQPHLVNIQFQKKVKLQLVVLYVDFKLDESYTPSKISIRAGDGFHNLKEIKVVELVKPTGWVYISLSGNDPRETFVNTFMLQIAVLSNHLNGRDTHVRQIKVYGPRPNPIPHQPFQFTSREFITYSTVR

SEQ ID NO: 11909 - protein, 192 aa, Quercus alba
MATELSEGEEEGKVTGGNQVLIVEDDLREMGKKAAWSVSSCKPGNGVSALRDENLETYWQSDGAQPHLVNIQFQKKVKLQLVVLYVDFKLDESYTPSKISIRAGDGFHNLKEIKTVELVKPSGWVYLSLSGNDPRETFVNTFMLQIAVLSNHLNGRDTHVRQIKVYGPRPNPIPHQPFHFTSREFITYSFVR

SEQ ID NO: 11910 - protein, 192 aa, Populus trichocarpa
MATESSEGEEEGKITGGNKLLVIEDDLREMGKKAAWSVSSCKPGNGVSSLRDDNLDTYWQSDGAQPHLVNIQFQKKVKLQLVVLYVDFKLDESYTPSKISIRAGDGFHNLKEIKTMELVKPTGWVYLSLSGNDPRETFVNTFMLQIAVLSNHLNGRDTHVRQIKVYGPQLNPFPHQPFQFTSREFITYSSVR

SEQ ID NO: 11911 - protein, 192 aa, Populus trichocarpa
MATESSEGEEEGKITGGNKHLVIEDDLREMGKKAAWSVSSCKPGNGVSSLRDDNLDTYWQSDGAQPHLVNIQFQKKVKLQLVVLYVDFKLDESYTPSKISIRAGDGFHNLKEIKTMELVKPTGWVYLSLSGNDPRETFVNTFMLQIAVLSNHLNGRDTHVRQIKVYGPRPNPFPHQPFQFTSREFIMYSSVR

SEQ ID NO: 11912 - protein, 192 aa, Unknown
  Sequence found in Organisms: Prunus persica, Prunus mume
MATESSEGEEEGKLTGGNQVLTVDDDLREMGKKAAWSVSSCKAGNGVSSLRDDNLDTYWQSDGAQPHLVNIQFQKKVKLQLVVLYVDFKLDESYTPCKISIRAGDGFHNLKDIKTVELDKPTGWVHISLSGNDPRETFVNTFMLQISVLSNHLNGRDTHVRQIKVYGPRPNPIPHQPFQFTSREFITYSSVR

SEQ ID NO: 11913 - protein, 90 aa, Tripterygium wilfordii
MATESSEGEDEGKITGGNQHLIVDDDLREMGKKAAWSVSSCKPGNGVSSLRDENLDTYWQSDGAQPHLVNVQFQKKVKLHLVVLYVDFKT

SEQ ID NO: 11914 - protein, 192 aa, Panax ginseng
MATESSEGEEEAKLIGGNQQLVVDDDLREMAKKAAWSVSSCKPGNGVLSLRDDNLDSYWQSDGAQPHLVNIQFQKKVKLQLVVLYVDFKLDESYTPSKIAIRAGDGFHNLKEIKTVELVKPTGWVYISLSGNDPREAFVNTFMLQIAVLSNHLNGRDTHVRQIKVYGPRPNPIPHQLFQFTSREFITYSIVR

SEQ ID NO: 11915 - protein, 192 aa, Fagus grandifolia
MATESSEGEEEGKVTGGNQALIVEDDLREMGKKAAWSVSSCKPGNGVSALRDDNLETYWQSDGAQPHLVNIQFQKKVKLQSVVLYLDFKLDESYTPSKISIRAGDGFHNLKEIRTVELDKPSGWIHLSLSGIDPRETFVNTFMLQIAVLSNHLNGRDTHVRQIKVYGPRPNPIPHQPFHFTSREFITYSSVR

SEQ ID NO: 11916 - protein, 192 aa, Manihot esculenta
MATELSEGEEEGKITGGNQFLILDDDLREMGKKAAWSVSSCKLGNGVSSLRDDNLDSFWQSDGAQPHLVNIQFQKKVKLQLIVLYVDFKLDESYTPSKISIRTGDGFHNLKEIKAVELVKPTGWVYLSLSRNDPRETFVNTFMLQIAVLSNHLNGRDTHVRQIKVYGPRPNPIPHQPFQFTSREFITYSSVR

SEQ ID NO: 11917 - protein, 189 aa, Gossypium hirsutum
ESSESEEEGKITGGNQHLIVEDDLREMGKKAAWSVSSCKTGNGVSSLRDDNLETYWQSDGAQPHLVNIQFQKKVKLQLVVLYVDFKLDESYTPSKISIRAGDGFHNLKEIKTVELVKPTGWVYLSLSGNDPRETFVSTFMLQIVVLSNHLNGRDTHVRQIKVYGPRPNPIPHQPFQFTSREFITYSTVR

SEQ ID NO: 11918 - protein, 152 aa, Carica papaya
MATESSESEEEGKIRGGNETLIVDDNLREMGKKAAWSVSSCKPGNGVSSLRDDNLDTYWQSDGAQPHLVNIQFQKKVKLQLVVLYVDFKLDESYTPSKISIRAGDGFHNMKEIKAVELVKPTGWVYISLSGNDPRETFVTPLCCKLLSYQSP

SEQ ID NO: 11919 - protein, 191 aa, Catharanthus roseus
MAESSEGEEEGKLTGGNQQLVVDDDLREMAKKAAWSVSSCKPGNGVLALRDDNLDTYWQSDGAQPHLVNIQFQKKVKLQLVVLYVDFKLDESYTPSKISIRAGDGFQNLKEIKVVELVKPTGWVYISLSGNDPRETFVNTFMLQIAILSNHLNGRDTHVRQIKVYGPRPNPIPHQPFQFTSREFITYSTVR

SEQ ID NO: 11920 - protein, 191 aa, Tabernaemontana elegans
MAESSEGEEDGKLTGGNQQLVVDDDLREMAKKAAWSVSSCKPGNGVLALRDDNLDTYWQSDGAQPHLVNIQFQKKVKLQLVVLYVDFKLDESYTPSKISIRAGDGFHNLKEIKVVELVKPTGWVYISLSGSDPSETFVNTFMLQIAVLSNHLNGRDTHVRQIKVYGPRPNPIPHQPFQFTSREFITYSTVR

SEQ ID NO: 11921 - protein, 192 aa, Malus domestica
MATESSEGEEDAKLTGGHQLLVVDDDLREMGKKAAWSVSSCKAGNGVSSLRDDNLDTYWQSDGAQPHLVNIQFQRKVKLQLVVLYVDFKLDESYTPCKISIRAGDGFHNLKDIKTVELDKPTGWVHISLSGNDPRETFVNTFMLQISVLSNHLNGRDTHVRQIKVYGPRPNPIPHQPFQFTSREFITYSTVR

SEQ ID NO: 11922 - protein, 191 aa, Chelidonium majus
MATESDGEEEGKLIGGNQHLVVDDDLREMAKKAAWSVSSCKSGNGVQSLRDDNLDTYWQSDGAQPHLVNIQFQKKVKLQLVVLYVDFKLDESYTPSKISIRAGDGFHNLKEIKTVELVKPVGWVYISLSGTDPREAFINTFMLQISVLSNHLNGRDTHVRQIKVYGPRPNPIPHQPFQFTSREFITYSSVR

SEQ ID NO: 11923 - protein, 192 aa, Euonymus alatus
MATVSSEGEDEGKITGGNQHLIIDDDLREMGKKAAWSVSSCKPGNGVSSLRDENLDTYWQSDGAQPHLVNVQFQKKVKLQLVVLYVDFKLDESYTPSKISIRAGDGFHNLKEIKTVELVKPTGWVYISLSGNDPRETFVNTFLLQIIVLSNHLNGRDTHVRQIKVYGPRPNPIPHQPFQFTSPEFITYSSVR

SEQ ID NO: 11924 - protein, 192 aa, Actinidia deliciosa
MATESSEGEEESKMVGGNQQLMVEDDLREMANKAAWSVSSCKPGNGVTALRDDNLDTYWQSDGAQPHLVNIQFQKKVKLQLVVLYVDFKLDESYTPSKISIRAGDGFHNLKEVKTVELIKPTGWVYISLSGNDPRETFVNTFMLQIAVLSNHLNGRDTHVRQIKVYGPRLNPIPHQPFQFTSREFITYSTVR

SEQ ID NO: 11925 - protein, 191 aa, Vinca minor
MAESSEGEEEGKLTGGNQQLVVDDDLREMAKKAAWSVSSCKPGNGVLALRDDNLDTYWQSDGAQPHLVNIQFQKKVKLQLVVVYVDFKLDESYTPSKISIRAGDGFHNLKEIKVVELVKPTGWVYISLSGNDPRETFINTFMLQIAILSNHLNGRDTHVRQIKVYGPRPNPIPHQPFQFTSREFITYSIVR

SEQ ID NO: 11926 - protein, 192 aa, Unknown
  Sequence found in Organisms: Centaurea maculosa, Cirsium arvense
MATESSEGEEETKLMGGNPQLVVDGDLREMAKMAAWSVSSCKPGNGVSSLRDDNYETYWQSDGAQPHLVNIQFQKKVKLQLVALYVDFNLDESYTPSKISVRAGDGFHNLKEIKTVELVKPTGWVYISLSGNDPREAFVNTFMLQIAILSNHLNGRDTHVRQIKVYGPRPNPIPHQPFQFTSTEFITYSTVR

SEQ ID NO: 11927 - protein, 188 aa, Panax ginseng
MATESSEGEEEAKLIGGNQQLVVDDDLREMAKKAAWSVSSCKPGNGVLSLRDDNLDSYWQSDGAQPHLVNIQFQKKLVVLYVDFKLDESYTPSKIAIRAGDGFHNLKEIKTVELVKPTGWVYISLSGNDPREAFVNTFMLQIAVLSNHLNGRDTHVRQIKVYGPRPNPIPHQLFQFTSREFITYSIVR

SEQ ID NO: 11928 - protein, 192 aa, Ambrosia trifida
MATESSEGEEETKLMGGNPQLVVDSDLREMAKNAAWSVSSCKPGNGVSSLRDDNYETYWQSDGAQPHLVNIQFQKKVKLQLVALYVDFNLDESYTPSKISIRAGDGFHNLKEIKTVELVKPTGWVYISLSGNDPRETFVNTFMLQIGVLSNHLNGRDTHIRQIKVYGPQPNPIPHQPFQFTSTEFITYSTLR

SEQ ID NO: 11929 - protein, 192 aa, Citrus clementina
MATESSESEEEGKITGGNHQLLIDDDLREMGKKAAWSVSSCKPGNGVSALRDDNLDTYWQSDGAQPHLVNIQFQKKVKLQLVVLYVDFKLDESYTPSKISVRAGDGFHNLKEIKTVELVKPTGWVYISLSGNDPRDTFVNTFMLQIVVLSNHLNGRDTHVRQIKIYGPRPNPIPHQQFQFTSSEFITYSTVR

SEQ ID NO: 11930 - protein, 192 aa, Vitis vinifera
MATESSEGEEEGKMIGGNQHLVVDDDLREMAKKAAWSVSSCKAGNGVLLLRDDNLDTYWQSDGAQPHLVNIQFLKKVKLQLVVIYVDFKLDESYTPSKISIRAGDGFHNLKEIKTVELVKPTGWVYISLSGNDPRETFVNTFMLQIAILSNHLNGRDTHVRQIKVYGPPPNPIPRQPFQFTSREFITYSSVR

SEQ ID NO: 11931 - protein, 192 aa, Centaurea maculosa
MATESSEGEEETKLMGGNPQLVVDGDLREMAKMAAWSVSSCKPGNGVSSLRDDNYETYWQSDGAQPHLVNIQFQKKVKLQLVALYVDFNLDESYTPSKISVRAGDGFHNLQEIKTVELVKPTGWVYISLSGNDPREAFVNTFMLQIAILSNHLNGRDTHVRQIKVYGPRPNPIPHQPFQFTSTEFITYSTVR

SEQ ID NO: 11932 - protein, 192 aa, Centaurea maculosa
MATESSEGEEETKLMGGNPQLVVDGDLREMAKMAAWSVSSCKPGNGVSSLRDDNYETYWQSDGAQPHLVNIQFQKKVKLQLVALYVDFNLDESYTPSKISVRAGDGFHNLKEIKTVELVKPTGWVYICLSGNDPREAFVNTFMLQIAILSNHLNGRDTHVRQIKVYGPRPNPIPHQPFQFTSTEFITYSTVR

SEQ ID NO: 11933 - protein, 192 aa, Cirsium arvense
MATESSEGEEETKLMGGNPQLVVDGDLREMAKMSAWSVSSCKPGNGVSSLRDDNYETYWQSDGAQPHLVNIQFQKKVKLQLVALYVDFNLDESYTPSKISVRAGDGFHNLKEIKTVELVKPTGWVYISLSGNDPREAFVNTFMLQIAILSNHLNGRDTHVRQIKVYGPRPNPIPHQPFQFTSTEFITYSTVR

SEQ ID NO: 11934 - protein, 192 aa, Taraxacum officinale
MATESSEGEEETKLMGGNPQLVVDGDLREMAKMAAWSVSSCKPGNGVSSLRDDNYETYWQSDGAQPHLVNIQFQKKVKLQLVALYVDFNLDESYTPSKISIRAGDGFHNLKEIKTVELVKPTGWVHISLSGNDPREAFVNTFMLQIGILSNHLNGRDTHVRQIKVYGPRPNPIPHQPFQFTSSEFITYSTVR

SEQ ID NO: 11935 - protein, 192 aa, Euphorbia peplus
MATELSEGEEEGKIVGGNQHLIVDAFLREMGKKAAWSVSSCKPGNAVSSLRDDNLDTFWQSDGAQPHLVNIQFQKKEKLQLVVVYVDFKLDESYTPSKISIRAGDGFHNLKEIKTVELVKPTGWVYLSLSGNDPRETFVNTFMLQIAVLSNHLNGRDTHVRQIKVYGPRPNPFPQQPFQFTSREFITYANVR

SEQ ID NO: 11936 - protein, 192 aa, Vitis vinifera
MATESSEGEEEGKMIGGNQHLVVDEDLREMAKKAAWSVSSCKAGNGVLLLRDDNLDTYWQSDGAQPHLVNIQFLKKVKLQLVVIYVDFKLDESYTPSKISIRAGDGFHNLKEIKTVELVKPTGWVYISLSGNDPRETFVNTFMLQIAILSNHLNGRDTHVRQIKVYGPPPNPIPRQPFQFTSREFITYSSVR

SEQ ID NO: 11937 - protein, 192 aa, Lactuca sativa
MATESSEGEEETKLTGGNPQLVVDGDLREMAKMAAWSVSSCKPGNGVSSLRDDNYETYWQSDGAQPHLVNIQFQKKVKLQLVALYVDFNLDESYTPSKISIRAGDGFHNLKEIKTVELVKPTGWVHISLSGNDPREAFVNTFMLQIGILSNHLNGRDTHVRQIKVYGPRPNPIPHQPFQFTSSEFITYSTVR

SEQ ID NO: 11938 - protein, 191 aa, Mimulus guttatus
MADSSEGEEEGKLSGGNQQLAVDEELREMAKKAAWSVSSCKPGNGVASIRDDNLDSYWQSDGAQPHLVNIQFQKKVRLQLVVLYVDFKLDESYTPSKISIRAGDGFHNLKEIKAVELVKPTGWVYISLSGTDPRETFVNTFMLQIAILSNHLNGRDTHVRQIKVYGPRPNPIPRQPFQFTSNEFITYSILR

SEQ ID NO: 11939 - protein, 191 aa, Papaver somniferum
MATESDGEEEGKLIGGNQHLVVDDDLREMAKKAAWSVSSCKSGNGVQSIRDDNLDTYWQSDGAQPHLVNIQFQKKVKLQLVVMYVDFKLDESYTPSKVSIRAGDGFHNLKEIKTVELVKPVGWMYIPLSGTEPRDAFLNTFMLQIAIISNHLNGRDTHVRQIKVYGPRPNPIPHQPFQFTSREFITYSSIR

SEQ ID NO: 11940 - protein, 152 aa, Euonymus alatus
MATVSSEGEDEGKITGGNQHLIIDDDLREMGKKAAWSVSSCKPGNGVSSLRDENLDTYWQSDGAQPHLVNVQFQKKVKLQLVVLYVDFKLDESYTPSKISIRAGDGFHNLKEIKTVELVKPTGWVYISLSGNDPRETFVNTFLLQIIVLSNH

SEQ ID NO: 11941 - protein, 163 aa, Heritiera littoralis
MGKKAAWTVSSCKTGNGVSSLRDDNLETYWQSDGAQPHLVNVQFQKKVKLQLVVIYVDFKLDESYTPSKISIRAGDGFHNLKEIKTVELVKPTGWVYLSLSGNDPRETFVNTFMLQIAILSNHLNGRDTHVRQIKVYGPRPNPIPHQPFQFTSREFITYSTVR

SEQ ID NO: 11942 - protein, 191 aa, Ocimum basilicum
MAESSEGEEEGKLTGGSAQLVVDDDLRDMAKKAAWSVSSCKPGNGVASLRDDNLDTYWQSDGAQPHLVNIQFQKKVKLQLVVLYVDFKIDESYTPSKISIRAGDGFHNLKEIKTVELDKPTGWMYISLSGSDPRETFVNTFMLQIAVLSNHLNGRDTHLRQIKVYGPRPNPIPHQPFHFTSTEFITYSILR

SEQ ID NO: 11943 - protein, 192 aa, Eucalyptus grandis
MATESSEGEDEGKITGGNPVLAVDDDLREMGKKAVWSVSSCKPGNGVSSLRDDNLDTYWQSDGAQPHLVNVQFQKKVKLQMVALYVDFKLDESYTPSKISIRAGDGFHNLKEIKTVELLKPSGWIPISLSGNDPRETFVNTFMLQIAVLSNHLNGRDTHVRQIKVYGPRPNPFPHQPFQFTSTEFITYSCVR

SEQ ID NO: 11944 - protein, 191 aa, Nicotiana benthamiana
MADSSEGEEEGKLTGGSQQLVVDDDLREMGKKAAWSVSSYKPGNGVLSLRDDNLDTYWQSDGAQPHLVNVQFQKKVKLQLVVLYVDFKLDESYTPGKISIRAGDGFHNLKEIKAVELVKPTGWIYISLSGNDPRETFVNTFMLQIGVLSNHLNGRDTHIRQIKVYGPRPNPIPLQPFQFTSTEFITYSTVR

SEQ ID NO: 11945 - protein, 191 aa, Papaver somniferum
METESDGEEEGKLIGGNQHLVVDDDLREMAKKAAWSVSSCKSGNGVPSIRDDNLDTYWQSDGAQPHLVNIQFQKKVKLQLVVMYVDFKLDESYTPSKVSIRAGDGFHNLKEIKTVELVKPVGWMYIPLSGTEPRDAFPNTFMLQIAIISNHLNGRDTHVRQIKVYGPRPNPIPHQPFQFTSREFITYSSIR

SEQ ID NO: 11946 - protein, 191 aa, Papaver somniferum
MATESDGEEEGKLIGGNQHLVVDDDLREMAKKAAWSVSSCKSGNGVQSIRDDNLDTYWQSDGAQPHLVNIQFQKKVKLQLVVMYVDFKLDESYTPSKVSIRAGDGFHNLKEIKTVELVKPVGWMYIPLSGTEPRDAFLNTFMLQIAIISNHLNGRDTHVRQIKVYGPRPNPIPHQPFQFTSREFITYSTIR

SEQ ID NO: 11947 - protein, 192 aa, Arabidopsis thaliana
MATESSESEEEGKISGGNYKLIIDDDLREMGKNAAWSVSSCKPGNGVTTLRDDNLETYWQSDGLQPHLINIQFQKKVKLQLVVLYVDFKLDESYTPSKISIRAGDGFHNLKEIKSVELVKPTGWVCLSLSGTDPRETFVNTFMLQIAILSNHLNGRDTHIRQIKVYGPRPNPIPHQPFQFTSMEFLTYSTLR

SEQ ID NO: 11948 - protein, 192 aa, Echinacea purpurea
MATESSEGEEETKLMGGNPQLVVDSDLREMAKNAAWSVSSCKPGNGVSSLRDDNYETYWQSDGAQPHLVNIQFQKKVKLQIVALYVDFNLDESYTPSKISIRVGDGFHNLKEIKTVELVKPTGWVPISLSGNDPRETFVNTFMLQIGVLSNHLNGRDTHIRQIKVYGPQPNPIPHQPFQFTSAEFITYSTLR

SEQ ID NO: 11949 - protein, 191 aa, Nicotiana benthamiana
MADSSEGEEEGKLTGGSQQLVVDDDLREMGKKAAWSVSSYKPGNGVLSLRDDNLDTYWQSDGAQPHLVNVQFQKKVKLQLVVLYVDFKLDESYTPGKISIRAGDGFHNLKEIKAVELVKTTGWVYISLSGSDPRETFVNTFMLQIAVLSNHLNGRDTHIRQIKVYGPRPNPIPLQPFQFTSTEFITYSTVR

SEQ ID NO: 11950 - protein, 191 aa, Solanum phureja
MADSSEGEEEGKLTGGSQQLVVDDDLREMGKTAAWSVSSYKPGNGVLSLRDDNLETYWQSDGAQPHLVNVQFQKKVKLQLVVLYVDFKLDESYTPGKISIRAGDGFHNLKEIKAVELVKPTGWMHISLSGNDPRETFVNTFMLQIAVLSNHLNGRDTHIRQIKVYGPRPNPIPLQPFQFTSTEFITYSAVR

SEQ ID NO: 11951 - protein, 191 aa, Fragaria vesca
MAESSEGEEEGKLTVGNQVLMVEDDLREMGKNAAWSVSSWKSGNGVSYLRDDNLDTYWQSDGAQPHSVNIQFQKKVKLQLVVLYVDFKLDESYTPSKISIRAGDGFHNLKDIKTVELDKPRGWIHISLSGNDARETFVNTFMLQISVLSNHLNGRDTHVRQIKLYGPRPNPIPHQPFQFTSREFITYASIR

SEQ ID NO: 11952 - protein, 192 aa, Helianthus annuus
MATESSEGEEETKLTGGTPQLVVDRDLREMAKNAAWSVSSCKPGNGVSSLRDDNYETYWQSDGAQPHLVNIQFQKKVKLQLVALYVDFNLDESYTPSKVSVRAGDGFHNLKEIKTVELVKPNGWMNIPLSGNDPRETFVNTFMLQIAVLSNHLNGRDTHVRQIKVFGPQPNPIPNQPFQFTSTEFITYSTIR

SEQ ID NO: 11953 - protein, 191 aa, Solanum lycopersicum
MADSSEGEEEGKLTGGSQQLVVDDDLREMGKKAAWSVSSYKPGNGVLSLRDDNLETYWQSDGAQPHLVNVQFQKKVKLQLVVLYVDFKLDESYTPGKISIRAGDGFHNLKEIKAVELVKPTGWMHISLSGNDPRETFVNTFMLQIGVLSNHLNGRDTHIRQIKVYGPRPNPIPLQPFQFTSTEFITYSAVR

SEQ ID NO: 11954 - protein, 192 aa, Arabidopsis lyrata
MATESSESEEEGKIRGGNDKLIIDDDLREMGKNAAWSVSSCKPGNGVTTLRDDNLETYWQSDGLQPHLINIQFQKKVKLQLVVLYVDFKLDESYTPSKISIRAGDGFHNLKEIKSVELVKPTGWVCLSLSGTDPRETFVNTFMLQIAILSNHLNGRDTHIRQIKVYGPRPNPIPHQPFQFTSMEFLTYSTLR

SEQ ID NO: 11955 - protein, 171 aa, Lippia dulcis
SEGEEEGKLTGGNPQLVVDDDLREMAKKAAWSVSSCKPGNGVTSLRDDNLDTYWQSDGAQPHLVNIQFQKKVKLQLVVLYVDFKLDESYTPSKISIRAGDGFHNLKEIKTVELVKPTGWVYISLSGTDPRETFVNTFMLQIAVLSNHLNGRDYPPAPNQSLWTSTESHSPT

SEQ ID NO: 11956 - protein, 191 aa, Nicotiana tabacum
  misc_feature (85)..(85): Xaa can be any naturally occurring amino acid
MADSSEGEEEGKLTGGSQQLVVDDDLREMGKKAAWSVSSYKPGNGVLSLRDDNLDTYWQSDGAQPHLVNVQFQKKVKLQLVVLYXDFKLDESYTPGKISIRAGDGFHNLKEIKAVELVKPTGWVYISLSGNDPRETFVNTFMLQIGVLSNHLNGRDTHIRQIKVYGPRPNPIPLQPFQFTSTEFITYSTVR

SEQ ID NO: 11957 - protein, 191 aa, Ipomoea nil
MADSSEGEEEGKLTGGSQQLLVDDDLCEMAKKAAWSVSSCKAGNGITSLRDDNLDTYWQSDGAQPHLVNIQFQKKVKLQLVVLYVDFKLDESYTPSKISIRAGDGFHNLKEIKSVELVKPTGWVYISLSGNDPRETFVNTFMLQVTILSNHLNGRDTHIRQIKVYGPRPNPIPLQPFQFTSTEFITYSIVR

SEQ ID NO: 11958 - protein, 191 aa, Aristolochia fimbriata
MATIESEGEEEGKLVGNQHLVVDNDLQEMAKKAAWSVSSCKQGNGVLALRDDNLDTYWQSDGAQPHLVNIQFQKKVRLHLVVLYVDYKLDESYTPSKISIRAGDGFHNLKEIKSVELVKPVGWVYISLSGTDPRETFINTFMLQLAVLSNHLNGRDTHVRQIKVYGPRPNPIPHQPFQFTSKEFIAYSCVR

SEQ ID NO: 11959 - protein, 192 aa, Beta vulgaris
MATESSEGEDEGKLVGGSKNLDVDGDLREMTKNAAWSVSSCKPGNGVQCLRDDNSETYWQSDGAQPHLINIQFQKKVKLQLIVLYVDFKLDESYTPSKISIRAGDGFHNLKEIKTIELVKPTGWVCISLSGNDPRETFVNTFMLQLAVLSNHLNGRDTHVRQIKVYGPRPNPFPRQPFQFTSAEFLTYSTVR

SEQ ID NO: 11960 - protein, 191 aa, Solanum melongena
MADSSEGAEEGKITGGSQQLVVDDDLREMGKKAAWSVSSYKPGNGVLSLRDDNLDTYWQSDGAQPHLVNVQFQKKVKLQLVVLYADFKLDESYTPGKISIRAGDGFHNLKEIKAVELVKPTGWMHISLSGNDPRETFVNTFMLQIAVLSNHLNGRDTHIRQIKVYGPRPNPIPLQPFQFTSSEFITYSTVR

SEQ ID NO: 11961 - protein, 189 aa, Euphorbia peplus
MASEGEEEGKIVGGNQHLIVDSFLREMGKKAVWSVSSCKPGNAVSSLRDDNLDTFWQSDGAQPHLVNIQFQKKEKLHLVVVYVDFKLDESYTPSKISIRAGDGFHNLKEIKTMELVKPTGWVYLSLSGNDPRETFVNTFMLQIAVLSNHLNGRDTHVRQIKVYGPRPNPFPHQPFQFTSREFITYANVR

SEQ ID NO: 11962 - protein, 191 aa, Silene vulgaris
MATESSDGEEGKLIGGSKHLSVDSDLREMTKNAAWSVSSCKPGNGVQCLRDDNFETYWQSDGAQPHVINIQFQKKVKLQLIVLYVDYKLDESYTPSKISIRAGDGFHNLKEIKTVELVKPTGWIHVSLSGNDPREVFVNTFMLQIAVLSNHLNGRDTHVRQIKVYGPRPNPIPCQPFQFTSSEFVTYSTVR

SEQ ID NO: 11963 - protein, 192 aa, Eutrema parvulum
MATESSESEEEGKIRGGNDKLIVDDDLREMGKNAAWSVSSCKPGNGVNTLRDDNLETYWQSDGLQPHLINIQFQKKVKLQLVVLYVDFKLDESYTPSKISVRAGDGFHNLKEIKSVELVKPSGWVCLSLSGTDPRETFVNTFMLQIAILSNHLNGRDTHIRQIKVYGPRPNPIPRQPFQFTSMEFLTYSTLR

SEQ ID NO: 11964 - protein, 191 aa, Aquilegia formosa
MATESDGEEEGKLIGGNQNLVVDEDLREMAKKASWSVSSCKSGNGVQFLRDDNLETYWQSDGAQPHLVNIQFQKKVKLQLVVLYVDFKLDESYTPSKISVRAGNGFHNLKEIKTVELVKPIGWIYISLSGTDPRDTFINTFMLQIAILSNHLNGRDTHVRQIKIYGPRLNPVPCQPFQFTSQEFIKYSILR

SEQ ID NO: 11965 - protein, 192 aa, Unknown
  Sequence found in Organisms: Brassica napus, Brassica rapa
MATESSESEEEGKIRGGNDKLIVDDDLREMGKNAAWSVSSCKPGNGVNTLRDDNLETYWQSDGLQPHLINIQFQKKVRLQLVALYVDFKLDESYTPSKISVRAGDGFHNLKEVKSVELVKPSGWVSISLSGTDPRETFVNTFMLQIAMLSNHLNGRDTHIRQIKVYGPRPNPIPRQPFQFTSTEFITYSTLR

SEQ ID NO: 11966 - protein, 191 aa, Fragaria vesca
MAESSEGEEEGKLTVGNQVLMVEDNLRETGKNATWSVSSWKSGNGVSYLRDDNLDTYWQSDGAQPHLVNIQFQKKVKLQLVVLYVDFKLDESYTPSKILIRAGDGFHNLKDIKTVELYKPRGWIYISLSGNDARETFVNTFMLQISVLSNHLNGRDTHVRQIKLYGPRLNPIPHQPFQFTSREFSTYASIR

SEQ ID NO: 11967 - protein, 192 aa, Eutrema halophilum
MATESSESEEEGKIRGGNEKLIVEDDLREMGKNAAWSVSSCKPGNGVNTLRDDNLETYWQSDGLQPHLINIQFQKKVKLQLVFLYVDFKLDESYTPSKISIRAGDGFHNLKEIKSVELVKPTGWVCLSLSGTDPRETFVNTFMLQIAILSNHLNGRDTHIRQIKVYGPRPNPIPRQTFQFTSMEFLTYSTLR

SEQ ID NO: 11968 - protein, 193 aa, Antirrhinum majus
MAETPPSDGEEEGKLTGGSLQLVVEGDLREMANKAAWSVSSCKPGNGVASLRDDNLDTYWQSDGAQPHLVNIQFQKKVKLQLVVFYVDFKLDESYTPSKISIRAGDGFHNLKEIKTVELVKPSGWVHISLSGSDPRETFVNTFMLQIAVIANHLNGRDTHVRQIKVYGPRPNPIPHQPFQFTSTEFITYSILR

SEQ ID NO: 11969 - protein, 192 aa, Chenopodium quinoa
MATESSEGEDEGKLVGGSKDLVVDGDLREMTKNAAWSVSSCKPGNGVQCLRDDNFETYWQSDGAQPHMINIQFQKKVKLQLIVLYVDFKLDESYTPSKISIRAGDGFHNMKEIKAVELVKPSGWVYISLSGNDARETFVNTFMLQIAVLSNHLNGRDTHVRQIKVYGPRPNPVPRQPFQFTSAEFLTYSTVR

SEQ ID NO: 11970 - protein, 192 aa, Raphanus sativus
MATESSESEEEGKISGGNEKLIVDEDLREMGKNAAWSVSSCKPGNGVNTLRDDNLETYWQSDGLQPHLINIQFQKKVRLQLVALYVDFKLDESYTPSKISVRAGDGFHNLKEVKSVELVKPSGWVSVSLSGTDPRETFVNTFMLQIAMLSNHLNGRDTHIRQIKVYGPRPNPIPRQPFQFTSTEFLTYSTLR

SEQ ID NO: 11971 - protein, 191 aa, Triphysaria pusilla
MAESSEGEDEGKLTVGHPQLVVEDDLREMAKKAAWSVSSCKPGNGVVSLRDDNLDTYWQSDGAQPHLVNIQFQKKVKLKLVVVYVDFKLDESYTPSKISVRAGDGFHNLKEIKTVELSKPSGWVHISLSGSDPRETFVNTFMLQIMIVSNHLNGRDTHVRQIKVYGPRPNPIPCQPFQFTSNEFITYSTLR

SEQ ID NO: 11972 - protein, 163 aa, Triphysaria pusilla
MAKKAAWSVSSCKPGNGVVSLRDDNLDTYWQSDGAQPHLVNIQFQKKVKLKLVVVYVDFKLDESYTPSKISVRAGDGFHNLKEIKTVELSKPSGWVHISLSGSDPRETFVNTFMLQIMIVSNHLNGRDTHVRQIKVYGPRPNPIPCQPFQFTSNEFITYSTLR

SEQ ID NO: 11973 - protein, 67 aa, Cleome spinosa
MATESSESEEEGKIRGGNDKLIVDEDLREMGKNAAWSVSSCKPGNGVSALRDDNLETYWQRSAATSG

SEQ ID NO: 11974 - protein, 192 aa, Phalaenopsis aphrodite
MATESDGEEETAGKLTGSPNLVVDDDSREMAKKAAWSVSSCKPGNGVLSLRDDNLETYWQSDGAQPHLVNIQFQKKVKLQLLVLYVDYKLDESYTPSKISIRAGDGFHNMKEIKTVELVKPVGWVHISLSGTDPRDTFIHTFMLQLAVLSNHLNGRDTHIRQIKIYGPRPNPIPTLPFHFTSKEFISYSTIR

SEQ ID NO: 11975 - protein, 190 aa, Amborella trichopoda
MATESEGEDEGKLPGILNLVVDDDLREMAKKAAWSVSSCKPGNGVHFLRDDNLETYWQSDGAQPHLVNIQFQRKVKLQLLVLYVDFKLDESYTPSKISVRAGDGFHNLKEIKMVELRKPIGWVSIALSGTDPRETFINTFMLQLAVLSNHLNGRDTHIRQIRVYGPRPNPVPHQPFQFTSKEFTMYSSIR

SEQ ID NO: 11976 - protein, 195 aa, Musa acuminata
MATESDGEEETATAAGKLTGSPQLSVDDDLREMAKKAAWSVSSCKPGNGVLSLRDENLDTYWQSDGAQPHLVNIQFQKKVKLQLVVLYVDFKLDESYTPSKISIRAGDGFHNLKEIKTVELVKPVGWVHISLSGNDPRETFIHTFMLQIAVLSNHLNGRDTHIRQVKIYGPRPNPVPLQPFHFTSKEFITYSILR

SEQ ID NO: 11977 - protein, 192 aa, Elaeis guineensis
MATESDGEEDTAGKLTGSQHLEVDDDLREMAKKAAWSVSSCKPGNGVLALRDDNLDTYWQSDGAQPHLVNIQFQKKVKLQLLVLYVDFKLDESYTPSKISIRAGDGFHNLKEIKTVEFKKPVGWVHIPLSGTDPRETFIHTFMLQLAVLSNHLNGRDTHVRQIKIYGPRPNPVPHQPFHFISKEFITYSTLR

SEQ ID NO: 11978 - protein, 136 aa, Amorphophallus konjac
VPRTRESEGEEEVGRLTGNQHLVVDDDLREMAKKAAWSVSSCKPGNGVLSLRDDNLDTYWQSDGAQPHLVNIQFQKKVKLQLLVLYVDFKLDESYTPSKISIRAGDGFHNLKEIKTVELVKPVGWVYISLSGTDPP

SEQ ID NO: 11979 - protein, 62 aa, Capsicum annuum
MAEPREPGLLLDYLLFFSRILISLRPIGCLWLVCVILGNICIQSYLVSHKPVTNNHVGCINL

SEQ ID NO: 11980 - protein, 181 aa, Phaseolus vulgaris
MASEKKLSNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKSRVGIQHRVTKEDSMKWFQVKYEGVILNKSQAIV

SEQ ID NO: 11981 - protein, 181 aa, Glycine max
MASEKKLSNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKSRVGIQHRVTKEDAMKWFQVKYEGVILNKSQAIV

SEQ ID NO: 11982 - protein, 182 aa, Cajanus cajan
MASEKKLSNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKSRVGIQHRVTKEDAMKWFQVKYEGVILNKSQAIVG

SEQ ID NO: 11983 - protein, 181 aa, Cicer arietinum
MASEKKLSNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKSRVGIQHRVTKDDAMKWFQVKYEGVILNKSQAIV

SEQ ID NO: 11984 - protein, 181 aa, Glycine max
MASEKKLSNPMREIKVQKLVLNISVGESGDRLTRAAKVLEQLSGQAPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKSRVGIQHRVTKEDAMKWFQVKYEGVILNKSQAIV

SEQ ID NO: 11985 - protein, 182 aa, Manihot esculenta
MASEKKLSNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKSRVGIQHRVTKEDAMKWFQVKYEGVILNKSQAIGA

SEQ ID NO: 11986 - protein, 180 aa, Vigna unguiculata
MASEKKLSNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKSRVGIQHRVTKDDAMKWFQVKYEGVILNKSQAI

SEQ ID NO: 11987 - protein, 181 aa, Medicago truncatula
MASEKKLSNPMRDIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKARVGIQHRVTKDDSMKWFQVKYEGVILNKSQAIV

SEQ ID NO: 11988 - protein, 182 aa, Cajanus cajan
MASEKKLSNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKARVGIQHRVTKEDAMKWFQVKYEGVILNKSQAIVG

SEQ ID NO: 11989 - protein, 181 aa, Glycine max
MASEKKLSNPMREIKVQKLVLNISVGESGDRLTRASKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKSRVGIQHRVTKEDAMKWFQVKYEGVILNKSQAIL

SEQ ID NO: 11990 - protein, 181 aa, Trigonella foenum-graecum
MASEKKLSNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKARVGIQHRVTKDDAMKWFQVKYEGVILNKSQAIV

SEQ ID NO: 11991 - protein, 182 aa, Antirrhinum majus
MASEKKLSNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSRVGIQHRVTKEDSMKWFQVKYEGVILNKSNAIGA

SEQ ID NO: 11992 - protein, 182 aa, Antirrhinum majus
  misc_feature (3)..(3): Xaa can be any naturally occurring amino acid
MAXEKKLSNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSRVGIQHRVTKEDSMKWFQVKYEGVILNKSNAIGA

SEQ ID NO: 11993 - protein, 182 aa, Unknown
  Sequence found in Organisms: Citrus clementina, Citrus sinensis
MASEKKLSNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKSRVGIQHRVTKEDAMKWFQVKYEGVILNKSQNIGA

SEQ ID NO: 11994 - protein, 182 aa, Glycyrrhiza uralensis
MASEKKLSNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSRVGIQHRVTKEDAMKWFQVKYEGVILNKSQALVG

SEQ ID NO: 11995 - protein, 182 aa, Medicago truncatula
MALSEKKLSNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKARVGIQHRVTKDDAMKWFQVKYEGVILNKSQAIV

SEQ ID NO: 11996 - protein, 182 aa, Tropaeolum majus
MASEKKLANPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKSRVGIQHRVTKEDSMKWFQVKYEGVILNKSQNIGA

SEQ ID NO: 11997 - protein, 182 aa, Unknown
  Sequence found in Organisms: Prunus persica, Prunus mume
MASEKKLANPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKSRVGIQHRVTKEDAMKWFQVKYEGVILNKSQNIVN

SEQ ID NO: 11998 - protein, 113 aa, Platanus occidentalis
MASEKKLSNPMREIKVQKLVLNISVGESGDRLTRAAKVLEQLSGQTPVFSKARYTVRSFGIRRNEKIACYVTVRGDKAMQLLESGLKVKEYELVEEELRVIPAVFGFGYSGTY

SEQ ID NO: 11999 - protein, 181 aa, Arachis hypogaea
MASEKKLSNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERAGYRVGRRRRCKSRVGIQHRVTKEDAMKWFQVKYEGVILNKAQTIV

SEQ ID NO: 12000 - protein, 181 aa, Cicer arietinum
MASEKKLSNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKARVGIQHRVTKDDAMKWFQVKYEGVILNKSQAIV

SEQ ID NO: 12001 - protein, 180 aa, Vigna unguiculata
MASEKKLSNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKSRVGIQHRVTKDDAMKWFQVKYEGVILNKSQNI

SEQ ID NO: 12002 - protein, 181 aa, Cucurbita pepo
MASEKKLSNPMRDIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKSRVGIQHRVTKEDAMKWFQVKYEGVILNKSQQIV

SEQ ID NO: 12003 - protein, 181 aa, Glycyrrhiza uralensis
MASEKKLSNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKARVGIQHRVTKEDAMKWFQVKYEGVILNKSQNIV

SEQ ID NO: 12004 - protein, 181 aa, Trigonella foenum-graecum
MASEKKLANPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKARVGIQHRVTKDDAMKWFQVKYEGVILNKSQAIV

SEQ ID NO: 12005 - protein, 182 aa, Unknown
  Sequence found in Organisms: Citrus clementina, Citrus sinensis
MASDKKLSNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKSRVGIQHRVTKEDAMKWFQVKYEGVILNKSQNIGA

SEQ ID NO: 12006 - protein, 181 aa, Trifolium pratense
MASEKKLANPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKARIGIQHRVTKDDAMKWFQVKYEGVILNKSQAIV

SEQ ID NO: 12007 - protein, 182 aa, Liriodendron tulipifera
MASEKKLLNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKSRVGIQHRVTKEDAMKWFQVKYEGVILNKSQNITG

SEQ ID NO: 12008 - protein, 182 aa, Plantago ovata
MASEKKLSNPMREIKVQKLVLNISVGESGDRLTRAAKVLEQLSGQTPVFSKARYTVRSFGIRRNEKIACYVTVRGEKAMQLLESGLKVKEYELLRRNFSDTGCFGFGIQEHIDLGIKYDPSTGIYGMDFFVVLERPGYRVGRRRRCKSRVGIQHRVTKEDSMKWFQVKYEGVILNKSSNIGA

SEQ ID NO: 12009 - protein, 182 aa, Platanus occidentalis
MASEKKLSNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSRVGIQHRVTKEDAMKWFQVKYEGVILNKSQNITG

SEQ ID NO: 12010 - protein, 182 aa, Platanus occidentalis
MASEKKLSNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSRVGIQHRVTKEDAMKWFQVKYEGVILNKSQTITG

SEQ ID NO: 12011 - protein, 181 aa, Primula obconica
MASEKKLSNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKARVGIQHRVTKEDSMKWFQVKYEGVILNKAQTIG

SEQ ID NO: 12012 - protein, 181 aa, Fragaria vesca
MASEKKLANPMREIKVQKLVLNISVGESGDRLTRAAKVLEQLSGQTPVFSKARYTVRSFGIRRNEKIACYVTVRGDKAMQLLESGLKVKEYELLRKNFSDTGCFGFGIQEHIDLGIKYDPSTGIYGMDFFVVLERPGYRVGRRRRCKARVGIQHRVTKDDAMKWFQVKYEGVILNKSQAIV

SEQ ID NO: 12013 - protein, 182 aa, Panax ginseng
MASEKKLLNPMREIKVQKLVLNISVGESGDRLTRASKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKSRVGIQHRVTKEDAMKWFQVKYEGVILNKSQNIGG

SEQ ID NO: 12014 - protein, 182 aa, Acacia harpophylla
MASEKKLSNPMREIKVQKLVLNISVGESGDRLTRAAKVLEQLSGQSPVFSKARYTVRSFGIRRNEKIACYVTVRGDKAMQLLESGLKVKEYELLRRNFSETGCFGFGIQEHIDLGIKYDPSTGIYGMDFFVVLERPGYRVGRRRRCKARVSIQHRVTKEDAMKWFQVKYEGVILNKSQAIVG

SEQ ID NO: 12015 - protein, 182 aa, Persea americana
MAAEKKLSNPMREMKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSRVGIQHRVTKEDAMKWFQVKYEGVILNKAQNIGA

SEQ ID NO: 12016 - protein, 182 aa, Unknown
  Sequence found in Organisms: Cannabis sativa, Humulus lupulus
MASEKKLSNPMREIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKSRVGIQHRVTKDDAMKWFQVKYEGVILNKSQNITG

SEQ ID NO: 12017 - protein, 182 aa, Ricinus communis
MASEKKLSNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSRVGIQHRVTKEDAMKWFQVKYEGVILNKAQTIGA

SEQ ID NO: 12018 - protein, 182 aa, Castanea mollissima
MASEKKLSNPMREIKVQKLVLNISVGESGDRLTRAAKVLEQLSGQNPVFSKARYTVRSFGIRRNEKIACYVTVRGEKAMQLLESGLKVKEYELLRRNFSDTGCFGFGIQEHIDLGIKYDPSTGIYGMDFFVVLERPGYRVGRRRRCKSRVGIQHRVTKEDAMKWFQVKYEGVILNKSQNITG

SEQ ID NO: 12019 - protein, 182 aa, Unknown
  Sequence found in Organisms: Gossypium hirsutum, Gossypium raimondii
MASEKKLSNPMREIKVQKLVLNISVGESGDRLTRAAKVLEQLSGQTPVFSKARYTVRSFGIRRNEKIACYVTVRGEKAMQLLESGLKVKEYELLRRNFSDTGCFGFGIQEHIDLGIKYDPSTGIYGMDFYVVLERAGYRVGRRRRCKSRVGIQHRVTKEDSMKWFQVKYEGVILNKSQNIGA

SEQ ID NO: 12020 - protein, 182 aa, Cyamopsis tetragonoloba
MASEKKLSNPMREIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSRVGIQHRVTKEDAMKWFQVKYEGVILNKAQTIVG

SEQ ID NO: 12021 - protein, 182 aa, Eucalyptus grandis
MAAEKKLSNPMREIKVQKLVLNISVGESGDRLTRAAKVLEQLSGQSPVFSKARYTVRSFGIRRNEKIACYVTVRGEKAMQLLESGLKVKEYELLRRNFSDTGCFGFGIQEHIDLGIKYDPSTGIYGMDFYVVLERPGYRVGRRRRCKSRVGIQHRVTKEDAMKWFQVKYEGVILNKSQNITG

SEQ ID NO: 12022 - protein, 182 aa, Fraxinus spp
MASEKKLSNPMREIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKSRVGIQHRVTKEDAMKWFQVKYEGVILNKSSNIAS

SEQ ID NO: 12023 - protein, 182 aa, Actinidia deliciosa
MASEKKLSNPMREIKVQKLVLNISVGESGDRLTRAAKVLEQLSGQTPVFSKARYTVRSFGIRRNEKIACYVTVRGEKAMQLLESGLKVKEYELLRRNFSDTGCFGFGIQEHIDLGIKYDPSTGIYGMDFYVVLERPGYRVGRRRRCKSRVGIQHRVTKEDSMKWFQVKYEGVILNKAQNIGA

SEQ ID NO: 12024 - protein, 182 aa, Momordica charantia
MASEKKLSNPMRDIKVQKLVLNISVGESGDRLTRAAKVLEQLSGQSPVFSKARYTVRSFGIRRNEKIACYVTVRGEKAMQLLESGLKVKEYELLRRNFSDTGCFGFGIQEHIDLGIKYDPSTGIYGMDFFVVLERPGYRVGRRRRCKSRVGIQHRVTKEDAMKWFQVKYEGVILNKSQAITG

SEQ ID NO: 12025 - protein, 182 aa, Momordica charantia
MASEKKLSNPMRDIKVQKLVLNISVGESGDRLTRAAKVLEQLSGQTPVFSKARYTVRSFGIRRNEKIACHVTVRGEKAMQLLESGLKVKEYELLRRNFSDTGCFGFGIQEHIDLGIKYDPSTGIYGMDFFVVLERPGYRVGRRRRCKSRVGIQHRVTKEDSMKWFQVKYEGVILNKSQNITG

SEQ ID NO: 12026 - protein, 182 aa, Mimulus guttatus
MASEKKLSNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSRVGIQHRVTKEDSMKWFQVKYEGVILNKATNIGT

SEQ ID NO: 12027 - protein, 182 aa, Elaeis guineensis
MASEKKLSNPMREIKVQKLVLNISVGESGDRLTRAAKVLEQLSGQTPVFSKARYTVRSFGIRRNEKIACYVTVRGEKAMQLLESGLKVKEYELLRRNFSDTGCFGFGIQEHIDLGIKYDPSTGIYGMDFFVVLERPGYRVGRRRRCKSRVGIQHRVTKEDAMKWFQVKYEGVILNKAQATTQ

SEQ ID NO: 12028 - protein, 182 aa, Citrullus lanatus
MASEKKLSNPMRDIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKSRVGIQHRVTKEDAMKWFQVKYEGVILNKSQQITG

SEQ ID NO: 12029 - protein, 133 aa, Panax ginseng
MASEKKLLNPMREIKVQKLVLNISVGESGDRLTRASKVLEQLSSQTPVFSKARYTVRSFGIRRNEKIACYVTVRGDKAMQLLESGLKVKEYELLRRNFSDTGCFGFGIQEHIDLGIKYDPSTGYLWYGFLCCT

SEQ ID NO: 12030 - protein, 104 aa, Fraxinus spp
MQLLESGLKVKEYELLRRNFSDTGCFGFGIQEHIDLGIKYDPSTGIYGMDFYVVLERPGYRVGRRRRCKSRVGIQHRVTKEDAMKWFQVKYEGVILNKSSNITN

SEQ ID NO: 12031 - protein, 534 aa, Vitis vinifera
MGASSSAIFLPFVSLVVLVSWATSSSIHENFLQCLSLNSNHTTPISNVLYTPKNLSYSAILESTIENLRFSSSATPKPLLILTPLHVSHIQAAVICSKKYGMNIRVRSGGHDYEGLSYVSEIPFIIIDLVELRSINISIEDGTAWVEAGATVGEVYYRIAQKSRTYGFPAGSCPTVGVGGHFSGGGYGTLMRKYGLSADNIIDAYIVVSDGRVLNRESMGEDLFWAIRGGGGASFGIILSWKIKLVPVPPIVTVFTVGRTLEQGALKVFLKWQQVGSRLQEDIFIGATFGAVSGSQEGERTIEVSFKSLFLGNTSQLLSLMKKSFPELGLEAKDCLEMSWIESVLYYTDLSGEPVNVLLNRIPQFKNYFKAKSDYVQEPISETGLQGVWKMLYQEEAGIMILSPYGGRMNEISETEVPFPHRKGNLYKIQYLVSWDEEGDRVSQKRINWIRKLYAYMAPYVSKFPRAAYLNYRDLDLGINKLKGNTSYAQASIWGIKYFSCNFNRLVHVKTKVDPSNFFRNEQSIPSLSPWWKN

SEQ ID NO: 12032 - protein, 181 aa, Arachis hypogaea
MASEKKLANPMREIKVQKLVLNISVGESGDRLTRAAKVLEQLSGQTPVFSKARYTVRSFGIRRNEKIACYVTVRGDKAMQLLESGLKVKEYELLRRNFSETGCFGFGIQEHIDLGIKYDPSTGIYGMDFFVVLERPGYRVGRRRRQKSRVGIQHRVTKEDAMKWFQVKYEGVILNKSQQIS

SEQ ID NO: 12033 - protein, 181 aa, Tripterygium wilfordii
MASEKKLSNPMREIKVQKLVLNISVGESGDRLTRAAKVLEQLSGQTPVYSKARYTVRSFGIRRNEKIACYVTVRGEKAMQLLESGLKVKEYELLRRNFSDTGCFGFGIQEHIDLGIKYDPSTGIYGMDFYVVLERPGYRVGRRRRCKSRVGIQHRVTKEDAMKWFQVKYEGVILNKSQNIA

SEQ ID NO: 12034 - protein, 181 aa, Citrullus lanatus
MASEKKLSNPMRDIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKSSVGIQHRVTKEDAMKWFQVKYEGVILNKSQNIS

SEQ ID NO: 12035 - protein, 182 aa, Panax ginseng
MASEKKLLNPMREIKVQKLVLNISVGESGDRLTRASKVLEQLSSQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKSRVGIQHRVTKEDAMKWFQVKYEGVILNKSQNIGG

SEQ ID NO: 12036 - protein, 182 aa, Panax ginseng
MASEKKLLNPMREIKVQKLVLNISVGESGDRLTRASKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSRVGIQHRVTKEDAMKWFQVKYEGVILNKSQNIGG

SEQ ID NO: 12037 - protein, 182 aa, Arachis hypogaea
MASEKKLANPMREIKVQKLVLNISVGESGDRLTRASKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERAGYRVGRRRRRKSRVGIQHRVTKEDAMKWFQVKYEGVILNKSQQIVS

SEQ ID NO: 12038 - protein, 181 aa, Arachis hypogaea
MASEKKLANPMREIKVQKLVLNISVGESGDRLTRAAKVLEQLSGQTPVFSKARYTVRSFGIRRNEKIACYVTVRGDKAMQLLESGLKVKEYELLRRNFSETGCFGFGIQEHIDLGIKYDPSTGIYGMDFFIVLERPGYRVGRRRRQKSRVGIQHRVTKEDAMKWFQVKYEGVILNKSQQIS

SEQ ID NO: 12039 - protein, 180 aa, Abies balsamea
MAAEKKLSNPMREIKVQKLVLNISVGESGDRLTRASKVLEQLSGQTPVFSKARYTVRSFGIRRNEKIACYVTVRGEKALQLLESGLKVKEYELLRRNFSDTGCFGFGIQEHIDLGIKYDPSTGIYGMDFFVVLERPGYRVGRRKRAQSRVGIQHRVTKEDSMKWFQVKYEGVILNKSQNI

SEQ ID NO: 12040 - protein, 181 aa, Amorphophallus konjac
MASEKKLSNPMREIKVQKLVLNICVGESGDRLTRAAKVLEQLSGQTPVFSKARYTVRSFGIRRNEKIACYVTVRGEKAMQLLESGLKVKEYELLRRNFSETGCFGFGIQEHIDLGIKYDPSTGIYGMDFFVVLERPGYRVGRRRRCKSRVGIQHRVTKEDAMKWFQVKYEGVILNKAQAGG

SEQ ID NO: 12041 - protein, 182 aa, Amsonia hubrichtii
MASEKKLSNPMREIKVQKLVLNISVGESGDRLTRAAKVLEQLSGQTPVFSKARYTVRSFGIRRNEKIACYVTVRGDKAMQLLESGLKVKEYELLRRNFSQTGCFGFGIQEHIDLGIKYDPSTGIYGMDFFVVLERPGYRVARRRRCKARVGIQHRVTKEDAMKWFQVKYEGVILNKSQTIAS

SEQ ID NO: 12042 - protein, 182 aa, Aquilegia formosa
MASEKKLSNPMRDIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSRVGIQHRVTKDDSMKWFQVKYEGVILNKSQNITG

SEQ ID NO: 12043 - protein, 180 aa, Aristolochia fimbriata
MGSEKKLSNPMREIKVQKLVLNISVGESGDRLTRAAKVLEQLSGQTPVYSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKSRVGIQHRVTKDDAMKWFQVKYEGVILNKSQST

SEQ ID NO: 12044 - protein, 182 aa, Persea americana
MASEKKLSNPMREIKVQKLVLNISVGESGDRLTRAAKVLDQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSRVGIQHRVTKEDAMKWFQVKYEGVILNKAQNIGA

SEQ ID NO: 12045 - protein, 182 aa, Musa acuminata
MASEKKLSNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERAGYRVARRRRCKSRVGIQHRVTKEDAMKWFQVKYEGVILNKSQTTTG

SEQ ID NO: 12046 - protein, 182 aa, Musa acuminata
MASEKKLSNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERAGYRVSRRRRCKSRVGIQHRVTKEDAMKWFQVKYEGVILNKSQTTTG

SEQ ID NO: 12047 - protein, 182 aa, Fagus grandifolia
MASEKKLSNPMREIKVQKLVLNISVGESGDRLTRAAKVLEQLSGQNPVFSKARYTVRSFGIRRNEKIACYVTVRGEKAMQLLESGLKVKEYELLRRNFSDTGCFGFGIQEHIDLGIKYDPSTGIYGMDFFVVLERPGYRVGRRRRCKSRVGIQHRVTKEDSMKWFQMKYEGVILNKSQSNTA

SEQ ID NO: 12048 - protein, 182 aa, Ricinus communis
MASEKKLSNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSRVGIQHRVTKDDAMKWFQVKYEGVILNKAQNIGS

SEQ ID NO: 12049 - protein, 181 aa, Unknown
  Sequence found in Organisms: Castanea mollissima, Quercus alba
MASEKKLSNPMREIKVQKLVLNISVGESGDRLTRAAKVLEQLSGQNPVFSKARYTVRSFGIRRNEKIACYVTVRGEKAMQLLESGLKVKEYELLRRNFSDTGCFGFGIQEHIDLGIKYDPSTGIYGMDFFVVLERAGYRVGRRRRCKSRVGIQHRVTKEDAMKWFQMKYEGVILNKSQNIS

SEQ ID NO: 12050 - protein, 182 aa, Cirsium arvense
MASERKQSNPMREIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKARVGIQHRVTKEDSMKWFQVKYEGVILNKSQQIGA

SEQ ID NO: 12051 - protein, 182 aa, Unknown
  Sequence found in Organisms: Gossypium hirsutum, Gossypium raimondii
MASEKKLSNPMREIKVQKLVLNISVGESGDRLTRAAKVLEQLSGQTPVFSKARYTVRSFGIRRNEKIACYVTVRGEKAMQLLESGLKVKEYELLRRNFSDTGCFGFGIQEHIDLGIKYDPSTGIYGMDFYVVLERAGYRVGRRRRCKSRVGIQHRVTKEDAMKWFQVKYEGVILNKSQNIGA

SEQ ID NO: 12052 - protein, 182 aa, Unknown
  Sequence found in Organisms: Cucumis sativus, Cucumis melo
MASEKKLSNPMRDIKVQKLVLNISVGESGDRLTRAAKVLEQLSGQSPVFSKARYTVRSFGIRRNEKIACYVTVRGEKAMQLLESGLKVKEYELLRRNFSDTGCFGFGIQEHIDLGIKYDPSTGIYGMDFFVVLERPGYRVGRRRRCKSRVGIQHRVTKEDAMKWFQVKYEGVILNKSQQITG

SEQ ID NO: 12053 - protein, 181 aa, Unknown
  Sequence found in Organisms: Cucumis sativus, Cucumis melo
MASEKKLSNPMRDIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSTVGIQHRVTKEDAMKWFQVKYEGVILNKSQNIS

SEQ ID NO: 12054 - protein, 181 aa, Cucurbita pepo
MASEKKLSNPMRDIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSSVGIQHRVTKEDAMKWFQVKYEGVILNKSQNIS

SEQ ID NO: 12055 - protein, 182 aa, Cyamopsis tetragonoloba
MASEKKLANPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKARVGIQHRVTKEDAMKWFQVKYEGVILNKAQTIVG

SEQ ID NO: 12056 - protein, 182 aa, Eschscholzia californica
MASDKKLSNPMRDIKVQKLVLNISVGESGDRLTRAAKVLEQLSGQTPVFSKARYTVRSFGIRRNEKIACYVTVRGEKAMQLLESGLKVKEYELLRRNFSDTGCFGFGIQEHIDLGIKYDPSTGIYGMDFYVVLERPGYRVGRRRRCKSRVGIQHRVTKEDSMKWFQVKYEGVILNKSQNITG

SEQ ID NO: 12057 - protein, 182 aa, Unknown
  Sequence found in Organisms: Euonymus alatus, Tripterygium wilfordii
MASEKKLSNPMREIKVQKLVLNISVGESGDRLTRAAKVLEQLSGQTPVYSKARYTVRSFGIRRNEKIACYVTVRGEKAMQLLESGLKVKEYELLRRNFSDTGCFGFGIQEHIDLGIKYDPSTGIYGMDFYVVLERPGYRVGRRRRCKSRVGIQHRVTKEDAMKWFQVKYEGVILNKSQNIGA

SEQ ID NO: 12058 - protein, 179 aa, Euonymus alatus
MASEKKLSNPMREIKVQKLVLNISVGESGDRLTRAAKVLEQLSGQTPVYSKARYTVRSFGIRRNEKIACYVTVRGEKAMQLLESGLKVKEYELLRRNFSDTGCFGFGIQEHIDLGIKYDPSTGIYGMDFYVVLERPGYRVGRRRRCKSRVGIQHRVTKEDAMKWFQVKYEGVILNKSQN

SEQ ID NO: 12059 - protein, 182 aa, Fraxinus spp
MASEKKLSNPMREIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSRVGIQHRVTKEDAMKWFQVKYEGVILNKSSNITN

SEQ ID NO: 12060 - protein, 182 aa, Jatropha curcas
MASEKKLSNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSKVGIQHRVTKEDAMKWFQVKYEGVILNKAQNITS

SEQ ID NO: 12061 - protein, 181 aa, Liriodendron tulipifera
  misc_feature (146)..(146): Xaa can be any naturally occurring amino acid
MASEKKLLNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRXKSRVGIQHRVVKEDAMKWFQVKYEGVILNKSQNIA

SEQ ID NO: 12062 - protein, 181 aa, Lotus japonicus
MASEKKLANPMREIKVQKLVLNISVGESGDRLTRAAKVLEQLSGQTPVFSKARYTVRSFGIRRNEKIACYVTVRGDKAMQLLESGLKVKEYELLRKNFSDTGCFGFGIQEHIDLGIKYDPSTGIYGMDFFVVLERPGYRVGRRRRCKSRVGIQHRVTKDDAMKWFQVKYEGVILNKAQAVF

SEQ ID NO: 12063 - protein, 181 aa, Medicago truncatula
MASDKKLANPMRDMKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKARVGIQHRVTKDDAMKWFQVKYEGVILNKSQAIV

SEQ ID NO: 12064 - protein, 182 aa, Quercus alba
MASEKKLSNPMREIKVQKLVLNISVGESGDRLTRAAKVLEQLSGQNPVFSKARYTVRSFGIRRNEKIACYVTVRGEKAMQLLESGLKVKEYELLRRNFSDTGCFGFGIQEHIDLGIKYDPSTGIYGMDFFVVLERPGYRVGRRRRCKSRVGIQHRVTKDDAMKWFQVKYEGVILNKSQNITG

SEQ ID NO: 12065 - protein, 183 aa, Carica papaya
MASEKKLSNPMREIKVQKLVLNISVGESGDRLTRAAKVLEQLSGQTPVFSKARYTVRSFGIRRNEKIACYVTVRGEKAMQLLESGLKVKEYELLRRNFSDTGCFGFGIQEHIDLGIKYDPSTGIYGMDFYVVLERPGYRVGRRRRCKSRVGIQHRVTKEDAMKWFQVKYEGVILNKSQTIAGS

SEQ ID NO: 12066 - protein, 180 aa, Populus trichocarpa
MASEKKLSNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSRVGIHQRVTKDDAMKWFQVKYEGVILNKSQNI

SEQ ID NO: 12067 - protein, 181 aa, Rosa hybrid cultivar
MASEKKLANPMREIKVQKLVLNISVGESGDRLTRAAKVLEQLSGQTPVFSKARYTVRSFGIRRNEKIACYVTVRGDKAMSLLESGLKVKEYELLRKNFSDTGCFGFGIQEHIDLGIKYDPSTGIYGMDFYVVLERPGYRVGRRRRCKARVGIQHRVTKDDAMKWFQVKYEGVILNKSQAIV

SEQ ID NO: 12068 - protein, 181 aa, Salvia sclarea
MASEKKLSNPMREIKVQKLVLNISVGESGDRLTRAAKVLEQLSGQTPVFSKARYTVRSFGIRRNEKIACYVTVRGDKAMQLLESGLKVKEYELLRRNFSETGCFGFGIQEHIDLGIKYDPSTGIYGMDFYVVLERPGYRVGRRRRCKARVGIQHRVTKEDSMKWFQVKYEGVILNKASNIA

SEQ ID NO: 12069 - protein, 182 aa, Sarracenia psittacina
MASEKKLSNPMREIKVQKLVLNISVGESGDRLTRAAKVLEQLSGQTPVFSKARYTVRSFGIRRNEKIACYVTVRGEKAMQLLESGLKVKEYELLRKNFSDTGCFGFGIQEHIDLGIKYDPSTGIYGMDFFVVLERPGYRVGRRRRCKSRVGIQHRVTKDDAMKWFQVKYEGVILNKSQNIGG

SEQ ID NO: 12070 - protein, 183 aa, Sarracenia psittacina
MAAEKKLSNPMREIKVQKLVLNISVGESGDRLTRAAKVLEQLSGQTPVFSKARYTVRSFGIRRNEKIACYVTVRGEKAMQLLESGLKVKEYELLRRNFSDTGCFGFGIQEHIDLGIKYDPSTGIYGMDFYVILERPGYRVGRRRRCKSRVGIQHRVTKDDAMKWFQVKYEGVILNKSQAIGAS

SEQ ID NO: 12071 - protein, 181 aa, Tripterygium wilfordii
MASEKKLSNPMREIKVQKLVLNISVGESGDRLTRAAKVLEQLSGQTPVYSKARYTVRSFGIRRNEKIACYVTVRGEKAMQLLESGLKVKEYELLRRNFSDTGCFGFGIQEHIDLGIKYDPSTGIYGMDFYVVLERPGYRVGRRRRCKSRVGIQHRVTKDDAMKWFQVKYEGVILNKSQNIA

SEQ ID NO: 12072 - protein, 400 aa, Musa acuminata
MAEPHSGGESRAASINPSTQEIGGTQQMNPRRLKGHKAAATCCVASRLRPGVIASSGEDGCICLFDLRCKDVLFTIDVGEEPVSSLCFKTGNDDILYASSGTKVSCFDIQMASSWKPLETYSYNKDEINQISFSTKSNFLAAADDSGEVKIIDSCQQSLYRTLRMVHTSICSCVQFVPWKPWTAITGGLDLKLAIWDFSKGRPHNVIDYGMAEPDSNITNGNAGQCFNPAFVHSIAVPEVDMLPGLNKVCAAARGDGVIDVIDLEVELANTKSKSSSIAKGSQPRSRKADAQSAKTMGQVLRKRTRLDYSLGGHTAGVSCVSFSLFGERGKFLISGGNDASVKLWDWSKCSYPEQASCSTHLSLTVNMNRKVNWLCTTPTDSENLVVCDTSKILKIYTVA

SEQ ID NO: 12073 - protein, 112 aa, Momordica charantia
MASEKKLSNPMRDIKVQKLVLNISVGESGDRLTRAAKVLEQLSGQSPVFSKARYTVRSFGIRRNEKIACYVTVRGDKAMQLLESGLKVKEYELLRRNFSDTGCFGFWNSGAH

SEQ ID NO: 12074 - protein, 182 aa, Theobroma cacao
MASEKKLSNPMREIKVQKLVLNISVGESGDRLTRAAKVLEQLSGQSPVFSKARYTVRSFGIRRNEKIACYVTVRGEKAMQLLESGLKVKEYELLRRNFSDTGCFGFGIQEHIDLGIKYDPSTGIYGMDFYVVLERAGYRVGRRRRCKSRVGIQHRVTKEDAMKWFQVKYEGVILNKSQNIGA

SEQ ID NO: 12075 - protein, 182 aa, Theobroma cacao
MASEQKLSNPMREIKVQKLVLNISVGESGDRLTRAAKVLEQLSGQTPVFSKARYTVRSFGIRRNEKIACYVTVRGEKAMQLLESGLKVKEYELLRRNFSDTGCFGFGIQEHIDLGIKYDPSTGIYGMDFYVVLERAGYRVGRRRRCKSRVGIQHRVTKEDAMKWFQVKYEGVILNKSQNIGS

SEQ ID NO: 12076 - protein, 182 aa, Centaurea maculosa
MASEKKLANPMREIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKARVGIQHRVTKDDAMKWFQVKYEGVILNKSQQIGA

SEQ ID NO: 12077 - protein, 183 aa, Vitis vinifera
MASEKKLSNPMRDIKVQKLVLNISVGESGDRLTRAAKVLEQLSGQTPVFSKARYTVRSFGIRRNEKIACYVTVRGEKAMQLLESGLKVKEYELLRRNFSDTGCFGFGIQEHIDLGIKYDPSTGIYGMDFFVVLERPGYRVGRRRRCKSRVGIQHRVTKDDSMKWFQVKYEGVILNKAQTIAGS

SEQ ID NO: 12078 - protein, 183 aa, Amsonia hubrichtii
MASEKKLNNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVARRRRCKARVGIQHRVTKEDAMKWFQVKYEGVILNKSQNIQTA

SEQ ID NO: 12079 - protein, 182 aa, Amsonia hubrichtii
MASEKKLSNPMREIKVQKLVLNISVGESGDRLTRAAKVLEQLSGQTPVFSKARYTVRSFGIRRNEKIACYVTVRGDKAMQLLESGLKVKEYELLRRNFSQTGCFGFGIQEHIDLGIKYDPSTGIYGMDFFVVLERPGYRVARRRRCKARVGIQHRVTKDDAMKWFQVKYEGVILNKSQTIAS

SEQ ID NO: 12080 - protein, 182 aa, Amsonia hubrichtii
MASEKKLNNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVARRRRCKARVGIQHRVTKEDAMKWFQVKYEGVILNKSQNITA

SEQ ID NO: 12081 - protein, 182 aa, Musa acuminata
MASEKKLSNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERAGYRVARRRRCKSRVGIQHRVTKDDAMKWFQVKYEGVILNKSQTTTG

SEQ ID NO: 12082 - protein, 182 aa, Fagus grandifolia
MASEKKLSNPMREIKVQKLVLNISVGESGDRLTRAAKVLEQLSGQNPVFSKARYTVRSFGIRRNEKIACYVTVRGEKAMQLLESGLKVKEYELLRRNFSDTGCFGFGIQEHIDLGIKYDPSTGIYGMDFFVVLERPGYRVGRRRRCKSRVGIQHRVTKDDAMKWFQVKYEGVILNKSQNTTS

SEQ ID NO: 12083 - protein, 182 aa, Unknown
  Sequence found in Organisms: Centaurea maculosa, Cirsium arvense
MASEKKLANPMREIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKARVGIQHRVTKDDAMKWFQVKYEGVILNKSQQIGG

SEQ ID NO: 12084 - protein, 182 aa, Eucalyptus grandis
MASEKKLSNPMREIKVQKLVLNISVGESGDRLTRAAKVLEQLSGQSPVFSKARYTVRSFGIRRNEKIACYVTVRGEKAMQLLESGLKVKEYELLRRNFSDTGCFGFGIQEHIDLGIKYDPSTGIYGMDFYVVLERPGYRVGRRRRCKSRVGIRHRVTKEDAMKWFQVKYEGVILNKSQNITG

SEQ ID NO: 12085 - protein, 182 aa, Euonymus alatus
MASEKKLSNPMREIKVQKLVLNISVGESGDRLTRAAKVLEQLSGQTPVYSKARYTVRSFGIRRNEKIACYVTVRGEKAMQLLESGLKVKEYELLRRNFSDTGCFGFGIQEHIDLGIKYDPSTGIYGMDFYVVLERPGYRVGRRRRCKSRVGIQHRVTKDDAMKWFQVKYEGVILNKSQNIGA

SEQ ID NO: 12086 - protein, 182 aa, Euonymus alatus
MASEKKLSNPMREIRVQKLVLNISVGESGDRLTRAAKVLEQLSGQSPVFSKARYTVRSFGIRRNEKIACYVTVRGEKAMQLLESGLKVKEYELLRRNFSDTGCFGFGIQEHIDLGIKYDPSTGIYGMDFYVVLERPGYRVGRRHRCKSRVGIQHRVTKEDSMKWFQVKYEGVILNKSNAITN

SEQ ID NO: 12087 - protein, 182 aa, Zea mays
MASEKKQSNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERAGYRVARRRRCKSRVGIQHRVTKEDSMKWFQVKYEGVILNKAQASTI

SEQ ID NO: 12088 - protein, 182 aa, Zea mays
MAHEKKLSNPMREIKVQKLVLNISVGESGDRLTRAAKVLEQLSGQTPVFSKARYTVRSFGIRRNEKIACYVTVRGEKAMQLLESGLKVKEYELLRRNFSDTGCFGFGIQEHIDLGIKYDPSTGIYGMDFYVVLERAGYRVARRRRCKSRVGIQHRVTKEDSMKWFQVKYEGVILNKAQANTL

SEQ ID NO: 12089 - protein, 182 aa, Mimulus guttatus
MAAEKKLSNPMREIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSRVGIQHRVTKDDAMKWFQVKYEGVILNKATNIGT

SEQ ID NO: 12090 - protein, 182 aa, Elaeis guineensis
MASEKKMSNPMREIKVQKLVLNISVGESGDRLTRAAKVLEQLSGQTPVFSKARYTVRSFGIRRNEKIACYVTVRGEKAMQLLESGLKVKEYELLRRNFSDTGCFGFGIQEHIDLGIKYDPSTGIYGMDFYVVLERPGYRVGRRRRCKSRVGIQHRVTKEDAMKWFQVKYEGVILNKAQATTG

SEQ ID NO: 12091 - protein, 182 aa, Olea europaea
MASEKKLSNPMREIKVQKLVLNISVGESGDRLTRAAKVLEQLSSQSPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSRVGIQHRVTKEDAMKWFQVKYEGVILNKSSNITN

SEQ ID NO: 12092 - protein, 182 aa, Olea europaea
MASEKKLSNPMREIKVQKLVLNISVGESGDRLTRAAKVLEQLSGQSPVFSKARYTVRSFGIRRNEKIACYVTVRGDKAMQLLESGLKVKEYELLRRNFSETGCFGFGIQEHIDLGIKYDPSTGIYGMDFYVVLERPGYRVGRRRRCKSRVGIQHRVTKEDAMKWFQVKYEGVILNKSSNIAS

SEQ ID NO: 12093 - protein, 182 aa, Orobanche aegyptiaca
MASEKKLSNPMREIKVQKLVLNISVGESGDRLTRASKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSRVGIQHRVTKEDAMKWFQVKYEGVILNKASNIGA

SEQ ID NO: 12094 - protein, 182 aa, Plantago ovata
MASDRKLANPMREIKVQKLVLNISVGESGDRLTRAAKVLEQLSGQTPVFSKARYTVRSFGIRRNEKIACYVTVRGEKAMQLLESGLKVKEYELLRRNFSDTGCFGFGIQEHIDLGIKYDPSTGIYGMDFFVVLERPGYRVGRRRRCKSRVGIQHRVTKEDSMKWFQVKYEGVILNKSSNIGA

SEQ ID NO: 12095 - protein, 183 aa, Unknown
  Sequence found in Organisms: Prunus persica, Prunus mume
MASEKKLANPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKSRVGIQHRVTKDDAMKWFQVKYEGVILNKSQQLSAS

SEQ ID NO: 12096 - protein, 182 aa, Scabiosa columbaria
MASERKLSNPMREIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKARVGIQHRVTKDDAMKWFQVKYEGVILNKSQNITG

SEQ ID NO: 12097 - protein, 182 aa, Citrullus lanatus
MASEKKLSNPMRDIKVQKLVLNISVGESGDRLTRAAKVLEQLSGQSPVFSKARYTVRSFGIRRNEKIACYVTVRGEKAMQLLESGLKVKEYELLRRNFSDTGCFGFGIQEHIDLGIKYDPSTGIYGMDFFVVLERPGYRVGRRRRCKSSVGIQHRVTKEDAMKWFQVKYEGVILNKSQNITG

SEQ ID NO: 12098 - protein, 70 aa, Cynara scolymus
MASERKPSNPMREIKVQKLVLNISVGESGDRLTRAAKVLEQLSGQSPVFSKARYTVRSFGIRRMRRSHAM

SEQ ID NO: 12099 - protein, 63 aa, Lippia dulcis
MASEKKLSNPMREIKVQKLVLNISVGESGDRLTRAAKVLEQLSGQSPVFSKARYTVRFIWDSA

SEQ ID NO: 12100 - protein, 180 aa, Cedrus atlantica
MAAEKKLSNPMREIKVQKLVLNISVGESGDRLTRASKVLEQLSGQTPVFSKARYTVRSFGIRRNEKIACYVTVRGEKALQLLESGLKVKEYELLRRNFSDTGCFGFGIQEHIDLGIKYDPSTGIYGMDFFVVLERPGYRVGRRKRAQSRVGIQHRVTKDDSMKWFQVKYEGVILNKSQNI

SEQ ID NO: 12101 - protein, 181 aa, Cucurbita pepo
MASEKKLSNPMRDIKVQKLVLNISVGESGDRLTRASKVLEQLSGQSPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSTVGIQHRVTKEDAMKWFQVKYEGVILNKSQNIS

SEQ ID NO: 12102 - protein, 181 aa, Carpinus betulus
MASERKLSNPMREIKVQKLVLNISVGESGDRLTRASKVLEQLSGQTPVFSKARYTVRSFGIRRNEKIACYVTVRGEKAMQLLESGLKVKEYELLRRNFSDTGCFGFGIQEHIDLGIKYDPSTGIYGMDFYVVLERPGYRVGRRRRCKARVGIQHRVTKEDAMKWFQVKYEGVILNKSQNIS

SEQ ID NO: 12103 - protein, 180 aa, Ipomoea batatas
MASEKKLNNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVARRRRCKARVGIQHRVTKEDAMKWFQVKYEGVILNKASNI

SEQ ID NO: 12104 - protein, 181 aa, Lotus japonicus
MASEKKLANPMREIKVQKLVLNISVGESGDRLTRAAKVLEQLSGQTPVFSKARYTVRSFGIRRNEKIACYVTVRGDKAMQLLESGLKVKEYELLRKNFSDTGCFGFGIQEHIDLGIKYDPSTGIYGMDFYVVLERPGYRVGRRRRCKSRVGIQHRVTKDDAMKWFQVKYEGVILNKAQAVF

SEQ ID NO: 12105 - protein, 180 aa, Olea europaea
MASEKKLSNPMREIKVQKLVLNISVGESGDRLTRAAKVLEQLSSQSPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSRVGIQHRVTKEDAMKWFQVKYEGVILNKSSNT

SEQ ID NO: 12106 - protein, 181 aa, Nicotiana tabacum
MASEKKLSNPMREIKVQKLVLNISVGESGDRLTRAAKVLEQLSGQSPVFSKARYTVRSFGIRRNEKIACYVTVRGDKAMQLLESGLKVKEYELLRRNFSETGCFGFGIQEHIDLGIKYDPSTGIYGMDFYVVLERPGYRVARRRRCKSRVGIQHRVTKEDAMKWFQVKYEGVILNKSSNIQ

SEQ ID NO: 12107 - protein, 171 aa, Phaseolus vulgaris
MREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKSRVGIQHRVTKEDSMKWFQVKYEGVILNKSQAIV

SEQ ID NO: 12108 - protein, 182 aa, Unknown
  Sequence found in Organisms: Ambrosia trifida, Arnica chamissonis, Artemisia annua, Echinacea purpurea, Flaveria ramosissima, Guizotia abyssinica, Parthenium argentatum, Helianthus annuus
MASERKQANPMREIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKARVGIQHRVTKEDAMKWFQVKYEGVILNKSQQIGA

SEQ ID NO: 12109 - protein, 182 aa, Panax ginseng
MASEKKLLNPMREIKVQKLVLNISVGESGDRLTRASKVLEQLSGQSPVFPKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSRVGIQHRVTKEDAMKWFQVKYEGVILNKSQNIGG

SEQ ID NO: 12110 - protein, 182 aa, Aristolochia fimbriata
MASEKKLSNPMREIKVQKLVLNISVGESGDRLTRAAKVLEQLSGQTPVYSKARYTVRSFGIRRNEKIACYVTVRGDKAMQLLESGLKVKEYELLRKNFSDTGCFGFGIQEHIDLGIKYDPSTGIYGMDFYIVLERPGYRVGRRRRCKSRVGIRHRVTKEDAMKWFQVKYEGVILNKSQALTG

SEQ ID NO: 12111 - protein, 182 aa, Vaccinium corymbosum
MASEKKLSNPMREIKVQKLVLNISVGESGDRLTRASKVLEQLSGQTPVFSKARYTVRSFGIRRNEKIACYVTVRGEKAMQLLESGLKVKEYELLRRNFSDTGCFGFGIQEHIDLGIKYDPSTGIYGMDFYVVLERPGYRVGRRRRCKARVGIQHRVTKDDAMKWFQVKYEGVILNKSQNITG

SEQ ID NO: 12112 - protein, 182 aa, Vaccinium corymbosum
MASEKKLSNPMREIKVQKLVLNISVGESGDRLTRASKVLEQLSGQTPVFSKARYTVRSFGIRRNEKIACYVTVRGEKAMQLLESGLKVKEYELLRRNFSDTGCFGFGIQEHIDLGIKYDPSTGIYGMDFYVVLERPGYRVGRRRRCKARVGIQHRVTKDDAMKWFQVKYEGVILNKSQNIGA

SEQ ID NO: 12113 - protein, 182 aa, Unknown
  Sequence found in Organisms: Cleome gynandra, Cleome spinosa
MASEKKLSNPMRDIKVQKLVLNISVGESGDRLTRAAKVLEQLSGQTPVFSKARYTVRSFGIRRNEKIACYVTVRGEKAMQLLESGLKVKEYELLRRNFSDTGCFGFGIQEHIDLGIKYDPSTGIYGMDFYVVLERPGYRVARRRRCKARVGIQHRVTKEDAMKWFQVKYEGVILNKSQNITG

SEQ ID NO: 12114 - protein, 182 aa, Unknown
  Sequence found in Organisms: Cucumis sativus, Cucumis melo
MASEKKLSNPMRDIKVQKLVLNISVGESGDRLTRAAKVLEQLSGQSPVFSKARYTVRSFGIRRNEKIACYVTVRGEKAMQLLESGLKVKEYELLRRNFSDTGCFGFGIQEHIDLGIKYDPSTGIYGMDFYVVLERPGYRVGRRRRCKSSVGIQHRVTKEDAMKWFQVKYEGVILNKSQNITG

SEQ ID NO: 12115 - protein, 182 aa, Taraxacum officinale
MASERKLANPMREIKVQKLVLNISVGESGDRLTRAAKVLEQLSGQAPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKARVGIQHRVTKDDAMKWFQVKYEGVILNKSQQIGN

SEQ ID NO: 12116 - protein, 182 aa, Eschscholzia californica
MAAEKKLLNPMRDIKVQKLVLNISVGESGDRLTRAAKVLEQLSGQSPVFSKARYTVRSFGIRRNEKIACYVTVRGEKAMQLLESGLKVKEYELLRRNFSDTGCFGFGIQEHIDLGIKYDPSTGIYGMDFYVVLERPGYRVGRRRRCKSRVGIQHRVTKDDAMKWFQVKYEGVILNKSQNITG

SEQ ID NO: 12117 - protein, 182 aa, Eucalyptus grandis
MASEKKLSNPMREIKVQKLVLNISVGESGDRLTRAAKVLEQLSGQSPVFSKARYTVRSFGIRRNEKIACYVTVRGEKAMQLLESGLKVKEYELLRRNFSDTGCFGFGIQEHIDLGIKYDPSTGIYGMDFYIVLERPGYRVGRRRRCKARVGIQHRVTKEDAMKWFQVKYEGVILNKSQNITG

SEQ ID NO: 12118 - protein, 182 aa, Euonymus alatus
MASEKKLANPMREIKVQKLVLNISVGESGDRLTRAAKVLEQLSGQTPVYSKARYTVRSFGIRRNKKIACYVTVRGEKAMQLLESGLKVKEYELLRRNFSDTGCFGFGIQEHIDLGIKYDPSTGIYGMDFYVVLERPGYRVGRRRRCKSRVGIQHRVTKEDAMKWFQVKYEGVILNKSQNIGA

SEQ ID NO: 12119 - protein, 182 aa, Unknown
  Sequence found in Organisms: Euphorbia peplus, Euphorbia esula
MASERKLSNPMREIKVQKLVLNISVGESGDRLTRASKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKSRVGIHQRVTKEDAMKWFQVKYEGVILNKAQNIGA

SEQ ID NO: 12120 - protein, 182 aa, Euphorbia peplus
MASERKLSNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSRVGIHQRVTKEDAMKWFQVKYEGVILNKAQNIGA

SEQ ID NO: 12121 - protein, 182 aa, Fraxinus spp
MASEKKLSNPMREIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFYVVWERPGYRVGRRRRCKSRVGIQHRVTKDDAMKWFQVKYEGVILNKSSNIAT

SEQ ID NO: 12122 - protein, 180 aa, Carpinus betulus
MAAERKLSNPMREIKVQKLVLNISVGESGDRLTRASKVLEQLSGQTPVFSKARYTVRSFGIRRNEKIACYVTVRGEKAMQLLESGLKVKEYELLRRNFSDTGCFGFGIQEHIDLGIKYDPSTGIYGMDFYVVLERAGYRVGRRRRCKSRVGIQHRVTKEDAMKWFQMKYEGVILNKSQNT

SEQ ID NO: 12123 - protein, 182 aa, Lactuca sativa
MASERKLANPMREIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKARVGIQHRVTKDDAMKWFQVKYEGVILNKSQQIGA

SEQ ID NO: 12124 - protein, 181 aa, Marchantia polymorpha
MASEKKMQNCMREIKVQKLVLNISVGESGDRLTRAAKVLEQLSGQSPVFSKARYTVRSFGIRRNEKIACYVTVRGEKAMQLLESGLKVKEYELLRRNFSDTGCFGFGIQEHIDLGIKYDPSTGIYGMDFYVVLERPGYRVGRRRRAKSRVGIQHRVTKEDSMKWFQVKYEGVILNKSTQIV

SEQ ID NO: 12125 - protein, 181 aa, Unknown
  Sequence found in Organisms: Nicotiana benthamiana, Nicotiana tabacum
MASEKKLSNPMREIKVQKLVLNISVGESGDRLTRAAKVLEQLSGQSPVFSKARYTVRSFGIRRNEKIACYVTVRGEKAMQLLESGLKVKEYELLRRNFSETGCFGFGIQEHIDLGIKYDPSTGIYGMDFYVVLERPGYRVARRRRCKSRVGIQHRVTKEDAMKWFQVKYEGVILNKSSNIQ

SEQ ID NO: 12126 - protein, 182 aa, Orobanche aegyptiaca
MASEKKLSNPMREIKVQKLVLNISVGESGDRLTRASKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSRVGIQHRVTKDDAMKWFQVKYEGVILNKASNIGA

SEQ ID NO: 12127 - protein, 182 aa, Orobanche aegyptiaca
MALEKKLSNPMREIKVQKLVLNISVGESGDRLTRASKVLEQLSGQTPVFSKARYTVRSFGIRRNEKIACHVTVRGDKAMQLLESGLKVKEYELLRRNFSDTGCFGFGIQEHIDLGIKYDPSTGIYGMDFYVVLERPGYRVGRRRRCKSRVGIQHRVTKEDAMKWFQVKYEGVILNKASNIGA

SEQ ID NO: 12128 - protein, 182 aa, Capsicum annuum
MASEKKLSNPMREIKVQKLVLNISVGESGDRLTRAAKVLEQLSGQSPVFSKARYTVRSFGIRRNEKIACYVTVRGEKAMQLLESGLKVKEYELLRRNFSDTGCFGFGIQEHIDLGIKYDPSTGIYGMDFYVVLERPGYRVGRRRRCKSRVGIQHRVTKDDAMKWFQMKYEGVILNKASQLAV

SEQ ID NO: 12129 - protein, 182 aa, Lippia dulcis
MASEKKLSNPMREIKVQKLVLNISVGESGDRLTRAAKVLEQLSGQSPVFSKARYTVRSFGIRRNEKIACYVTVRGDKAMQLLESGLKVKEYELLRRNFSETGCFGFGIQEHIDLGIKYDPSTGIYGMDFYVVLERPGYRVGRRRRCKSRVGIQHRVTKEDAMKWFQVKYEGVILNKASNIGA

SEQ ID NO: 12130 - protein, 182 aa, Papaver somniferum
MAAEKKLTNPMRDIKVQKLVLNISVGESGDRLTRAAKVLEQLSGQAPVFSKARYTVRSFGIRRNEKIACYVTVRGEKAMQLLESGLKVKEYELLRRNFSDTGCFGFGIQEHIDLGIKYDPSTGIYGMDFYVVLERPGYRVGRRRRCKSRVGIQHRVTKDDAMKWFQVKYEGVILNKSQNITG

SEQ ID NO: 12131 - protein, 182 aa, Papaver somniferum
MASEKKLTNPMRDIKVQKLVLNISVGESGDRLTRAAKVLEQLSGQAPVFSKARYTVRSFGIRRNEKIACYVTVRGEKAMQLLESGLKVKEYELLRRNFSDTGCFGFGIQEHIDLGIKYDPSTGIYGMDFYVVLERPGYRVGRRRRCKSRVGIQHRVTKEDAMKWFQVKYEGVILNKSQNITG

SEQ ID NO: 12132 - protein, 181 aa, Unknown
  Sequence found in Organisms: Solanum lycopersicum, Solanum tuberosum, Solanum phureja
MASEKKLSNPMRDIKVQKLVLNISVGESGDRLTRAAKVLEQLSGQSPVFSKARYTVRSFGIRRNEKIACYVTVRGEKAMQLLESGLKVKEYELLRRNFSETGCFGFGIQEHIDLGIKYDPSTGIYGMDFYVVLERPGYRVARRRRCKSRVGIQHRVTKEDSMKWFQVKYEGVILNKSSNIQ

SEQ ID NO: 12133 - protein, 180 aa, Pseudotsuga menziesii
MAAEKKLNNPMREIKVQKLVLNISVGESGDRLTRASKVLEQLSGQTPVFSKARYTVRSFGIRRNEKIACYVTVRGEKALQLLESGLKVKEYELLRRNFSDTGCFGFGIQEHIDLGIKYDPSTGIYGMDFFVVLERPGYRVGRRKRAQSRVGIQHRVTKEDAMKWFQVKYEGVILNKSQNI

SEQ ID NO: 12134 - protein, 183 aa, Sesamum indicum
MASEKKLSNPMREIKVQKLVLNISVGESGDRLTRAAKVLEQLSGQTPVFSKARYTVRSFGIRRNEKIACYVTVRGEKAMQLLESGLKVKEYELLRRNFSETGCFGFGIQEHIDLGIKYDPSTGIYGMDFYVVLERPGYRVGRRRRCKSRVGIQHRVTKEDSMKWFQVKYEGVILNKASNIGAS

SEQ ID NO: 12135 - protein, 181 aa, Solanum phureja
MASEKKLSNPMRDIKVQKLVLNISVGESGDRLTRAAKVLEQLSGQSPVFSKARYTVRSFGIRRNEKIACYVTVRGEKAMQLLESGLKVKEYELLRRNFSETGCFGFGIQEHIDLGIKYDPSTGIYGMDFYVVLERPGYRVARRRRCKSRVGIQHRVTKEDSMKWFQVKYEGVILNKSANIQ

SEQ ID NO: 12136 - protein, 180 aa, Picea glauca
MAAEKKLNNPMRDIKVQKLVLNISVGESGDRLTRASKVLEQLSGQTPVFSKARYTVRSFGIRRNEKIACYVTVRGEKALQLLESGLKVKEYELLRRNFSDTGCFGFGIQEHIDLGIKYDPSTGIYGMDFFVVLERPGYRVGRRKRAQSRVGIQHRVTKEDSMKWFQVKYEGVILNKSQNI

SEQ ID NO: 12137 - protein, 182 aa, Helianthus annuus
MASERKQANPMREIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKARVGIQHRVTKEDAMKWFQVKYEGVILNKSQQIGS

SEQ ID NO: 12138 - protein, 182 aa, Tripterygium wilfordii
MASEKKLSNPMREIRVQKLVLNISVGESGDRLTRAAKVLEQLSGQSPVFSKARYTVRSFGIRRNEKIACYVTVRGEKAMQLLESGLKVKEYELLRRNFSDTGCFGFGIQEHIDLGIKYDPSTGIYGMDFYIVLERPGYRVGRRHRCKSRVGIQHRVTKEDSMKWFQVKYEGVILNKSNAITN

SEQ ID NO: 12139 - protein, 182 aa, Valeriana officinalis
MASEKKLANPMREIKVQKLVLNISVGESGDRLTRAAKVLEQLSGQTPVFSKARYTVRSFGIRRNEKIACYVTVRGDKAMQLLESGLKVKEYELLKKNFSDTGCFGFGIQEHIDLGIKYDPSTGIYGMDFFVVLERPGYRVGRRRRCKARVGIQHRVTKDDAMKWFQVKYEGVILNKSQNITG

SEQ ID NO: 12140 - protein, 182 aa, Vinca minor
MASEKKLNNPMREIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSRVGIHQRVTKDDAMKWFQVKYEGVILNKSQAITN

SEQ ID NO: 12141 - protein, 69 aa, Glycine max
MASEKKLANPMREIKVQKLVLNISVGESGDRLTRAAKVLEQLSGQTPVFSKGTLCVRLGLGGTRRSRVM

SEQ ID NO: 12142 - protein, 61 aa, Arnica chamissonis
MASERKQANPMREIKVQKLVLNISVGESGDRLTRAAKVLEQLSGQSPVFSKARYTVEIVWY

SEQ ID NO: 12143 - protein, 868 aa, Brassica rapa
MAMLSANLSSSSFSFVPSRRSQTHKETASVTRVRKDSIFNKASLRTASIEHRDPPQTLTDANTRLRRLCESGDLENIAKLLRVSQKYDIDPRTLCSVLQLCADTRSLKHGKEVDSFIRRNGVVVDSNMGSKLALMYTNCGDLREARRVFDQVRIEKALFWNILMNELAKAGDFSGSIELFEKMMGSGVEMDSYTFSCVSKSFSSLRSVDGGEQLHGYVLKLGFGECSSVGNSLLAFYLKNGRVESARKVFDEMTERDVISWNSMINGYVSTGLTEQGLYLFVEMLCSGIEFDLATVVSVFAGCADSCLVSLGRAVHGIGLKACMSREDRFCNTLLDMYSKCSDLDSAKAVFTKMSDRSVVSYTSMIAGYAREGLAGEAVKLFAEMEEEGISPDVYTVTAVLNCCARNRLLEEGKRVHEWIKENDMGFDIFLSNALMDMYAKCGSMGEAEIVFSEMPVRDIISWNTIIGGYSKNCYANEALSLFNLLLEEKRFVPDERTVVCVLPACASLSAFDKGREIHGYIMRNGFFRDRHVANSLVDMYAKCGALLLARLLFDEIASKDLVSWTVMIAGYGMHGFGKEAIALFDQKRREGIEPDEISFVSVLYACSHSGLVDEGWRFFNIMRHECKIEPTLEHYACVVDMLARTGELSKAYRFIESMPIPPDATIWGALLCGCRIHHDVKLAERVAERVFELEPENTGYYVLMANIYAEAEKWEEVKRLRKRIGQRGLRKNPGCSWIEIKGRVNIFVAGDSSHPETENIEALLRRVRARMREEGYSPQTKYALIDAEEMEKEEALCGHSEKLAMGLGILTSGHGKIIRVTKNLRVCGDCHEMAKFMSKLTGREIVLRDSNRFHHFKDGHCSCRGFW

SEQ ID NO: 12144 - protein, 151 aa, Brassica napus
MLNPNASLAPTATSNTVPRAFKNNIEVHSIDTSGRIVLDSKINVLLDTEPKAASVTEVPPQELVLLHFQSALKKLHRLVSPHGDVASNLLVTPDSERPHSVPRLGEDRCLTTELFQHLGGTSETITTLTNRDVENELLDLDVPHRVRELLL

SEQ ID NO: 12145 - protein, 104 aa, Euphorbia peplus
MQLLESGLKVKEYELLRRNFSDTGCFGFGIQEHIDLGIKYDPSTGIYGMDFYVVLERPGYRVGRRRRCKSRVGIHQRVTKEDAMKWFQVKYEGVILNKAQNIGA

SEQ ID NO: 12146 - protein, 85 aa, Picea glauca
MAAEKKLNNPMREIKVQKLVLNISVGESGDRLTRASKVLEQLSGQTPVFSKARYTVRSFGIRRNERLPATLLLEEKRLFNFWRVG

SEQ ID NO: 12147 - protein, 182 aa, Unknown
  Sequence found in Organisms: Centaurea maculosa, Cichorium intybus, Taraxacum officinale
MASERKQANPMREIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKARVGIQHRVTKDDAMKWFQVKYEGVILNKSQQIGG

SEQ ID NO: 12148 - protein, 182 aa, Unknown
  Sequence found in Organisms: Arnica chamissonis, Cirsium arvense, Cynara scolymus, Echinacea purpurea, Carthamus tinctorius, Helianthus annuus, Tragopogon dubius
MASERKQANPMREIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKARVGIQHRVTKDDAMKWFQVKYEGVILNKSQQIGA

SEQ ID NO: 12149 - protein, 182 aa, Sorghum bicolor
MASEKKQSNPMREIKVQKLVLNISVGESGDRLTRAAKVLEQLSGQTPVFSKARYTVRSFGIRRNEKIACYVTVRGEKAMQLLESGLKVKEYELLRRNFSDTGCFGFGIQEHIDLGIKYDPSTGIYGMDFYVVLERAGYRVARRRRCKARVGIQHRVTKEDSMKWFQVKYEGVILNKAQANTV

SEQ ID NO: 12150 - protein, 182 aa, Unknown
  Sequence found in Organisms: Brassica napus, Brassica juncea, Brassica oleracea, Brassica rapa, Raphanus sativus, Eutrema halophilum, Eutrema parvulum
MASEKKLSNPMRDIKVQKLVLNISVGESGDRLTRASKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVARRRRCKARVGIQHRVTKDDAMKWFQVKYEGVILNKSQNITG

SEQ ID NO: 12151 - protein, 182 aa, Triphysaria pusilla
MASEKKLSNPMREIKVQKLVLNISVGESGDRLTRASKVLEQLSGQTPVFSKARYTVRSFGIRRNEKIACYVTVRGDKAMQLLESGLKVKEYELLRRNFSETGCFGFGIQEHIDLGIKYDPSTGIYGMDFYVVLERPGYRVGRRRRCKARVGIQHRVTKDDAMKWFQVKYEGVILNKSSNIGA

SEQ ID NO: 12152 - protein, 182 aa, Amorphophallus konjac
MASEKKLSNPMREIKVQKLVLNICVGESGDRLTRAAKVLEQLSGQTPVFSKARYTVRSFGIRRNEKIACYVTVRGEKAMQLLESGLKVKEYELLRRNFSDSGCFGFGIQEHIDLGIKYDPSTGIYGMDFYVVLERPGYRVGRRRRCKSRVGIQHRVTKDDAMKWFQVKYEGVILNKAQAGPQ

SEQ ID NO: 12153 - protein, 182 aa, Aquilegia formosa
MASEQKLANPMREIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSRIGIQHRVTKDDAMKWFQVKYEGVILNKSQNITG

SEQ ID NO: 12154 - protein, 182 aa, Unknown
  Sequence found in Organisms: Brassica napus, Brassica juncea, Brassica oleracea, Brassica rapa, Raphanus sativus
MASEKKLSNPMRDIKVQKLVLNISVGESGDRLTRASKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVARRRRCKTRVGIQHRVTKDDAMKWFQVKYEGVILNKSQNITG

SEQ ID NO: 12155 - protein, 182 aa, Chelidonium majus
MAAEKKLSNPMREIKVQKLVLNISVGESGDRLTRAAKVLEQLSGQSPVFSKARYTVRSFGIRRNEKIACYVTVRGEKAMQLLESGLKVKEYELLRKNFSDTGCFGFGIQEHIDLGIKYDPSTGIYGMDFYVVLERPGYRVGRRRRCKAKVGIQHRVTKDDAMKWFQVKYEGVILNKSQNITG

SEQ ID NO: 12156 - protein, 182 aa, Cirsium arvense
MASERKQANPMREIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKARVGIQHRVTKDDAMKWFQVKYEGVILNKSQQIGN

SEQ ID NO: 12157 - protein, 182 aa, Cleome gynandra
MASEKKLSNPMRDIKVQKLVLNISVGESGDRLTRAAKVLEQLSGQTPVFSKARYTVRSFGIRRNEKIACYVTVRGEKAMQLLESGLKVKEYELLRRNFSDTGCFGFGIQEHIDLGIKYDPSTGIYGMDFYVVLERPGYRVARRRRCKARLGIQHRVTKEDAMKWFQVKYEGVILNKSQNITG

SEQ ID NO: 12158 - protein, 182 aa, Cucurbita pepo
MASERKLSNTMRDIKVQKLVLNISVGESGDRLTRAAKVLEQLSGQSPVFSKARYTVRSFGIRRNEKIACYVTVRGEKAMQLLESGLKVKEYELLRRNFSDTGCFGFGIQEHIDLGIKYDPSTGIYGMDFFVVLERPGYRVGRRRRCKSRVGIQHRVTKEDAMKWFQVKYEGVILNKSQQLTG

SEQ ID NO: 12159 - protein, 182 aa, Cynara scolymus
  misc_feature (19)..(19): Xaa can be any naturally occurring amino acid
MASERKQSNPMREIKVQKXVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKARVGIQHRVTKDDAMKWFQVKYEGVILNKSQQIGG

SEQ ID NO: 12160 - protein, 182 aa, Cynodon dactylon
MASEKKQSNPMREIKVQKLVLNISVGESGDRLTRAAKVLEQLSGQSPVFSKARYTVRSFGIRRNEKIACYVTVRGEKAMQLLESGLKVKEYELLRRNFSDTGCFGFGIQEHIDLGIKYDPSTGIYGMDFYVVLERAGYRVARRRRCKSRVGIQHRVTKEDAMKWFQVKYEGVILNKSQANTT

SEQ ID NO: 12161 - protein, 182 aa, Cynodon dactylon
MASEKKQSNPMREIKVQKLVLNISVGESGDRLTRAAKVLEQLSGQSPVFSKARYTVRSFGIRRNEKIACYVTVRGEKAMQLLESGLKVKEYELLRRNFSDTGCFGFGIQEHIDLGIKYDPSTGIYGMDFYVVLERAGYRVARRRRCKSRVGIQHRVTKEDAMKWFQVKYEGVILNKSQANTS

SEQ ID NO: 12162 - protein, 182 aa, Epimedium sagittatum
MASEKKLANPMRDIKVQKLVLNISVGESGDRLTRASKVLEQLSGQAPVFSKARYTVRSFGIRRNEKIACYVTVRGDKAMQLLESGLKVKEYELLRRNFSETGCFGFGIQEHIDLGIKYDPSTGIYGMDFYVVLERPGYRVGRRRRCKSRVGIQHRVTKEDAMKWFQVKYEGVILNKSQNITG

SEQ ID NO: 12163 - protein, 182 aa, Eschscholzia californica
MASEKKLLNPMRDIKVQKLVLNISVGESGDRLTRAAKVLEQLSGQSPVFSKARYTVRSFGIRRNEKIACYVTVRGEKAMQLLESGLKVKEYELLRRNFSDTGCFGFGIQEHIDLGIKYDPSTGIYGMDFYVVLERPGYRVGRRRRCKSRVGIQHRVTKDDAMKWFQVKYEGVILNKSQNITG

SEQ ID NO: 12164 - protein, 182 aa, Linum usitatissimum
MAAERKLSNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVARRRRCKARVGIHQRVTKDDAMKWFQVKYEGVILNKAQNITG

SEQ ID NO: 12165 - protein, 182 aa, Linum usitatissimum
MAAERKLSNPMREIKVQKLVLNISVGESGDRLTRAAKVLEQLSGQTPVFSKARYTVRSFGIRRNEKIACYVTVRGEKAMQLLESGLKVKEYELLRKNFSDTGCFGFGIQEHIDLGIKYDPSTGIYGMDFFVVLERPGYRVARRRRCKARVGIHQRVTKEDSMKWFQVKYEGVILNKAQNITG

SEQ ID NO: 12166 - protein, 182 aa, Actinidia deliciosa
  misc_feature (131)..(131): Xaa can be any naturally occurring amino acid
MASEKKLLNPMREIKVQKLVLNISVGESGDRLTRAAKVLEQLSGQTPVFSKARYTVRSFGIRRNEKIACYVTVRGEKAMQLLESGLKVKEYELLRRNFSDTGCFGFGIQEHIDLGIKYDPSTGIYGMDFYXVLERPGYRVGRRRRCKSRVGIQHRVTKEDAMKWFQVKYEGVILNKAQNLTS

SEQ ID NO: 12167 - protein, 181 aa, Parthenium argentatum
ASERKQANPMREIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKARVGIQHRVTKEDAMKWFQVKYEGVILNKSQQIGA

SEQ ID NO: 12168 - protein, 183 aa, Phalaenopsis aphrodite
MASEKKLSNPMREIKVQKLVLNISVGESGDRLTRAAKVLEQLSGQIPVFSKARYTVRSFGIRRNEKIACYVTVRGEKAMQLLESGLKVKEYELLRRNFSDTGCFGFGIQEHIDLGIKYDPSTGIYGMDFYVVLERPGYRVSRRRRCKSRLGVQHRVTKEDAMKWFQVKYEGVILNKSQAITNA

SEQ ID NO: 12169 - protein, 182 aa, Carthamus tinctorius
  misc_feature (143)..(143): Xaa can be any naturally occurring amino acid
MASEKKLANPMREIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRXRTCKARVGIQHRVTKDDAMKWFQVKYEGVILNKSQQIGA

SEQ ID NO: 12170 - protein, 182 aa, Salvia sclarea
MAAEKKLSNPMREIKVQKLVLNISVGESGDRLTRAAKVLEQLSGQSPVFSKARYTVRSFGIRRNEKIACYVTVRGDKAMQLLESGLKVKEYELLRRNFSETGCFGFGIQEHIDLGIKYDPSTGIYGMDFYVVLERPGYRVGRRRRCKARVGIQHRVTKDDAMKWFQVKYEGVILNKASNIGA

SEQ ID NO: 12171 - protein, 182 aa, Silene vulgaris
MASEKKLANPMREIKVQKLVLNISVGESGDRLTRAAKVLEQLSGQTPVFSKARYTVRSFGIRRNEKIACYVTVRGEKAMQLLESGLKVKEYELLRRNFSDTGCFGFGIQEHIDLGIKYDPSTGIYGMDFFVVLERPGYRVGRRRRCKARVGIQHRVTKDDAMKWFQVKYEGVILNKAQNVGS

SEQ ID NO: 12172 - protein, 182 aa, Silene vulgaris
MASEKKLANPMREIKVQKLVLNISVGESGDRLTRAAKVLEQLSGQTPVFSKARYTVRSFGIRRNEKIACYVTVRGEKAMQLLESGLKVKEYELLRRNFSDTGCFGFGIQEHIDLGIKYDPSTGIYGMDFFVVLERPGYRVGRRRRCKARVGIQHRVTKDDAMKWFQVKYEGVILNKAQNVGA

SEQ ID NO: 12173 - protein, 182 aa, Saccharum officinarum
MASEKKQSNPMREIKVQKLVLNISVGESGDRLTRAAKVLEQLSGQTPVFSKARYTVRSFGIRRNEKIACYVTVRGEKAMQLLESGLKVKEYELLRRNFSETGCFGFGIQEHIDLGIKYDPSTGIYGMDFYVVLERAGYRVARRRRCKSRVGIQHRVTKEDSMKWFQVKYEGVILNKAQANTS

SEQ ID NO: 12174 - protein, 182 aa, Tabernaemontana elegans
MASEKKLNNPMREIKVQKLVLNISVGESGDRLTRAAKVLEQLSGQTPVFSKARYTVRSFGIRRNEKIACYVTVRGEKAMQLLESGLKVKEYELLRRNFSDTGCFGFGIQEHIDLGIKYDPSTGIYGMDFYVVLERAGYRVARRRRCKSRVGIQHRVTKEDAMKWFQVKYEGVILNKAQTIAS

SEQ ID NO: 12175 - protein, 182 aa, Camellia sinensis
MASERKLSNPMREIKVQKLVLNISVGESGDRLTRAAKVLEQLSGQAPVFSKARYTVRSFGIRRNEKIACYVTVRGEKAMQLLESGLKVKEYELLRRNFSETGCFGFGIQEHIDLGIKYDPSTGIYGMDFYVVLERPGYRVGRRRRCKSRVGIQHRVTKDDAMKWFQVKYEGVILNKSQNIGG

SEQ ID NO: 12176 - protein, 182 aa, Thalictrum flavum
MASEQKLANPMRDIKVQKLVLNISVGESGDRLTRAAKVLEQLSGQAPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKSRIGIQHRVTKDDAMKWFQVKYEGVILNKSQNITG

SEQ ID NO: 12177 - protein, 182 aa, Vinca minor
MASEKKLNNPMREIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSRVGIHQRVTKDDAMKWFQVKYEGVILNKSQNITN

SEQ ID NO: 12178 - protein, 182 aa, Ocimum basilicum
MASEKKLSNPMREIKVQKLVLNISVGESGDRLTRAAKVLEQLSGQSPVFSKARYTVRSFGIRRNEKIACYVTVRGEKAMQLLESGLKVKEYELLRRNFSETGCFGFGIQEHIDLGIKYDPSTGIYGMDFYVVLERPGYRVGRRRRCKSRVGIQHRVTKEDAMKWFQVKYEGVILNKASNIGA

SEQ ID NO: 12179 - protein, 104 aa, Triphysaria pusilla
MQLLESGLKVKEYELLRRNFSETGCFGFGIQEHIDLGIKYDPSTGIYGMDFYVVLERPGYRVGRRRRCKARVGIQHRVTKDDAMKWFQVKYEGVILNKSSNIGA

SEQ ID NO: 12180 - protein, 70 aa, Triphysaria pusilla
MASEKKLSNPMREIKVQKLVLNISVGESGDRLTRASKVLEQLSGQTPVFSKARYTVRSFGIRRNEKLLAT

SEQ ID NO: 12181 - protein, 144 aa, Ambrosia trifida
MASERKQANPMREIKVQKLVLNIPVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRR

SEQ ID NO: 12182 - protein, 99 aa, Valeriana officinalis
MASERKLANPMREIKVQKLVLNISVGESGDRLTRAAKVLEQLSGQMPVFSKARYTVRSFGIRRNEKIACYVTVRGDKAMQLLESGLKVKEYELLKKEFQ

SEQ ID NO: 12183 - protein, 181 aa, Unknown
  Sequence found in Organisms: Solanum melongena, Capsicum annuum
MASEKKLSNPMRDIKVQKLVLNISVGESGDRLTRAAKVLEQLSGQSPVFSKARYTVRSFGIRRNEKIACYVTVRGEKAMQLLESGLKVKEYELLRRNFSETGCFGFGIQEHIDLGIKYDPSTGIYGMDFYVVLERPGYRVARRRRCKSRVGIQHRVTKEDAMKWFQVKYEGVILNKSSNIQ

SEQ ID NO: 12184 - protein, 180 aa, Setaria italica
MASEKKQSNPMREIKVQKLVLNISVGESGDRLTRAAKVLEQLSGQSPVFSKARYTVRSFGIRRNEKIACYVTVRGEKAMQLLESGLKVKEYELLRRNFSDTGCFGFGIQEHIDLGIKYDPSTGIYGMDFYVVLERAGYRVARRRRCKSRVGIQHRVTKEDAMKWFQVKYEGVILNKAQAN

SEQ ID NO: 12185 - protein, 180 aa, Ipomoea batatas
MASEKKLNNPMRDIKVQKLVLNISVGESGDRLTRASKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVARRRRCKARVGIQHRVTKEDAMKWFQVKYEGVILNKASNI

SEQ ID NO: 12186 - protein, 180 aa, Ipomoea nil
MASEKKLNNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVARRRRCKARVGIQHRVTKDDAMKWFQVKYEGVILNKASNI

SEQ ID NO: 12187 - protein, 181 aa, Ipomoea nil
MASEKKLNNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVARRRRCKARVGIQHRVTKDDAMKWFQVKYEGVILNKASNIS

SEQ ID NO: 12188 - protein, 181 aa, Marchantia polymorpha
MASEKKQQNCMREIKVQKLVLNISVGESGDRLTRAAKVLEQLSGQSPVFSKARYTVRSFGIRRNEKIACYVTVRGEKAMQLLESGLKVKEYELLRRNFSDTGCFGFGIQEHIDLGIKYDPSTGIYGMDFYVVLERPGYRVGRRRRAKSRVGIQHRVTKEDSMKWFQVKYEGVILNKSTQIA

SEQ ID NO: 12189 - protein, 180 aa, Unknown
  Sequence found in Organisms: Pinus pinaster, Pinus taeda
MAAEKKLSNPMREIKVQKLVLNISVGESGDRLTRASKVLEQLSGQTPVFSKARYTVRSFGIRRNEKIACYVTVRGEKALQLLESGLKVKEYELLRRNFSDTGCFGFGIQEHIDLGIKYDPSTGIYGMDFFVVLERPGYRIGRRKRAQSRVGIQHRVTKDDAMKWFQVKYEGVILNKSQNI

SEQ ID NO: 12190 - protein, 181 aa, Unknown
  Sequence found in Organisms: Nicotiana benthamiana, Nicotiana tabacum
MASEKKLSNPMREIKVQKLVLNISVGESGDRLTRAAKVLEQLSGQSPVFSKARYTVRSFGIRRNEKIACYVTVRGDKAMQLLESGLKVKEYELLRRNFSETGCFGFGIQEHIDLGIKYDPSTGIYGMDFYVVLERPGYRVARRRRCKARVGIQHRVTKDDAMKWFQVKYEGVILNKSSNIQ

SEQ ID NO: 12191 - protein, 181 aa, Nicotiana benthamiana
MASEKKLSNPMREIKVQKLVLNISVGESGDRLTRAAKVLEQLSGQSPVFSKARYTVRSFGIRRNEKIACYVTVRGEKATQLLESGLKVKEYELLRRNFSETGCFGFGIQEHIDLGIKYDPSTGIYGMDFYVVLERPGYRVARRRRCKSRVGIQHRVTKEDAMKWFQVKYEGVILNKSSNIQ

SEQ ID NO: 12192 - protein, 181 aa, Solanum phureja
MASEKKLSNPMRDIKVQKLVLNISVGESGDRLTRAAKVLEQLSGQSPVFSKARYTVRSFGIRRNEKIACYVTVRGEKAMQLLESGLKVKEYELLRRNFSETGCLGFGIQEHIDLGIKYDPSTGIYGMDFYVVLERPGYRVARRRRCKSRVGIQHRVTKEDSMKWFQVKYEGVILNKSSNIQ

SEQ ID NO: 12193 - protein, 181 aa, Nicotiana tabacum
MASEKKLSNPMREIKVQKLVLNISVGESGDRLTRAAKVLEQLSGQSPVFSKARYTVRSFGIRRNEKIACYVTVRGEKAMQLLESGLKVKEYELLRRNFSETGCFGFGIQEHIDLGIKYDPSTGIYGMDFYVVLERPGYRVARRRRCKSRVGIQHRVTKEDAMKWFQVKYEGVILNKSSNLQ

SEQ ID NO: 12194 - protein, 182 aa, Unknown [sequence omitted]

SEQ ID NO: 12195 - protein, 182 aa, Arabidopsis thaliana
MASEKKLSNPMRDIKVQKLVLNISVGESGDRLTRASKVLEQLSGQTPVFSKARYTVRSFGIRRNEKIACYVTVRGEKAMQLLESGLKVKEYELLRRNFSDTGCFGFGIQEHIDLGIKYDPSTGIYGMDFYVVLERPGYRVARRRRCKTRVGIQHRVTKDDAMKWFQVKYEGVILNKSQNITG

SEQ ID NO: 12196 - protein, 181 aa, Cenchrus ciliaris
MASEKKQSNPMREIKVQKLVLNISVGESGDRLTRAAKVLEQLSGQSPVFSKARYTVRSFGIRRNEKIACYVTVRGEKAMQLLESGLKVKEYELLRRNFSETGCFGFGIQEHIDLGIKYDPSTGIYGMDFYVVLERAGYRVARRRRCKSRVGIQHRVTKEDAMKWFQVKYEGVILNKAQANS

SEQ ID NO: 12197 - protein, 182 aa, Echinacea purpurea
MASEKKLSNPMREIKVQKLVLNISVGESGDRLTRAAKVLEQLSGQSPVFSKARYTVRSFGIRRNEKIACYVTVRGDKAMQLLESGLKVKEYELLRRNFSETGCFGFGIQEHIDLGIKYDPSTGIYGMDFYVVLERPGYRVGRRRRCKARVGIQHRVTKDDAMKWFQVKYEGVILNKASNIGA

SEQ ID NO: 12198 - protein, 181 aa, Zea mays
MASEKKQSNPMREIKVQKLVLNISVGESGDRLTRAAKVLEQLSGQSPVFSKARYTVRSFGIRRNEKIACYVTVRGEKAMQLLESGLKVKEYELLRRNFSDTGCFGFGIQEHIDLGIKYDPSTGIYGMDFYVVLERAGYRVARRRRCKSRVGIQHRVTKEDAMKWFQVKYEGVILNKAQNTS

SEQ ID NO: 12199 - protein, 182 aa, Acacia harpophylla
MASEKKLLNPMREIKVQKLVLNISVGESGDRLTRAAKVLEQLSGQTPVFSKARYTVRSFGIRRNEKIACYVTVRGEKAMQLLESGLKVKEYELLRRNFSDTGCFGFGIQEHIDLGIKYDPSTGIYGMDFYVVLERPGYRVGRRRRCKSHVGIQHRLSKEDAMKWFQVKYEGVILNKAQATFG

SEQ ID NO: 12200 - protein, 183 aa, Malus domestica
MQAEEKKLANPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSRVGIRHRVTKDDAMKWFQVKYEGVILNKSQQLTA

SEQ ID NO: 12201 - protein, 182 aa, Brassica juncea
MASEKKLSNPMRDIKVQKLVLNISVGESGDRLTRASKVLEQLSGQTPVFSKARYTVRSFGIRRNEKIACYVTVRGDKAMQLLESGLKVKEYELLRKNFSDTGCFGFGIQEHIDLGIKYDPSTGIYGMDFYVVLERPGYRVARRRRCKTRVGIQHRVTKDDAMKWFQVKYEGVILNKSQNITG

SEQ ID NO: 12202 - protein, 182 aa, Unknown
  Sequence found in Organisms: Brassica napus, Brassica oleracea
MASEKKLSNPMRDIKVQKLVLNISVGESGDRLTRASKVLEQLSGQTPVFSKARYTVRSFGIRRNEKIACYVTVRGDKAMQLLESGLKVKEYELLRKNFSDTGCFGFGIQEHIDLGIKYDPSTGIYGMDFYVVLERPGYRVARRRRCKARVGIQHRVTKDDAMKWFQVKYEGVILNKSQNITG

SEQ ID NO: 12203 - protein, 177 aa, Bupleurum chinense
MASDRKLANPMREIKVQKLVLNISVGESGDRLTRASKVLEQLSGQMPVFSKARYTVRSFGIRRNEKIACYVTVRGDKAMQLLESGLKVKEYELLRKNFSDTGCFGFGIQEHIDLGIKYDPSTGIYGMDFFVVLERPGYRVGRRRRCKSRVGIQHRVTKEDAMKWFQVKYEGVILNKS

SEQ ID NO: 12204 - protein, 182 aa, Bupleurum chinense
MASDRKLANPMREIKVQKLVLNISVGESGDRLTRASKVLEQLSGQIPVFSKARYTVRSFGIRRNEKIACYVTVRGDKAMQLLESGLKVKEYELLRKNFSDTGCFGFGIQEHIDLGIKYDPSTGIYGMDFYVVLERPGYRVGRRRRCKSRVGIQHRVTKEDAMKWFQVKYEGVILNKSQNIGN

SEQ ID NO: 12205 - protein, 181 aa, Solanum melongena
MASEKKMSNPMRDIKVQKLVLNISVGESGDRLTRAAKVLEQLSGQSPVFSKARYTVRSFGIRRNEKIACYVTVRGEKAMQLLESGLKVKEYELLRRNFSETGCFGFGIQEHIDLGIKYDPSTGIYGMDFYVVLERPGYRVARRRRCKSRVGIQHRVTKEDAMKWFQVKYEGVILNKSSNIQ

SEQ ID NO: 12206 - protein, 182 aa, Zingiber officinale
  misc_feature (20)..(20): Xaa can be any naturally occurring amino acid
MASEKKLANPMRDIKVQKLXLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVSRRRRCKSRVGIHQRVTKEDAMKWFQVKYEGVILNKSQATTS

SEQ ID NO: 12207 - protein, 182 aa, Panax ginseng
MASEKKLLNPMREIKVQKLVLNISVGESGDRLTRASKVLEQLSGQSPVFSKARYTVRSFGIRRNEKIACYVTVRGDKAMQLLESGLKVKEYELLRRNFSDTGCFGFGIQEHIDLGIKYDPSTGIHGMDSYVVLERPGYRVGRRRRCKSRVGIQHRVTKEDAMKWFQVKYEGVILNKSQNFGG

SEQ ID NO: 12208 - protein, 182 aa, Eragrostis curvula
MASEKKQSNPMRDIKVQKLVLNISVGESGDRLTRAAKVLEQLSGQSPVFSKARYTVRSFGIRRNEKIACYVTVRGEKAMQLLESGLKVKEYELLRRNFSDTGCFGFGIQEHIDLGIKYDPSTGIYGMDFYVVLERAGYRVARRRRCKSRVGIQHRVTKEDAMKWFQVKYEGVILNKSQANAS

SEQ ID NO: 12209 - protein, 181 aa, Pennisetum glaucum
MASEKKQSNPMREIKVQKLVLNISVGESGDRLTRAAKVLEQLSGQSPVFSKARYTVRSFGIRRNEKIACYVTVRGEKAMQLLESGLKVKEYELLRRNFSETGCFGFGIQEHIDLGIKYDPSTGIYGMDFYVVLERAGYRVARRRRCKSRVGIQHRVTKEDAMKWFQVKYEGVILNKAQATS

SEQ ID NO: 12210 - protein, 182 aa, Nuphar advena
MAAEKKLSNPMREIKVQKLVLNISVGESGDRLTRAAKVLEQLSGQTPVYSKARYTVRSFGIRRNEKIACYVTVRGEKAMQLLESGLKVKEYELLRRNFSDTGCFGFGIQEHIDLGIKYDPSTGIYGMDFYVVLERAGYRVSRRRRCKSRLGIHHRVTKEDAMKWFQVKYEGVILNKSQTTAS

SEQ ID NO: 12211 - protein, 180 aa, Pinus taeda
MAAEKKLSNTMREIKVQKLVLNISVGESGDRLTRASKVLEQLSGQTPVFSKARYTVRSFGIRRNEKIACYVTVRGEKALQLLESGLKVKEYELLRRNFSDTGCFGFGIQEHIDLGIKYDPSTGIYGMDFFVVLERPGYRIGRRKRAQSRVGIQHRVTKDDAMKWFQVKYEGVILNKSQNI

SEQ ID NO: 12212 - protein, 182 aa, Raphanus sativus
MASEKKLSNPMRDIKVQKLVLNISVGESGDRLTRASKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVARRRRCKTRVGIQHRVTKDDAMKWFQVKYERVILNKSQNITG

SEQ ID NO: 12213 - protein, 182 aa, Raphanus sativus
MASEKKLTNPMRDIKVQKLVLNISVGESGDRLTRASKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVARRRRCKTRVGIQHRVTKDDAMKWFQVKYEGVILNKSQNITG

SEQ ID NO: 12214 - protein, 182 aa, Oryza sativa
MASEKKQSNPMREIKVQKLVLNISVGESGDRLTRASKVLEQLSGQTPVFSKARYTVRSFGIRRNEKIACYVTVRGEKAMQLLESGLKVKEYELLRRNFSDTGCFGFGIQEHIDLGIKYDPSTGIYGMDFYVVLERAGYRVARRRRCKSRVGIQHRVTKEDAMKWFQVKYEGVILNKAQANTS

SEQ ID NO: 12215 - protein, 182 aa, Senecio madagascariensis
MASERKQANPMREIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFFVVLERPGYRIGRRRRCKSRVGIQHRVTKEDAMKFFQAKYEGVILNKSQQIGA

SEQ ID NO: 12216 - protein, 180 aa, Picea glauca
MAAEKKLNNPMREIKVQKLVLNISVGESGDRLTRASKVLEQLSGQTPVFSKARYTVRSFGIRRNEKIACYVTVRGEKALQLLESGLKVKEYELLRRNFSDTGCFGFGIQEHIDLGIKYDPSTGIYGMDFFVVLERPGYRIGRRKRAQSRVGIQHRVTKDDAMKWFQVKYEGVILNKSQNI

SEQ ID NO: 12217 - protein, 180 aa, Panicum virgatum
MASEKKQSNPMREIKVQKLVLNISVGESGDRLTRAAKVLEQLSGQSPVFSKARYTVRSFGIRRNEKIACYVTVRGEKAMQLLESGLKVKEYELLRRNFSETGCFGFGIQEHIDLGIKYDPSTGIYGMDFYVVLERAGYRVARRRRCKSRVGIQHRVTKEDAMKWFQVKYEGVILNKAQAS

SEQ ID NO: 12218 - protein, 182 aa, Triphysaria pusilla
MASEKKLSNPMREIKVQKLVLNISVGESGDRLTRASKVLEQLSGQTPVFSKARYTVRSFGIRRNEKIACHVTVRGEKAMQLLESGLKVKEYELLRRNFSETGCFGFGIQEHIDLGIKYDPSTGIYGMDFYVVLERPGYRVGRRRRCKSRVGIQHRVTKDDSMKWFQQKYEGVILNKSSNIGA

SEQ ID NO: 12219 - protein, 182 aa, Triphysaria pusilla
MASEKKLSNPMREIKVQKLVLNISVGESGDRLTRASKVLEQLSGQTPVFSKARYTVRSFGIRRNEKIACYVTVRGDKAMQLLESGLKVKEYELLRRNFSETGCFGFGIQEHIDLGIKYDPSTGIYGMDFYVVLGRPGYRVGRRRRCKARVGIQHRVTKDDAMKWFQVKYEGVILNKSSNIGA

SEQ ID NO: 12220 - protein, 183 aa, Vinca minor
MASEKKLNNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVARRRRCKARVGIHQRVTKEDAMKWFQVKYEGVILNKAQNIGTA

SEQ ID NO: 12221 - protein, 109 aa, Brassica rapa
MASEKKLSNPMRDIKVQKLVLNISVGESGDRLTRASKVLEQLSGQTPVFSKARYTVRSFGIRRNEKIACYVTVRGDKAMQLLESGLKVKEYELLRRNFSDTGCFGFGIP

SEQ ID NO: 12222 - protein, 182 aa, Zea mays
MASEKKQSNPMREMKVQKLVLNISVGESGDRLTRAAKVLEQLSGQSPVFSKARYTVRSFGIRRNEKIACYVTVRGEKAMQLLESGLKVKEYELLRRNFSDTGCFGFGIQEHIDLGIKYDPSTGIYGMDFYVVLERAGYRVARRRRCKSRVGIQHRVTKEDAMKWFQVKYEGVILNKAQANTS

SEQ ID NO: 12223 - protein, 182 aa, Unknown
  Sequence found in Organisms: Sorghum bicolor, Saccharum officinarum, Panicum virgatum
MASEKKQSNPMREIKVQKLVLNISVGESGDRLTRAAKVLEQLSGQSPVFSKARYTVRSFGIRRNEKIACYVTVRGEKAMQLLESGLKVKEYELLRRNFSETGCFGFGIQEHIDLGIKYDPSTGIYGMDFYVVLERAGYRVARRRRCKSRVGIQHRVTKEDAMKWFQVKYEGVILNKAQANTS

SEQ ID NO: 12224 - protein, 182 aa, Arabidopsis lyrata
MASEKKLSNPMRDIKVQKLVLNISVGESGDRLTRASKVLEQLSGQTPVFSKARYTVRSFGTRRNEKIACYVTVRGEKAMQLLESGLKVKEYELLRRNFSDTGCFGFGIQEHIDLGIKYDPSTGIYGMDFYVVLERPGYRVARRRRCKARVGIQHRVTKDDAMKWFQVKYEGVILNKSQNITG

SEQ ID NO: 12225 - protein, 182 aa, Ocimum basilicum
MASEKKLSNPMREIKVQKLVLNISVGESGDRLTRAAKVLEQLSGQSPVFSKARYTVRSFGIRRNEKIACYVTVRGEKAMQLLESGLKVKEYELLRRNFSETGCPGFGIQEHIDLGIKYDPSTGIYGMDFYVVLERPGYRVGRRRRCKSRVGIQHRVTKEDAMKWFQVKYEGVIPNKASNIGA

SEQ ID NO: 12226 - protein, 182 aa, Curcuma longa
MASEKKLSNPMREIKVQKLVLNISVGESGDRLTRAAKVLEQLSGQIPVFSKARYTVRSFGIRRNEKIACYVTVRGDKAMQLLESGLKVKEYELLRRNFSDTGCFGFGIQEHIDLGIKYDPSTGIYGMDFYVILERPGYRVSRRRRCKSRVGIHQRVTKEDAMKWFQVKYEGVILNKAQGTTN

SEQ ID NO: 12227 - protein, 183 aa, Fagopyrum esculentum
MATKDKKLSNPMRDIKVQKLVLNISVGESGDRLTRASKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVARRRRCKSRVGIQHRVTKDDAMKWFQMKYEGVILNKSQNITG

SEQ ID NO: 12228 - protein, 182 aa, Gerbera hybrid cultivar
MASERKQSNPMREIKVQKLVLNISVGESGDRLTRAAQVLEQLSGQSPVFSKASYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKARVGIQHRVTKDDAMKWFQVKYEGVILNKSQQIGA

SEQ ID NO: 12229 - protein, 182 aa, Gnetum gnemon
MASERKQDNPMREIKVQKLVLNISVGESGDRLTRAAKVLEQLSGQTPVFSKARYTVRSFGIRRNEKIACYVTVRGEKALQLLESGLKVKEYELLRRNFSDTGCFGFGIQEHIDLGIKYDPSTGIYGMDFYVVLERPGYRVGRRKRAKSRVGIQHRVTKEEAMKWFQVKYEGVILNKSQAIAQ

SEQ ID NO: 12230 - protein, 182 aa, Guizotia abyssinica
MASERKQANPMREIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDFGIKYDPSTGIYGMDFFVVLERPGYRVGRRRRCKARVSIQHRVTKDDAMKWFQVKYEGVILNKSQQIGA

SEQ ID NO: 12231 - protein, 182 aa, Actinidia deliciosa
MASEKKLLNPMREIKVQKLVLNISVGESGDRLTRAAKVLEQLSGQTPVFSKARYTVRSFGIRRNEKIACYVTVRGEKAMQLLESGLKVKEYELLRRNFSDTGCFGFGIQEHIDLGIKYDPSTGIYGMDFYIVLERPGYRVGRRRRCKARVGIQHRVTKDDAMKWFQVKYEGVILNKAQNLTS

SEQ ID NO: 12232 - protein, 182 aa, Zea mays
MASEKKQSNPMREIKVQKLVLNISVGESGDRLTRAAKVLEQLSGQSPVFSKARYTVRSFGIRRNEKIACYVTVRGEKAMQLLESGLKVKEYELLRRNFSDTGCFGFGIQEHIDLGIKYDPSTGIYGMDFYVVLERAGYRVARRRRCKSRVGIQHRVTKEDAMKWFQVKYEGVILNKAQGNTS

SEQ ID NO: 12233 - protein, 182 aa, Nuphar advena
MASEKKLSNPMREIKVQKLVLNISVGESGDRLTRAAKVLEQLSGQTPVYSKARYTVRSFGIRRNEKIACYVTVRGEKAMQLLESGLKVKEYELLRRNFSDTGCFGFGIQEHIDLGIKYDPSTGIYGMDFYVVLERAGYRVSRRRRCKSRLGIHHRVTKEDAMKWFQVKYEGVILNKSQTTAS

SEQ ID NO: 12234 - protein, 182 aa, Allium cepa
MASEKKLSNPMREIKVQKLVLNISVGESGDRLTRAAKVLEQLSGQTPVFSKARYTVRSFGIRRNEKIACYVTIRGEKAMQLLESGLKVKEYELVRKNFSDTGCFGFGIQEHIDLGIKYDPSTGIYGMDFYVVLERAGYRVGRRRRCKSRVGIQHRVTKDDAMKWFQVKYEGVILNKAHAITG

SEQ ID NO: 12235 - protein, 182 aa, Allium cepa
MASEKKLSNPMREIKVQKLVLNISVGESGDRLTRASKVLEQLSGQTPVFSKARYTVRSFGIRRNEKIACYVTVRGEKAMQLLESGLKVKEYELVRRNFSDTGCFGFGIQEHIDLGIKYDPSTGIYGMDFYVVLERAGYRVGRRRRCKSRVGIQHRVTKDDAMKWFQVKYEGVILNKAHAMTG

SEQ ID NO: 12236 - protein, 182 aa, Raphanus sativus
  misc_feature (34)..(34): Xaa can be any naturally occurring amino acid
MASEKKLTNPMRDIKVQKLVLNISVGESGDRLTXASKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVARRRRCKARVGIQHRVTKDDAMKWFQVKYEGVILNKSQNITG

SEQ ID NO: 12237 - protein, 182 aa, Helianthus annuus
MASERKQANPMREIKVQKLVLNISVGESGDRLTRAAKVLEQLIGQSPVFSKARYTVRSFGIRRNEKIACYVTVRGDKAMHLLESGLKVKEYELLRRNFSDTGCFGFGIQEHIDLGIKYDPSTGIYGMDFFVVLERPGYRVGRRRRCKARVGIQHRVTKDDAMKWFQVKYEGVILNKSQQIGA

SEQ ID NO: 12238 - protein, 183 aa, Tabernaemontana elegans
MASEKKLSNPMREIKVQKLVLNISVGESGDRLTRAAKVLEQLSGQSPVFSKARYTVRSFGIRRNEKIACYVTVRGEKAMQLLESGLKVKEYELLRRNFSATGCFGFGIQEHIDLGIKYDPSTGIYGMDFYVVLERAGYRVARRRRCKSRVGIQHRVTKEDAMKWFQVKYEGVILNKAQNIHTA

SEQ ID NO: 12239 - protein, 183 aa, Eutrema halophilum
MQASEKKLSNPMRDIKVQKLVLNISVGESGDRLTRASKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVARRRRCKARVGIQHRVTKDDAMKWFQVKYEGVILNKSQNITG

SEQ ID NO: 12240 - protein, 182 aa, Eutrema parvulum
MASEKKLSNPMRDIKVQKLVLNISVGESGDRLTRASKVLEQLSGQIPVFSKARYTVRSFGIRRNEKIACHVTVRGDKAMQLLESGLKVKEYELLRRNFSDTGCFGFGIQEHIDLGIKYDPSTGIYGMDFYVVLERPGYRVARRRRCKARVGIQHRVTKDDAMKWFQVKYEGVILNKSQNITG

SEQ ID NO: 12241 - protein, 162 aa, Fagopyrum esculentum
MATKDKKLSNPMRDIKVQKLVLNISVGESGDRLTRASKVLEQLSGQTPVFSKARYTVRSFGIRRNEKIACYVTVRGDKAMQLLESGLKVKEYELLRRNFSDTGCFGFGIQEHIDLGSSTIHLPVSMVWTSTWCWSAQDTVLLVDADASPVLEFSTELLRMMP

SEQ ID NO: 12242 - protein, 74 aa, Picea glauca
GLGGSISRSRRRSSRESSKMAAEKKLNNPMREIKVQKLVLNISVGESGDRLTRASKVLEQLSRQTPVFPRQGIL

SEQ ID NO: 12243 - protein, 74 aa, Picea glauca
GLGGCISRSRRRSSRASSKMAAEKKLNNPMREIKVQKLVLNISVGESGDRLTRASKVLEQLSGQTPVFPRQGTL

SEQ ID NO: 12244 - protein, 181 aa, Unknown
  Sequence found in Organisms: Pennisetum glaucum, Cenchrus ciliaris, Setaria italica
MASEKKQANPMREIKVQKLVLNISVGESGDRLTRAAKVLEQLSGQSPVFSKARYTVRSFGIRRNEKIACYVTVRGEKAMQLLESGLKVKEYELLRRNFSETGCFGFGIQEHIDLGIKYDPSTGIYGMDFYVVLERAGYRVARRRRCKSRVGIQHRVTKEDAMKWFQVKYEGVILNKAQANS

SEQ ID NO: 12245 - protein, 171 aa, Medicago truncatula
MRDIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKARVGIQHRVTKDDSMKWFQVKYEGVILNKSQAIV

SEQ ID NO: 12246 - protein, 171 aa, Medicago truncatula
MREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKARVGIQHRVTKDDAMKWFQVKYEGVILNKSQAIV

SEQ ID NO: 12247 - protein, 180 aa, Cedrus atlantica
MMSEKRLSNPMREIKVQKLVLNISVGESGDRLTRASKVLEQLSGQTPVFSKARYTVRSFGIRRNEKIACYVTVRGEKALQLLESGLKVKEYELLRRNFSDTGCFGFGIQEHIDLGIKYDPSTGIYGMDFFVVLERPGYRIGRRKRAQSRVGIQHRVTKEDAMKWFQVKYEGVILNKSQNI

SEQ ID NO: 12248 - protein, 181 aa, Capsicum annuum
MASENKLNNPMRDIKVQKLVLNISVGESGDRLTRAAKVLEQLSGQSPVFSKARYTVRSFGIRRNEKIACYVTVRGEKAMQLLESGLKVKEYELLRRNFSETGCFGFGIQEHIDLGIKYDPSTGIYGMDFYVVLERPGYRVARRRRCKSRVGIQHRVTKEDAMKWFQVKYEGVILNKSSNIQ

SEQ ID NO: 12249 - protein, 181 aa, Physcomitrella patens
MASEKKQQNSMREIKVQKLVLNISVGESGDRLTRASKVLEQLSGQSPVFSKARYTVRSFGIRRNEKIACYVTVRGEKAMQLLESGLKVKEYELLRRNFSESGCFGFGIQEHIDLGIKYDPSTGIYGMDFYVVLERPGYRVGRRRRAKSRVGIQHRVTKEDAMKWFQVKYEGVILNKSQAIA

SEQ ID NO: 12250 - protein, 180 aa, Picea glauca
MAAEKKLNNPMRDIKVQKLVLNISVGESGDRLTRASKVLEQLSGQTPVFSKARYTVRSFGIRRNEKIACYVTVRGEKALQLLESGLKVKEYELLRRNFSDTGCFGFGIQEHIDLGIKYDPSTGIYGMDFFVVLERPGYRIGRRKRAQSRVGIQHRVTKDDAMKWFQVKYEGVILNKSQNI

SEQ ID NO: 12251 - protein, 179 aa, Tamarix hispida
MASERKLANPMREIKVQKLVLNISVGESGDRLTRAAKVLEQLSGQSPVFSKARYTVRSFGIRRNEKIACYVTVRGEKAMQLLESGLKVKEYELLRRNFSDTGCFGFGIQEHIDLGIKYDPSTGIYGMDFYVVLERPGYRVGRRRRCKSRVGIQHRVTKDDAMKWYQMKYEGVILNKSQN

SEQ ID NO: 12252 - protein, 67 aa, Ambrosia trifida
SSSSTSAASAAMAFRKKTKKTPMREIKVLKLVLNISVGESGDRLTRAAKVLEQLSGQSPVSPRQGTL

SEQ ID NO: 12253 - protein, 180 aa, Abies balsamea
MTTEKRLNNSMREIKVQKLVLNISVGESGDRLTRASKVLEQLSGQTPVFSKARYTVRSFGIRRNEKIACYVTVRGEKALQLLESGLKVKEYELLRRNFSDTGCFGFGIQEHIDLGIKYDPSTGIYGMDFFVVLERPGYRVGRRKRAQSRVGIQHRVTKEDAMKWFQVKYEGVILNKSQNI

SEQ ID NO: 12254 - protein, 172 aa, Antirrhinum majus
MREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSRVGIQHRVTKEDSMKWFQVKYEGVILNKSNAIGA

SEQ ID NO: 12255 - protein, 182 aa, Beta vulgaris
MAPEKKLSNPMRDIKVQKLVLNISVGESGDRLTRAAKVLEQLSGQTPVYSKARYTVRSFGIRRNEKIACYVTVRGEKAMQLLESGLKVKEYELLRRNFSDTGCFGFGIQEHIDLGIKYDPSTGIYGMDFYVVLERPGYRVARRRRCKARVGIQHRVTKDDAMKWFQVKYEGVILNKAHNIGS

SEQ ID NO: 12256 - protein, 182 aa, Chelidonium majus
MAAEKKLLNPMREIKVQKLVLNISVGESGDRLTRAAKVLEQLSGQSPVFSKARYTVRSFGIRRNEKIACHVTVRGEKAMQLLESGLKVKEYELLRKNFSDTGCFGFGIQEHIDLGIKYDPSTGIYGMDFYVVLERPGYRVGRRRRCKAKVGIQHRVKKDDAMKWFQVKYEGVILNKSQNITG

SEQ ID NO: 12257 - protein, 181 aa, Cycas rumphii
MASEKKLNNPMREIKVQKLVLNISVGESGDRLTRAAKVLEQLSGQTPVFSKARYTVRSFGIRRNEKIACYVTVRGDKALQLLESGLKVKEYELLRRNFSETGCFGFGIQEHIDLGIKYDPSTGIYGMDFYVVLERPGYRIARRKRAKARVGIQHRVTKEDAMKWFQVKYEGVILNKSQSTT

SEQ ID NO: 12258 - protein, 183 aa, Flaveria ramosissima
MASERKQANPMREIKVQKLVLNISVGESGDRLTRAAKVLEQLSGQSPVFSKARYTVRIVLAIRRNEKIACYVTVRGDKAMQLLESGLKVKEYELLRRNFSDTGCFGFGIQEHIDLGIKYDPSTGIYGMDFFVVLERPGYRVGRRRRCKARVGIQHRVTKEDAMKWFQVKYEGVILNKSQQIGA

SEQ ID NO: 12259 - protein, 182 aa, Gnetum gnemon
MASERKLNNPMREIKVQKLVLNISVGESGDRLTRAAKVLEQLSGQTPVFSKARYTVRSFGIRRNEKIACYVTVRGEKALQLLESGLKVKEYELLRRNFSETGCFGFGIQEHIDLGIKYDPSTGIYGMDFYVVLERPGYRVCRRKRAKSRVGIQHRVTKEDAMKWFQVKYEGVILNKSQNIGP

SEQ ID NO: 12260 - protein, 182 aa, Mesembryanthemum crystallinum
  misc_feature (162)..(162): Xaa can be any naturally occurring amino acid
MASEKKLANPMRDIKVQKLVLNISVGESGDRLTRAAKVLEQLSGQSPVFSKARYTVRSFGIRRNEKIACYVTVRGEKAMQLLESGLKVKEYELLRRNFSDTGCFGFGIQEHIDLGIKYDPSTGIYGMDFYVVLERPGYRVGRRRRCKSRVGIQHRVTKDDAXKWFQVKYEGVILNKAQNVGA

SEQ ID NO: 12261 - protein, 181 aa, Pennisetum glaucum
MASEKKQANPMREIKVQKLVLNISVGESGDRLTRAAKVLEQLSGQSPVFSKARYTVRSFGIRRNEKIACYVTVRGEKAMQLLESGLKVKEYELLRRNFSETGCFGFGIQEHIDLGIKYDPSTGIYGMDFYVVLERAGYRVARRRRCKARVGIQHRVTKEDAMKWFQVKYEGVILNKAQANS

SEQ ID NO: 12262 - protein, 181 aa, Physcomitrella patens
MASEKKQQNLMREIKVQKLVLNISVGESGDRLTRASKVLEQLSGQSPVFSKARYTVRSFGIRRNEKIACYVTVRGEKAMQLLESGLKVKEYELLRRNFSESGCFGFGIQEHIDLGIKYDPSTGIYGMDFYVVLERPGYRVGRRRRAKSRVGIQHRVTKEDAMKWFQVKYEGVILNKSNAIA

SEQ ID NO: 12263 - protein, 181 aa, Physcomitrella patens
MASEKKMQNSMREIKVQKLVLNISVGESGDRLTRASKVLEQLSGQSPVFSKARYTVRSFGIRRNEKIACYVTVRGEKAMQLLESGLKVKEYELLRRNFSESGCFGFGIQEHIDLGIKYDPSTGIYGMDFYVVLERPGYRVGRRRRAKSRVGIQHRVTKEDAMKWFQVKYEGVILNKSQQIA

SEQ ID NO: 12264 - protein, 181 aa, Physcomitrella patens
MASEKKSQNSMREIKVQKLVLNISVGESGDRLTRASKVLEQLSGQSPVFSKARYTVRSFGIRRNEKIACYVTVRGEKAMQLLESGLKVKEYELLRRNFSESGCFGFGIQEHIDLGIKYDPSTGIYGMDFYVVLERPGYRVGRRRRAKSRVGIQHRVTKEDAMKWFQVKYEGVILNKSQQIA

SEQ ID NO: 12265 - protein, 182 aa, Pteridium aquilinum
MAVSEKKAANPMREIKVQKLVLNISVGESGDRLTRAAKVLEQLSGQTPVFSKARYTVRSFGIRRNEKIACYVTVRGAKAMQLLESGLKVKEYELIRKNFSDTGCFGFGIQEHIDLGIKYDPSTGIYGMDFYVVLERAGYRVGRRKRAKTRVGIQHRVTKEDAMKWFQVKYEGVILNKSQAIN

SEQ ID NO: 12266 - protein, 182 aa, Oryza sativa
MASEKKQSNPMREIKVQKLVLNISVGESGDRLTRASKVLEQLSGQSPVFSKARYTVRSFGIRRNEKIACYVTVRGEKAMQLLESGLKVKEYELLRRNFSETGCFGFGIQEHIDLGIKYDPSTGIYGMDFYVVLERAGYRVARRRRCKSRVGIQHRVTKEDAMKWFQVKYEGVILNKAQANTS

SEQ ID NO: 12267 - protein, 182 aa, Panicum virgatum
MASEKKQLNPMREIKVQKLVLNISVGESGDRLTRAAKVLEQLSGQSPVFSKARYTVRSFGIRRNEKIACYVTVRGEKAMQLLESGLKVKEYELLRRNFSETGCFGFGIQEHIDLGIKYDPSTGIYGMDFYVVLERAGYRVARRRRCKSRVGIQHRVTKEDAMKWFQVKYEGVILNKAQANTS

SEQ ID NO: 12268 - protein, 212 aa, Cryptomeria japonica
  misc_feature (2)..(2): Xaa can be any naturally occurring amino acid
VXIRGLFSSFWIVRTLDVCFTGEEDSAKVKSLMADKLKNPMREIKVQKLVLNISVGESGDRLTRAAKVLEQLSGQTPVFSKARYTVRSFGIRRNEKIACYVTVRGEKAMQLLESGLKVKEYELLRRNFSDTGCFGFGIQEHIDLGIKYDPSTGIYGMDFFVVLERPGYRISRRKRAVSRVGIQHRVTKDDSMKWFQNKYEGVILNKSQNITG

SEQ ID NO: 12269 - protein, 75 aa, Sequoia sempervirens
MREIKVQKLVLNISVGESGDRLTRAAKVLEQLSGQTPVFSKARYTVRSFGIRRNEKIACYVTVRGEKLCSFWRAD

SEQ ID NO: 12270 - protein, 172 aa, Panax ginseng
MREIKVQKLVLNISVGESGDRLTRASKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKSRVGIQHRVTKEDAMKWFQVKYEGVILNKSQNIGG

SEQ ID NO: 12271 - protein, 182 aa, Chenopodium quinoa
MAPEKKLSNPMRDIKVQKLVLNISVGESGDRLTRAAKVLEQLSGQTPVYSKARYTVRSFGIRRNEKIACHVTVRGDKAMQLLESGLKVKEYELLRRNFSETGCFGFGIQEHIDLGIKYDPSTGIYGMDFYVVLERPGYRVARRRRCKARVGIQHRVTKDDAMKWFQVKYEGVILNKAQNLSA

SEQ ID NO: 12272 - protein, 172 aa, Antirrhinum majus
MREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKARVGIQHRVTKEDSMKWFQVKYEGVILNKSNAIGA

SEQ ID NO: 12273 - protein, 183 aa, Coffea canephora
MASEKKLNNPMREIKVQKLVLNISVGESGDRLTRAAKVLEQLSGQSPVFSKARYTVRSFGIRRNEKIACYVTVRGDKAMQLLESGLKVKEYELLKRNFSETGCFGFGIQEHIDLGIKYDPSTGIYGMDFYVVLERPGYRVARRRRCKSRVGIHQRVTKEDAMKWFQVKYEGVILNKAQNIQTA

SEQ ID NO: 12274 - protein, 172 aa, Platanus occidentalis
MREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSRVGIQHRVTKEDAMKWFQVKYEGVILNKSQNITG

SEQ ID NO: 12275 - protein, 182 aa, Unknown
  Sequence found in Organisms: Oryza sativa, Panicum virgatum
MASEKKQANPMREIKVQKLVLNISVGESGDRLTRASKVLEQLSGQSPVFSKARYTVRSFGIRRNEKIACYVTVRGEKAMQLLESGLKVKEYELLRRNFSETGCFGFGIQEHIDLGIKYDPSTGIYGMDFYVVLERAGYRVARRRRCKSRVGIQHRVTKEDAMKWFQVKYEGVILNKAQANTS

SEQ ID NO: 12276 - protein, 182 aa, Euphorbia esula
  misc_feature (53)..(53): Xaa can be any naturally occurring amino acid
  misc_feature (92)..(92): Xaa can be any naturally occurring amino acid
  misc_feature (95)..(95): Xaa can be any naturally occurring amino acid
  misc_feature (110)..(110): Xaa can be any naturally occurring amino acid
MASERKLSNPMREIKVQKLVLNISVGESGDRLTRASKVLEQLSGQTPVFSKAXYTVRSFGIRRNEKIACYVTVRGDKAMQLLESGLKVKEYXLLXRNFSDTGCFGFGIQXHIDLGIKYDPSTGIYGMDFFVVLERPGYRVGRRKRCKSRVGIHQRVTKEDAMKWFQVKYEGVILNKAQNIGA

SEQ ID NO: 12277 - protein, 183 aa, Utricularia gibba
MGSEKKLTNPMRDIKVQKLVLNISVGESGDRLTRAAKVLEQLSGQTPVFSKARYTVRSFGIRRNEKIACYVTVRGEKAMQLLESGLKVKEYELLRRNFSETGCFGFGIQEHIDLGIKYDPSTGIYGMDFYVVLERPGYRVGRRRRCKSRVGIQHRVTKDDAMKWFQVKYEGVILNKASNIGAS

SEQ ID NO: 12278 - protein, 151 aa, Musa acuminata
PPLPLQDSEKKLSNPMREIKVQKLVLNISVGESGDRLTRAAKVLEQLSGQTPVFSKVRYTVRSFGIRRNEKIACYVTVRGDKATQLLESGLKVKEYELLRRNFSDTGCFGFGIQEHIDLGIKYDPSTGIYGMDFYVVLERAGYLVAADASH

SEQ ID NO: 12279 - protein, 171 aa, Lupinus angustifolius
MREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKARVGIQHRVTKEDAMKWFQVKYEGVILNKSQNIS

SEQ ID NO: 12280 - protein, 171 aa, Medicago truncatula
MRDMKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKARVGIQHRVTKDDAMKWFQVKYEGVILNKSQAIV

SEQ ID NO: 12281 - protein, 179 aa, Distylium racemosum
MAADKLKNPMREIKVQKLVLNISVGESGDRLTRAAKVLEQLSGQTPVFSKARYTVRSFGIRRNEKIACYVTVRGDKAMQLLESGLKVKEYELLRRNFSETGCFGFGIQEHIDLGIKYDPSTGIYGMDFYVVLERPGYRIARRKRCKSRVGIDHRVIKEDAMKWFQNKYEGVILNKSQSS

SEQ ID NO: 12282 - protein, 181 aa, Petunia hybrida
MASEKKLNNPMRDIKVQKLVLNISVGESGDRLTRAAKVLEQLSGQSPVFSKARYTVRSFGIRRNEKIACYVTVRGEKAMQLLESGLKVKEYELLRRNFSETGCFGFGIQEHIDLGIKYDPSTGIYGMDFYVVLERPGYRVARRRRCKSRVGIHQRVTKDDAMKWFQVKYEGVILNKSSNIQ

SEQ ID NO: 12283 - protein, 171 aa, Primula obconica
MREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKARVGIQHRVTKEDSMKWFQVKYEGVILNKAQTIG

SEQ ID NO: 12284 - protein, 180 aa, Zostera marina
MASERKLQNPMREIKVQKLVLNISVGESGDRLTRASKVLEQLSGQSPVFSKARFTVRSFGIRRNEKIACHVTVRGEKAMQLLESGLKVKEYELLRKNFSDTGCFGFGIQEHIDLGIKYDPSTGIYGMDFFVVLERPGYRVARRRRCKARVGIQHRVTKDDAMKWFQVKYEGVILNKSQNI

SEQ ID NO: 12285 - protein, 88 aa, Picea glauca
MRDIKVQKLVLNISVGESGDRLTRASKVLEQLSGQTPVFSKARYTVRSFGIRRNEKIACYVTVRGEKALQLLESGLKVKEYELTPKEL

SEQ ID NO: 12286 - protein, 172 aa, Gossypium raimondii
MREIKVQKLVLNISVGESGDRLTRAAKVLEQLSGQTPVFSKARYTVRSFGIRRNEKIACYVTVRGEKAMQLLESGLKVKEYELLRRNFSDTGCFGFGIQEHIDLGIKYDPSTGIYGMDFYVVLERAGYRVGRRRRCKSRVGIQHRVTKEDSMKWFQVKYEGVILNKSQNIGA

SEQ ID NO: 12287 - protein, 171 aa, Lupinus angustifolius
MREIKVQKLVLNISVGESGDRLTRAAKVLEQLSGQTPVFSKARYTVRSFGIRRNEKIACYVTVRGDKATQLLESGLKVKEYELLRRNFSDTGCFGFGIQEHIDLGIKYDPSTGIYGMDFYVVLERPGYRVGRRRRCKARVGIQHRVTKEDAMKWFQVKYEGVILNKSQNIS

SEQ ID NO: 12288 - protein, 172 aa, Unknown
  Sequence found in Organisms: Ambrosia trifida, Arnica chamissonis, Artemisia annua, Flaveria ramosissima, Helianthus annuus
MREIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKARVGIQHRVTKEDAMKWFQVKYEGVILNKSQQIGA

SEQ ID NO: 12289 - protein, 181 aa, Cephalotaxus harringtonia
MASDKLKNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRISRRKRAVSRVGIQHRVTKDDAMKWFQNKYEGVILNKSQNITG

SEQ ID NO: 12290 - protein, 182 aa, Ceratodon purpureus
MASEKKQQNSMRDIKVQKLVLNISVGESGDRLTRASKVLEQLSGQSPVFSKARYTVRSFGIRRNEKIACYVTVRGEKAMQLLESGLKVKEYELLRRNFSESGCFGFGIQEHIDLGIKYDPSTGIYGMDFYVVLERPGYRVGRRRRAKSRVGIQHRVTKEDAMKWFQVKYEGVILNKSQNITG

SEQ ID NO: 12291 - protein, 182 aa, Ceratodon purpureus
MASEKKMQNSMRDIKVQKLVLNISVGESGDRLTRASKVLEQLSGQSPVFSKARYTVRSFGIRRNEKIACYVTVRGEKAMQLLESGLKVKEYELLRRNFSESGCFGFGIQEHIDLGIKYDPSTGIYGMDFYVVLERPGYRVGRRRRAKSRVGIQHRVTKEDAMKWFQVKYEGVILNKSQNITG

SEQ ID NO: 12292 - protein, 182 aa, Ceratodon purpureus
MASEKKQQNCMRDIKVQKLVLNISVGESGDRLTRASKVLEQLSGQSPVFSKARYTVRSFGIRRNEKIACYVTVRGEKAMQLLESGLKVKEYELLRRNFSESGCFGFGIQEHIDLGIKYDPSTGIYGMDFYVVLERPGYRVGRRRRAKSRVGIQHRVTKEDAMKWFQVKYEGVILNKSQNITG

SEQ ID NO: 12293 - protein, 179 aa, Distylium racemosum
MASDKLKNPMREIKVQKLVLNISVGESGDRLTRAAKVLEQLSGQTPVFSKARYTVRSFGIRRNEKIACFVTVRGDKAMQLLESGLKVKEYELLRRNFSDTGCFGFGIQEHIDLGIKYDPSTGIYGMDFFVVLERPGYRISRRKRCTSRVGIEHRVTKDDAMKWFQNKYEGVILNKSQSN

SEQ ID NO: 12294 - protein, 172 aa, Flaveria ramosissima
MREIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKARVGIQHRVTKEDAMKWFQVKYEGVILNKSQKIGA

SEQ ID NO: 12295 - protein, 172 aa, Platanus occidentalis
MREIKVQKLVLNISVGESGDRLTRAAKVLEQLSGQTPVFSKARYTVRSFGIRRNEKIACYVTVRDDKAMQLLESGLKVKEYELLRRNFSDTGCFGFGIQEHIDLGIKYDPSTGIYGMDFYVVLERPGYRVGRRRRCKSRVGIQHRVTKEDAMKWFQVKYEGVILNKSQNITG

SEQ ID NO: 12296 - protein, 180 aa, Podocarpus macrophillus
MSSDKLKNPMREIKVQKLVLNISVGESGDRLTRASKVLEQLSGQTPVFSKARYTVRSFGIRRNEKIACYVTVRGEKAMQLLESGLKVKEYELLRRNFSDTGCFGFGIQEHIDLGIKYDPSTGIYGMDFYVVLERPGYRISRRKRCKSRVGIKHRVTKEDSMKWFQNKYEGVILNKSQSNT

SEQ ID NO: 12297 - protein, 171 aa, Juglans hindsii x Juglans regia
MREIKVQKLVLNISVGESGDRLTRAAKVLEQLSGQNPVFSKARYTVRSFGIRRNEKIACYVTVRGDKAMQLLESGLKVKEYELLRRNFSDTGCFGFGIQEHIDLGIKYDPSTGIYGMDFYVILERPGYRVGRRRRCKSRVGIQHRVTKEDAMKWFQVKYEGVILNKSQNIT

SEQ ID NO: 12298 - protein, 181 aa, Zamia vazquezii
MASEKKLNNPMREIKVQKLVLNISVGESGDRLTRAAKVLEQLSGQAPVFSKARYTVRSFGIRRNEKIACYVTVRGEKALQLLESGLKVKEYELLRRNFSDTGCFGFGIQEHIDLGIKYDPSTGIYGMDFYVVLERPGYRICRRKRAKARVGIKHRVTKEDAMKWFQVKYEGVILNKSQSTT

SEQ ID NO: 12299 - protein, 172 aa, Unknown
  Sequence found in Organisms: Centaurea maculosa, Cichorium intybus
MREIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKARVGIQHRVTKDDAMKWFQVKYEGVILNKSQQIGG

SEQ ID NO: 12300 - protein, 171 aa, Echinacea purpurea
REIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKARVGIQHRVTKEDAMKWFQVKYEGVILNKSQQIGG

SEQ ID NO: 12301 - protein, 172 aa, Gossypium raimondii
MREIKVQKLVLNISVGESGDRLTRAAKVLEQLSGQTPVFSKARYTVRSFGIRRNEKIACYVTVRGEKAMQLLESGLKVKEYELLRRNFSDTGCFGFGIQEHIDLGIKYDPSTGIYGMDFYVVLERAGYRVGRRRRCKSRVGIQHRVTKEDAMKWFQVKYEGVILNKSQNIGA

SEQ ID NO: 12302 - protein, 182 aa, Ceratodon purpureus
MASERKQQNCMRDIKVQKLVLNISVGESGDRLTRASKVLEQLSGQSPVFSKARYTVRSFGIRRNEKIACYVTVRGEKAMQLLESGLKVKEYELLRRNFSESGCFGFGIQEHIDLGIKYDPSTGIYGMDFYVVLERPGYRVGRRRRAKSRVGIQHRVTKEDAMKWFQVKYEGVILNKSQNITG

SEQ ID NO: 12303 - protein, 181 aa, Cryptomeria japonica
MALDKLKNPMREMKVQKLVLNISVGESGDRLTRAAKVLEQLSGQTPVFSKARYTVRSFGIRRNEKIACYVTVRGEKAMQLLESGLKVKEYELLRRNFSDTGCFGFGIQEHIDLGIKYDPSTGIYGMDFFVVLERPGYRISRRKRAVSRVGIQHRVTKDDAMKWFQNKYEGVILNKSQNITG

SEQ ID NO: 12304 - protein, 172 aa, Flaveria ramosissima
MREIKVQKLVLNISVGESGDRLTRAAKVLEQLSGQSPVFSKAGYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKARVGIQHRVTKEDAMKWFQVKYEGVILNKSQQIGA

SEQ ID NO: 12305 - protein, 183 aa, Vitis vinifera
MASERKLANPMRDIKVQKLVLNISVGESGDRLTRAAKVLEQLSGQSPVFSKARYTVRSFAIRRNEKIACYVTVRGEKAMQLLESGLKVKEYELLRRNFSDTGCFGFGIQEHIDLGIKYDPSTGIYGMDFYVVLERPGYRVGRRRRCKARVGPHHRVTKDDAMKWFQVKYEGVILNKAQNIVGS

SEQ ID NO: 12306 - protein, 181 aa, Taxus baccata
MAADKLKNPMREIKVQKLVLNISVGESGDRLTRASKVLEQLSGQTPVFSKARYTVRSFGIRRNEKIACYVTVRGEKAMQLLESGLKVKEYELLRRNFSDTGCFGFGIQEHIDLGIKYDPSTGIYGMDFYVVLERPGYRISRRKRAVSRVGIQHRVTKDDAMKWFQNKYEGVILNKSQNITG

SEQ ID NO: 12307 - protein, 88 aa, Catharanthus roseus
MASEKKLNNPMREIKVQKLVLNISVGESGDRLTRAAKVLEQLSGQSPVFSKARYTVRSFGIRRNEKIACYVTVRGEKAMQLLESWFKS

SEQ ID NO: 12308 - protein, 150 aa, Zea mays
MLNPNTGLAPPAARDAIASTLKHDVEVHPIDAYGAVLDTKVDVLLDAEPEAAGVAEVPPEQLVLLDLEAALKQLHGLVAPDRDVAGDLLVTPDAERAHPPTLGEDGGLAAELLQHLGGAGEAVAALPYGYVEDQLLHLDLPHRVGLLLLG

SEQ ID NO: 12309 - protein, 171 aa, Lupinus angustifolius
MREIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKARVGIQHRVTKDDAMKWFQVKYEGVILNKSQQIS

SEQ ID NO: 12310 - protein, 170 aa, Populus trichocarpa
MREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSRVGIHQRVTKDDAMKWFQVKYEGVILNKSQNI

SEQ ID NO: 12311 - protein, 180 aa, Unknown
  Sequence found in Organisms: Pseudoroegneria spicata, Secale cereale, Triticum aestivum
MSTEKKQLNPMREIKVQKLVLNISVGESGDRLTRAAKVLEQLSGQSPVFSKARYTVRSFGIRRNEKIACYVTIRGEKAMQLLESGLKVKEYELLRRNFSDTGCFGFGIQEHIDLGMKYDPSTGIYGMDFFVVLERAGYRVSRRRRCKARVGIHQRVTKEDAMKWFQVKYEGVILNKSHAS

SEQ ID NO: 12312 - protein, 182 aa, Panax ginseng
MASERKLANPMREIKVKKLVLNISVGESGDRLTRASKVLEQLSGQTPVFSKARYTVRSFAIRRNEKIACYVTVRGDKAMQLLDSGLKVKEYELYRKNFSDSGCFGFGIPEHIDLGIKYDPSTGIYGMDFYVVLERPGYRVGRRRKCKSRVGIQHRVAKEDAMKWFQVKYEGVILNKSQNIGN

SEQ ID NO: 12313 - protein, 172 aa, Aquilegia formosa
MREIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSRIGIQHRVTKDDAMKWFQVKYEGVILNKSQNITG

SEQ ID NO: 12314 - protein, 172 aa, Musa acuminata
MREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERAGYRVARRRRCKSRVGIQHRVTKEDAMKWFQVKYEGVILNKSQSSTV

SEQ ID NO: 12315 - protein, 180 aa, Hordeum vulgare
MSTEKKQLNTMREIKVQKLVLNISVGESGDRLTRAAKVLEQLSGQSPVFSKARYTVRSFGIRRNEKIACYVTIRGEKAMQLLESGLKVKEYELLRRNFSDTGCFGFGIQEHIDLGMKYDPSTGIYGMDFFVVLERAGYRVSRRRRCKARVGIHQRVTKEDAMKWFQVKYEGVILNKSHAS

SEQ ID NO: 12316 - protein, 191 aa, Fagus grandifolia
MASEKKLSNPMREIKVQKLVLNISVGESGDRLTRAAKVLEQLSGQNPVFSKARYTVRSFGIRRNEKIACYVTVRGEKAMQLLESGLKVKEYELLRRNFSDTGCFGFGIQEHIDLGIKYDPSTGIYGMDFFVVLERPGYRVGRRRRCKSRVGIQHRVTKDDAMKWFQVKYEGVILNKSTKHHKLILEDFDLG

SEQ ID NO: 12317 - protein, 180 aa, Brachypodium distachyon
MSTEKKQLNPMREIKVQKLVLNISVGESGDRLTRASKVLEQLSGQSPVFSKARYTVRSFGIRRNEKIACYVTVRGEKAMQLLESGLKVKEYELLRRNFSDTGCFGFGIQEHIDLGMKYDPSTGIYGMDFYVVLERAGYRVSRRRRCKARVGIHQRVTKEDAMKWFQVKYEGVILNKSHAS

SEQ ID NO: 12318 - protein, 172 aa, Bupleurum chinense
MREIKVQKLVLNISVGESGDRLTRASKVLEQLSGQMPVFSKARYTVRSFGIRRNEKIACYVTVRGDKAMQLLESGLKVKEYELLRKNFSDTGCFGFGIQEHIDLGIKYDPSTGIYGMDFYVVLERPGYRVGRRRRCKSRVGIQHRVTKEDAMKWFQVKYEGVILNKSQNIGN

SEQ ID NO: 12319 - protein, 172 aa, Hevea brasiliensis
MREIKVQKRVLNISVGESGDRLTRAAKVLEQLSGQAPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSRVGIQHRVTKEDAMKWFQVKYEGVILNKAQTIGA

SEQ ID NO: 12320 - protein, 170 aa, Ipomoea batatas
MREIKVQKLVLNISVGESGDRLTRAAKVLEQLSGQTPVFSKARYTVRSFGIRRNEKIACYVTVRGDKAMQLLESGLKVKEYELLRRNFSDTGRFGFGIQEHIDLGIKYDPSTGIYGMDFFVVLERPGYRVARRRRCKARVGIQHRVTKEDAMKWFQVKYEGVILNKASNI

SEQ ID NO: 12321 - protein, 180 aa, Avena sativa
MSTEKKQSNPMREIKVQKLVLNISVGESGDRLTRASKVLEQLSGQSPVFSKARYTVRSFGIRRNEKIACYVTIRGEKAMQLLESGLKVKEYELLRRNFSDTGCFGFGIQEHIDLGMKYDPSTGIYGMDFFVVLERAGYRVSRRRRCKARIGIHQRVTKEDAMKWFQVKYEGVILNKSHAS

SEQ ID NO: 12322 - protein, 104 aa, Sorghum bicolor
MQLLESGLKVKEYELLRRNFSETGCFGFGIQEHIDLGIKYDPSTGIYGMDFYVVLERAGYRVARRCRCKSRVGIQHIVTKEDAMKWFQVKYEGVILNKAQANTS

SEQ ID NO: 12323 - protein, 172 aa, Eschscholzia californica
MRDIKVQKLVLNISVGESGDRLTRAAKVLEQLSGQSPVFSKARYTVRSFGIRRNEKIACYVTVRGEKAMQLLESGLKVKEYELLRRNFSDTGCFGFGIQEHIDLGIKYDPSTGIYGMDFYVVLERPGYRVGRRRRCKSRVGIQHRVTKDDAMKWFQVKYEGVILNKSQNITG

SEQ ID NO: 12324 - protein, 172 aa, Papaver somniferum
MRDIKVQKLVLNISVGESGDRLTRAAKVLEQLSGQAPVFSKARYTVRSFGIRRNEKIACYVTVRGEKAMQLLESGLKVKEYELLRRNFSDTGCFGFGIQEHIDLGIKYDPSTGIYGMDFYVVLERPGYRVGRRRRCKSRVGIQHRVTKDDAMKWFQVKYEGVILNKSQNITG

SEQ ID NO: 12325 - protein, 172 aa, Camellia sinensis
MREIKVQKLVLNISVGESGDRLTRAAKVLEQLSGQTPVFSKARYTVRSFGIRRNEKIACFVTVRGEKAMQLLESGLKVKEYELLRRNFSETGCFGFGIQEHIDLGIKYDPSTGIYGMDFYAVLERPGYRVGRRRRCKSRIGIQHRVTKEDSMKWFQVKYEGVILNKSYAIGA

SEQ ID NO: 12326 - protein, 172 aa, Vinca minor
MREIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSRVGIHQRVTKDDAMKWFQVKYEGVILNKSQNITN

SEQ ID NO: 12327 - protein, 180 aa, Unknown
  Sequence found in Organisms: Festuca arundinacea, Avena sativa
MSTEKKQLNPMREIKVQKLVLNISVGESGDRLTRASKVLEQLSGQSPVFSKARYTVRSFGIRRNEKIACYVTIRGEKAMQLLESGLKVKEYELLRRNFSDTGCFGFGIQEHIDLGMKYDPSTGIYGMDFFVVLERAGYRVSRRRRCKARIGIHQRVTKEDAMKWFQVKYEGVILNKSHAS

SEQ ID NO: 12328 - protein, 170 aa, Setaria italica
MREIKVQKLVLNISVGESGDRLTRAAKVLEQLSGQSPVFSKARYTVRSFGIRRNEKIACYVTVRGEKAMQLLESGLKVKEYELLRRNFSDTGCFGFGIQEHIDLGIKYDPSTGIYGMDFYVVLERAGYRVARRRRCKSRVGIQHRVTKEDAMKWFQVKYEGVILNKAQAN

SEQ ID NO: 12329 - protein, 180 aa, Hordeum vulgare
MSTEKKQMNPMRDIKVQKLVLNISVGESGDRLTRASKVLEQLSGQSPVFSKARYTVRSFGIRRNEKIACYVTIRGEKAMQLLESGLKVKEYELLRRNFSDTGCFGFGIQEHIDLGMKYDPSTGIYGMDFFVVLERAGYRVSRRRRCKARVGIHQRVTKEDAMKWFQVKYEGVILNKSHAS

SEQ ID NO: 12330 - protein, 171 aa, Nicotiana benthamiana
MREIKVQKLVLNISVGESGDRLTRAAKVLEQLSGQSPVFSKARYTVRSFGIRRNEKIACYVTVRGEKAMQLLESGLKVKEYELLRRNFSETGCFGFGIQEHIDLGIKYDPSTGIYGMDFYVVLERPGYRVARRRRCKSRVGIQHRVTKEDAMKWFQVKYEGVILNKSSNIQ

SEQ ID NO: 12331 - protein, 184 aa, Secale cereale
MSTEKKQLNPMRDIKVQKLVLNISVGESGDRLTRASKVLEQLSGQSPVFSKARYTVRSFGIRRNEKIACYVTIRGEKAMQLLESGLKVKEYELLRRNFSDTGCFGFGIQEHIDLGMKYDPSTGIYGMDFFVVLERAGYRVSRRRRCKGPGRYPPEGHQGGRHEVVPGQVRGCHPQQVPCELRRT

SEQ ID NO: 12332 - protein, 180 aa, Sciadopitys verticillata
MASDKLKNPMREIKVQKLVLNISVGESGDRLTRAAKVLEQLSGQTPVFSKARYTVRSFGIRRNEKIACYVTVRGEKAMQLLESGLKVKEYELLRRNFSETGCFGFGIQEHIDLGIKYDPSTSIYGMDFYVVLERPGYSISRRKRSKSRVGIQHRVTKDDAMKWFQNKYEGVILNKSQSNT

SEQ ID NO: 12333 - protein, 180 aa, Triticum aestivum
MSTEKKQLNPMRDIKVQKLVLNISVGESGDRLTRASKVLEQLSGQSPVFSKARYTVRSFGIRRNEKIACYVTIRGEKAMQLLESGLKVKEYELLRRNFSDTGCFGFGIQEHIDLGMKYDPSTGIYGMDFFVVLERAGYRVSRRRRCKARVGIHQRVTKEDAMKWFQVKYEGVILNKSHAS

SEQ ID NO: 12334 - protein, 180 aa, Zostera marina
MAERKQSNPMREIKVQKLVLNISVGESGDRLTRASKVLEQLSGQSPVFSKARFTVRSFGIRRNEKIACHVTVRGEKAMQLIESGLKVKEYELLRKNFSDTGCFGFGIQEHIDLGIKYDPSTGIYGMDFYVVLERPGYRVARRRRAKARVGIQHRVTKDDAMKWFQVKYEGVILNKSQNIG

SEQ ID NO: 12335 - protein, 182 aa, Panax ginseng
MASERKLANPMREIKVQKLVLNISVGESGDRLTRASKVLEQLSGQTPVFSNARYTVRSFAIRRNEKIACYVTVRGDKAMQLLDSGLNVKECELYRKNFSDSGCFGFGIPEHIDLGIKYDPSTGIYGMDFYVVLERPGCRVGRRRKCKSRVGIQHRVTKEDAMKWFQVKYEGVILNKSQNIGN

SEQ ID NO: 12336 - protein, 171 aa, Setaria italica
MREIKVQKLVLNISVGESGDRLTRAAKVLEQLSGQSPVFSKARYTVRSFGIRRNEKIACYVTVRGEKAMQLLESGLKVKEYELLRRNFSETGCFGFGIQEHIDLGIKYDPSTGIYGMDFYVVLERAGYRVARRRRCKSRVGIQHRVTKEDAMKWFQVKYEGVILNKAQANS

SEQ ID NO: 12337 - protein, 172 aa, Unknown
  Sequence found in Organisms: Brassica napus, Brassica juncea
MRDIKVQKLVLNISVGESGDRLTRASKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVARRRRCKARVGIQHRVTKDDAMKWFQVKYEGVILNKSQNITG

SEQ ID NO: 12338 - protein, 182 aa, Ceratodon purpureus
MASDKKQQNCMRDIKVQKLVLNISVGESGDRLTRGSKVLEQLSGQSPVFSKARYTVRSFGIRRNEKIACYVTVRGEKAMQLLESGLKVKEYELLRRNFSESGCFGFGIQEHIDLGIKYDPSTGIYGMDFYVVLERPGYRVGRRRRAKSRVGIKHRVTREDAMKWFQVKYEGVILNKSQNITG

SEQ ID NO: 12339 - protein, 180 aa, Lolium multiflorum
MSTEKKQLNPMRDIKVQKLVLNISVGESGDRLTRASKVLEQLSGQSPVFSKARYTVRSFGIRRNEKIACYVTIRGEKAMQLLESGLKVKEYELLRRNFSDTGCFGFGIQEHIDLGMKYDPSTGIYGMDFFVVLERAGYRVSRRRRCKARIGIHQRVTKEDAMKWFQVKYEGVILNKSHAS

SEQ ID NO: 12340 - protein, 182 aa, Eragrostis curvula
  misc_feature (151)..(151): Xaa can be any naturally occurring amino acid
  misc_feature (154)..(154): Xaa can be any naturally occurring amino acid
  misc_feature (175)..(175): Xaa can be any naturally occurring amino acid
MASEKKQANPMREIKVQKLVLNISVGESGDRLTRAAKVLEQLSGQSPVFSKARYTVRSFGIRRNEKIACYVTVRGEKAMQLLESGLKVKEYELLRRNFSETGCIGFGIQEHIDLGIKYDPSTGIYGMDFYVVLERAGYRVARRRRCKARVXIQXRVTKEDAMKWFQVKYEGVILXKAQGNTS

SEQ ID NO: 12341 - protein, 171 aa, Nicotiana benthamiana
MREIKVQKLVLNISVGESGDRLTRAAKVLEQLSGQSPVFSKARYTVRSFGIRRNEKIACYVTVRGEKAMQLLESGLKVKEYELLRRNFSETGCFGFGIQEHIDLGIKYDPSTGIYGMDFYVVLERAGYRVARRRRCKSRVGIQHRVTKEDAMKWFQVKYEGVILNKSSNIQ

SEQ ID NO: 12342 - protein, 180 aa, Avena sativa
MSTEKKRANPMREIKVQKLVLNCSVGESGDRLTRAAKVLEQLSGQSPVFSKARYTVRSFGIRRNEKIACYVTVRGEKAMQLLESGLKVKEYELLRRNFSETGCFGFGIQEHIDLGMKYDPSTGIYGMDFYVVLERAGYRVSRRRRCKSRIGIHQRVTKEDAMKWFQVKYEGVILNKSHTA

SEQ ID NO: 12343 - protein, 180 aa, Avena sativa
MSTEKKQLNPMREIKVQKLVLNISVGESGDRLTRASKVLEQLSGQSPVFSKARYTVRSFGIRRNEKIACYVTIRGEKAMQLLESGLKVKEYELLRRNFSDTGCFGFGIQEHIDLGMKYDPSTGIYGMDFFVVLERAGYRVSRRRRCKARIGIHQRVTKEDAMKWFQVKYGGVILNKSHAS

SEQ ID NO: 12344 - protein, 171 aa, Capsicum annuum
MRDIKVQKLVLNISVGESGDRLTRAAKVLEQLSGQSPVFSKARYTVRSFGIRRNEKIACYVTVRGEKAMQLLESGLKVKEYELLRRNFSETGCFGFGIQEHIDLGIKYDPSTGIYGMDFYVVLERPGYRVARRRRCKSRVGIQHRVTKEDAMKWFQVKYEGVILNKSSNIQ

SEQ ID NO: 12345 - protein, 172 aa, Ananas comosus
MREIKVQKLVLNISVGESGDRLTRASKVLEQLSGQTPVFSKARYTVRSFGIRRNEKIACYVTVRGEKAMQLLESGLKVKEYELLRRNFSDTGCFGFGIQEHIDLGIKYDPSTGIYGMDFYVVLERPGYRVGRRRRCKSGVGIQHRVTKDDAMKWFQVRYEGVILNRSQAIAS

SEQ ID NO: 12346 - protein, 172 aa, Papaver somniferum
MRDIKVQKLVLNISVGESGDRLTRAAKVLEQLSGQAPVFSKARYTVRSFGIRRNEKIACYVTIRGEKAMQLLESGLKVKEYELLRRNFSDTGCFGFGVQEHIDLGIKYDPSTGIYGMDFYVVLERPGYRVGRRRRCKSRVGIQHRVTKEDAMKWFQVKYEGVILNKSQNIPC

SEQ ID NO: 12347 - protein, 170 aa, Sciadopitys verticillata
MREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRIARRKRAKSRVGIKHRVTKDDSMKWFQNKYEGVILNKSQNN

SEQ ID NO: 12348 - protein, 194 aa, Malus domestica
MVSWILWGVEMQASENKLANPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKSRVGIQHRVTKEDAMKWFQVKYEGVILNKSQQLSAS

SEQ ID NO: 12349 - protein, 173 aa, Catharanthus roseus
MREIKVQKLVLNISVGESGDRLTRAAKVLEQLSGQTPVFSKARYTVRSFGIRRNEKIACYVTVRGDKAMQLLESGLKVKEYELLKRNFSETGCFGFGIQEHIDLGIKYDPSTGIYGMDFYVVLERPGYRVARRRRCKSRVGIQHRVTKDDAMKWFQGKYEGVILNKSQNIQTA

SEQ ID NO: 12350 - protein, 172 aa, Fagopyrum esculentum
MRDIKVQKLVLNISVGESGDRLTRASKVLEQLSGQTPVFSKARYTVRSFGIRRNEKIACYVTVRGEKAMQLLESGLKVKEYELLRRNFSDTGCFGFGIQEHIDLGIKYDPSTGIYGMDFYVVLERPGYRVARRRRCKSRVGIQHRVTKDDAMKWFQMKYEGVILNKSQNITG

SEQ ID NO: 12351 - protein, 172 aa, Fagopyrum esculentum
MRDIKVQKLVLNISVGESGDRLTRASKVLEQLSGQSPVFSKARYTVRSFGIRRNEKIACYVTVRGDKAMQLLESGLKVKEYELLRRNFSDTGCFGFGIQEHIDLGIKYDPSTGIYGMDFYVVLERPGYRVARRRRCKSRVGIQHRVTKDDAMKWFQMKYEGVILNKSQNITG

SEQ ID NO: 12352 - protein, 172 aa, Adiantum capillus-veneris
MREIKVQKLVLNISVGESGDRLTRAAKVLEQLSGQTPVFSKARYTVRSFGIRRNEKIACYVTVRGAKAMQLLESGLKVKEYELIRRNFSDTGCFGFGIQEHIDLGIKYDPSTGIYGMDFYVVLERAGYRVGRRKRAKARVGIQHRVTKEDAMKWFQVKYEGVILNRSQAITN

SEQ ID NO: 12353 - protein, 172 aa, Adiantum capillus-veneris
MREIKVQKLVLNISVGESGDRLTRAAKVLEQLSGQTPVFSKARYTVRSFGIRRNEKIACYVTVRGSKAMQLLESGLKVKEYELIRRNFSDTGCFGFGIQEHIDLGIKYDPSTGIYGMDFYVVLERAGYRVGRRKRAKARVGIQHRVTKEDAMKWFQVKYEGVILNRSQAITN

SEQ ID NO: 12354 - protein, 170 aa, Brassica juncea
MRDIKVQKLVLNISVGESGDRLTRASKVFGQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVARRRRCKARVGIQHRVTKDDAMKWFQVKYEGVILNKSQNI

SEQ ID NO: 12355 - protein, 168 aa, Cirsium arvense
MASERKQANPMREIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKARVGIQHRVTKDDAMKWFQVK

SEQ ID NO: 12356 - protein, 171 aa, Nicotiana benthamiana
MREIKVQKLVLNISVGESGDRLTRAAKVLEQLSGQSPVFSKARYTVRSFGICRNEKIACYVTVRGDKAMQLLESGLKVKEYELLRRNFSETGCFGFGIQEHIDLGIKYDPSTGIYGMDFYVVLERPGYRVARRRRCKARVGIQHRVTKDDAMKWFQVKYEGVILNKSSNIQ

SEQ ID NO: 12357 - protein, 180 aa, Avena sativa
MSTEKKRANPMREIKVQKLVLNCSVGESGDRLTRAAKVLEQLSGQSPVFSKARYTVRSFGIRRNEKIACYVTVRGEKAMQLLESGLKVKEYELLRRNFSETGCFGFGIQEHIDLGMKYDPSTGIYGMDFYVVLERAGYRVSRRRRCKARIGIHQRVTKEDAMKWFQVKYEGVILNKSHTA

SEQ ID NO: 12358 - protein, 137 aa, Heritiera littoralis
VQKLVLNISVGESGDRLTRAAKVLEQLSGQTPVFSKARYTVRSFGIRRNEKIACYVTVRGEKAMQLLESGLKVKEYELLRRNFSDTGCFGFGIQEHIDLGIKYDPSTGIYGMDFYVVLERAGYRVGRRRRCKSRVGI

SEQ ID NO: 12359 - protein, 180 aa, Lolium multiflorum
MSTEKKQLNPMRDIKVQKLVLNISVGESGDRLTRASKVLEQLSGQSPVFSKARYTVRSFGIRRNEKIACYVTIRGEKAMQLLDSGLKVKEYELLRRNFSDTGCFGFGIQEHIDLGMKYDPSTGIYGMDFFVVLERAGYRVSRRRRCKARIGIHQRVTKEDAMKWFQVKYEGIILNKSHAG

SEQ ID NO: 12360 - protein, 180 aa, Festuca arundinacea
MSTEKKLANPMRDIKVQKLVLNISVGESGDRLTRASKVLEQLSGQSPVFSKARYTVRSFGIRRNEKIACYVTIRGEKAMQLLDSGLKVKEYELLRRNFSDTGCFGFGIQEHIDLGMKYDPSTGIYGMDFYVVLERAGYRVSRRRRCKARIGIHQRVTKEDAMKWFQVKYEGIILNKSHAS

SEQ ID NO: 12361 - protein, 165 aa, Flaveria ramosissima
KLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKARVGIQHRVTKEDAMKWFQVKYEGVILNKSQQIGA

SEQ ID NO: 12362 - protein, 186 aa, Selaginella moellendorffii
RPNLWRRCAMADKQNPMREIKVQKLVLNISVGESGDRLTRAAKVLEQLSGQQPVFSKARFTVRSFGIRRNEKIACYVTVRGDKAMQLLESGLKVKEYELLRRNFSDTGCFGFGIQEHIDLGIKYDPSTGIYGMDFFVVLERPGYRVARRRRCKSKVGHKQRVTKEDAMKWFQLKYEGVILNKSQAI

SEQ ID NO: 12363 - protein, 161 aa, Lolium multiflorum
MSTEKKQLNPMRDIKVQKLVLNISVGESGDRLTRASKVLEQLSGQSPVFSKARYTVRSFGIRRNEKIACYVTIRGEKAMQLLDSGLKVKEYELLRRNFSDTGCFGFGIQEHIDLGMKYDPSTGIYGMDFFVVLERSGYRVSRRRRCKARIGIHQRVTKETP

SEQ ID NO: 12364 - protein, 152 aa, Nicotiana benthamiana
MASEKKLSNPMREIKVQKLVLNISVGESGDRLTRAAKVLEQLSGQSPVFSKSRYIVRSFGICRNEKIACYVTIRGDKAMRLLESGLKVKEYELLRRNFCETGCFGFGIQEHIDLGIKYDSSTGIYGMDFYVVLQRPGYRVARRRRCNARVEI

SEQ ID NO: 12365 - protein, 173 aa, Vitis vinifera
MRDIKVQKLVLNISVGESGDRLTRAAKVLEQLSGQSPVFSKARYTVRSFAIRRNEKIACYVTVRGEKAMQLLESGLKVKEYELLRRNFSDTGCFGFGIQEHIDLGIKYDPSTGIYGMDFYVVLERPGYRVGRRRRCKARVGPHHRVTKDDAMKWFQVKYEGVILNKAQNIVGS

SEQ ID NO: 12366 - protein, 187 aa, Selaginella moellendorffii
SRPNLWRRCAMADKQNPMREIKVQKLVLNISVGESGDRLTRAAKVLEQLSGQQPVFSKARFTVRSFGIRRNEKIACYVTVRGDKAMQLLESGLKVKEYELLRRNFSDTGCFGFGIQEHIDLGIKYDPSTGIYGMDFFVVLERPGYRVARRRRCKSKVGHKQRVTKEDAMKWFQLKYEGVILNKSQAI

SEQ ID NO: 12367 - protein, 166 aa, Panax ginseng
MASEKKLLNPMREIKVQKLVLNISVGESGDRLTRASKVLEQLSSQTPVFSKARYTVRSFGIRRNEKIACYVTVRGDKAMQLLESGLKVKEYELLRRNFSDTGCFGFGIQEHIDLGIKYDPSTGIYGMVFLCCTCNVLVTVWDVVVDANLVLESSTRVTKGGCNEVV

SEQ ID NO: 12368 - protein, 170 aa, Brachypodium distachyon
MREIKVQKLVLNISVGESGDRLTRASKVLEQLSGQSPVFSKARYTVRSFGIRRNEKIACYVTVRGEKAMQLLESGLKVKEYELLRRNFSDTGCFGFGIQEHIDLGMKYDPSTGIYGMDFYVVLERAGYRVSRRRRCKARVGIHQRVTKEDAMKWFQVKYEGVILNKSHAS

SEQ ID NO: 12369 - protein, 180 aa, Lolium multiflorum
MSTEKKRANPMREIKVQKLVLNCSVGESGDRLTRASKVLEQLSGQSPVFSKARYTVRSFGIRRNEKIACYVTVRGEKAMQLLESGLKVKEYELLRRNFSETGCFGFGIQEHIDLGMKYDPSTGIYGMDFYVVLERAGYRVSRRRRCKARIGIHQRVTKEDAMRWFQAKYEGVILNKSHNA

SEQ ID NO: 12370 - protein, 180 aa, Festuca arundinacea
MSTEKKRANPMREIKVQKLVLNCSVGESGDRLTRASKVLEQLSGQSPVFSKARYTVRSFGIRRNEKIACYVTVRGEKAMQLLESGLKVKEYELLRRNFSETGCFGFGIQEHIDLGMKYDPSTGIYGMDFYVVLERAGYRVSRRRRCKARIGIHQRVTKEDAMRWFQAKYEGVILNKSHSA

SEQ ID NO: 12371 - protein, 162 aa, Lippia dulcis
MREIKVQKLVLNISVGESGDRLTRAAKVLEQLSGQSPGFSKARYTVRSFGIRRNEKIACYVTVRGDKAMQLLESGLKVKEYELLRRNFSETGCFGFGIQEHIDLGIKYDPSTGIYGMDFYVVLERPGYRVGRRRRCKARVGIQHRVTKEDAMKWFQVKYEGV

SEQ ID NO: 12372 - protein, 171 aa, Podocarpus macrophillus
MKEIKVQKLVLNISVGESGDRLTRASKVLEQLSGQTPVFSKARYTVRSFGIRRNEKIACYVTVRGEKAMQLLESGLKVKEYELLRRNFSDTGCFGFGIQEHIDLGIKYDPSTGIYGMDFYVVLERAGYRISRRKRCKSRVGIKHRVTKDDAMKWFQNKYEGVILNKSQSNT

SEQ ID NO: 12373 - protein, 170 aa, Pseudoroegneria spicata
MRDIKVQKLVLNISVGESGDRLTRASKVLEQLSGQAPVFSKARYTVRSFGIRRNEKIACYVTIRGEKAMQLLESGLKVKEYELLRRNFSDTGCFGFGIQEHIDLGMKYDPSTGIYGMDFFVVLERAGYRVSRRRRCKARVGIHQRVTKEDAMKWFQVKYEGVILNKSHAS

SEQ ID NO: 12374 - protein, 149 aa, Secale cereale
MREIKAQKLVLNISVGESGDRLTRAAKVLEQLSGQSPVFSKARYTVRSFGIRRNEKIACYVTIRGEKAMQLLESGLKVKEYELLRRNFSDTGCFGFGIQEHIDLGMKYDPSTGIYGMDFFVVLERAGYRVSRRRRCKARVGIDKVTEMP

SEQ ID NO: 12375 - protein, 104 aa, Papaver somniferum
MQLLESGLKVKEYELLRKNFSETGCFGFGIQEHIDLGIKYDPSTGIYGMDFYVVLERPGYRVGRRRRCKAKVGIQHRVKKDDAMKWFQVKYEGVILNKSQNITG

SEQ ID NO: 12376 - protein, 170 aa, Festuca arundinacea
MREIKVQKLVLNISVGESGDRLTRASKVLEQLSGQSPVFSKARYTVRSFGIRRNEKIACYVTIRGEKAMQLLESGLKVKEYELLRRNFSDTGCFGFGIQEHIDLGMKYDPSTGIYGMDFFVVLERAGYRVSRRRRCKARIGIHQRVTKEDAMKWFQVKYEGVILNKSHTG

SEQ ID NO: 12377 - protein, 182 aa, Eragrostis curvula
  misc_feature (14)..(14): Xaa can be any naturally occurring amino acid
  misc_feature (19)..(19): Xaa can be any naturally occurring amino acid
  misc_feature (21)..(21): Xaa can be any naturally occurring amino acid
  misc_feature (24)..(25): Xaa can be any naturally occurring amino acid
  misc_feature (32)..(32): Xaa can be any naturally occurring amino acid
  misc_feature (46)..(46): Xaa can be any naturally occurring amino acid
MAIKKKQANPRREXKGQKXGXNIXXGESGDRXTRAAKGLEQLSGQXPVFSKARYTVRSFGIRRNEKIACYVTVRGEKAMQLLESGLKVKEYELLRRNFSETGCFGFGIQEHIDLGIKYDPSTGIYGMDFYVVLERAGYRVARRRRCKARVGIQHRVTKEDAMKWFQVKYEGVILNKAQGNTS

SEQ ID NO: 12378 - protein, 170 aa, Festuca arundinacea
MRDIKVQKLVLNISVGESGDRLTRASKVLEQLSGQSPVFSKARYTVRSFGIRRNEKIACYVTIRGEKAMQLLDSGLKVKEYELLRRNFSDTGCFGFGIQEHIDLGMKYDPSTGIYGMDFYVVLERAGYRVSRRRRCKARIGIHQRVTKEDAMKWFQVKYEGVILNKSHAS

SEQ ID NO: 12379 - protein, 170 aa, Lolium multiflorum
MRDIKVQKLVLNCSVGESGDRLTRASKVLEQLSGQSPVFSKARYTVRSFGIRRNEKIACYVTVRGEKAMQLLESGLKVKEYELLRRNFSDTGCFGFGIQEHIDLGMKYDPSTGIYGMDFYVVLERAGYRVSRRRRCKARIGIHQRVTKEDAMKWFQVKYEGIILNKSHAG

SEQ ID NO: 12380 - protein, 158 aa, Primula obconica
SVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVGRRRRCKARVGIQHRVTKEDSMKWFQVKYEGVILNKAQTIG

SEQ ID NO: 12381 - protein, 161 aa, Eschscholzia californica
NISVGESGDRLTRAAKVLEQLSGQSPVFSKARYTVRSFGIRRNEKIACYVTVRGEKAMQLLESGLKVKEYELLRRNFSDTGCFGFGIQEHIDLGIKYDPSTGIYGMDFYVVLERPGYRVGRRRRCKSRVGIQHRVTKDDAMKWFQVKYEGVILNKSQNITG

SEQ ID NO: 12382 - protein, 141 aa, Cyamopsis tetragonoloba
EAGPNVSVGESGDRLTRAAKVLEQLSGQSAVFSKARYTVRSFGIRRNEKIACYVTVRGDKAMQLLESGLKVKEYELLRRNFSDLALVSRSILIWESSMILQLAFMEWTSMLFWSAQVIVWDVAVGASPVWGFSTGSQRRML

SEQ ID NO: 12383 - protein, 187 aa, Bruguiera gymnorhiza
MASERKLSNPMREIKVQKLVLNISVGESGDRLTRAAKVLEQLSGQTPVFSKARYTVRSFGIRRNEKIACYVTVRGEKAMQLLESGLKVKEYELLRRNFSDTGCFGFGIQEHIDLGIKYDPSTGIYGMDFYVVLERPGYRVGRRRSCKSLVGIKHRVPKEDAMKGFPVLIRRAGTLKQVPVRGPYKRF

SEQ ID NO: 12384 - protein, 88 aa, Papaver somniferum
MESEKKHTNPMRDIKVQKLVLNISVGESGDRLTRAAKVVEQLTGQAPVFSKAKNTVRSFGIRRNEKTACHVTVRGDKATELLERGIES

SEQ ID NO: 12385 - protein, 192 aa, Sorghum bicolor
MASEKKQSNPMREIKVQKLVLNISVGESGDRLTRAAKHISKSMVCFHACRSWRGQSPVFSKARYTVRSFGIRRNEKIVCYVTVRGEKAMQLLESGLKVKEYELLRRNFSETGCFGFGIQEHIDLGIKYDPSTGIYGMDFYVVLERAGYRVARRCRCKSRVGIQHIVTKEDAMKWFQVKYEGVILNKAQANTS

SEQ ID NO: 12386 - protein, 160 aa, Panax ginseng
MASEKKLLNPMREIKVQKLVLNISVGESGDRLTRASKVLEQLSSQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKSRVGIQHEGHEGG

SEQ ID NO: 12387 - protein, 163 aa, Utricularia gibba
MGSEKKLSNPMRDIKVQKLVLNISVGESGDRLTRAAKVLEQLSGQTPVFSKARYTVRSFGIRRNEKLLVMSTVRGEKAMQLIESGLKVKEYELLRRNFSETGCFGFGIQEHIDLGIKYDPSTGIYGMDFYVVLERPGYRVGRRRRCKSRVGIQHRVTKEDAMK

SEQ ID NO: 12388 - protein, 106 aa, Arachis hypogaea
MASEKKLANPMREIKVQKLVLNISVGESGDRLTRASKVLEQLSGQTPVFSKARYTVRSFGIRRNEKIACYVTVRGDKAMQLLESGLKVKEYELLRRNFSDTGCSYS

SEQ ID NO: 12389 - protein, 159 aa, Brassica napus
SVGESGDRLTRASKVLEQLSGQTPVFSKARYTVRSFGIRRNEKIACYVTVRGDKAMQLLESGLKVKEYELLRRNFSDTGCFGFGIQEHIDLGIKYDPSTGIYGMDFYVVLERPGYRVARRRRCKARVGIQHRVTKDDAMKWFQVKYEGVILNKSQNITG

SEQ ID NO: 12390 - protein, 65 aa, Panax ginseng
FFPYLAELQLQLQCSCELHHRRMAMASERKLANPMREIKVQKLVLNISVGESGDRLTRASKQGIL

SEQ ID NO: 12391 - protein, 161 aa, Petunia hybrida
LNISVGESGDRLTRAAKVLEQLSGQSPVFSKARYTVRSFGIRRNEKIACYVTVRGEKAMQLLESGLKVKEYELLRRNFSETGCFGFGIQEHIDLGIKYDPSTGIYGMDFYVVLERPGYRVARRRRCKSRVGIHQRVTKDDAMKWFQVKYEGVILNKSSNIQ

SEQ ID NO: 12392 - protein, 161 aa, Cirsium arvense
TFLLVESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKARVGIQHRVTKDDAMKWFQVKYEGVILNKSQQIGG

SEQ ID NO: 12393 - protein, 165 aa, Zingiber officinale
SEARPHISVGESGDRLTRAAKVLEQLSGQIPVFSKARYTVRSFGIRRNEKIACYVTVRGDKAMQLLESGLKVKEYELLRRNFSDTGCFGFGIQEHIDLGIKYDPSTGIYGMDFYVILERPGYRVSRRRRCKSRVGIHQRVTKEDAMKWFQVKYEGVILNKAQGTS

SEQ ID NO: 12394 - protein, 178 aa, Mesostigma viride
MVSEKKKANPMREIRVQKLVLNISVGESGDRLTRAAKVLEQLSGQQPVFSKARYTVRTFGIRRGEKISCHVTLRGEKAMQLIESGLKVKEYELLRQNFSDTGCFGFGIQEHIDLGIKYDPSTGIYGMDFFVVLERPGFRVARRRRATGHVGLQHKITKEDVIKWFQAKYEGIVLNKPN

SEQ ID NO: 12395 - protein, 158 aa, Picea glauca
MAAEKKLNNPMRDIKVQKLVLNISVGESGDRLTRASKVLEQLSGQTPVFSKARYTVRSFGIRRNEKIACYVTVRGEKALQLLESGLKVKEYELLRRNFSDTGCFGFGIQEHIDPGIKYDPSTGIYGMDFFVVLERPGYRIGRRKRAQSRVGIQHRVTK

SEQ ID NO: 12396 - protein, 200 aa, Ambrosia trifida
SSSAVIHRNINGIRKEARESNEGIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKARVGIQHRVTKEDAMKWFQVKYEGVILNKSQTNRSIETNLYLL

SEQ ID NO: 12397 - protein, 157 aa, Lippia dulcis
GESGDRLTRAAKVLEQLSGQSPVFSKARYTVRSFGIRRNEKIACYVTVRGDKAMQLLESGLKVKEYELLRRNFSETGCFGFGIQEHIDLGIKYDPSTGIYGMDFYVVLERPGYRVGRRRRCKSRVGIQHRVTKEDAMKWFQVKYEGVILNKASNIGA

SEQ ID NO: 12398 - protein, 167 aa, Festuca arundinacea
  misc_feature (163)..(163): Xaa can be any naturally occurring amino acid
MSTEKKRANPMREIKVQKLVLNCSVGESGDRLTRASKVLEQLSGQSPVFSKARYTVRSFGIRRNEKIACYVTVRGEKAMQLLESGLKVKEYELLRRNFSETGCFGFGIQEHIDLGMKYDPSTGIYGMDFYVVLERAGYRVSRRRRCKARIGIHQRVTKEDAMXWFQA

SEQ ID NO: 12399 - protein, 170 aa, Mesostigma viride
KPHAGDQVQKLVLNISVGESGDRLTRAAKVLEQLSGQQPVFSKARYTVRTFGIRRGEKISCHVTLRGEKAMQLIESGLKVKEYELLRQNFSDTGCFGFGIQEHIDLGIKYDPSTGIYGMDFYVVLERPGFRVARRRRATSHVGLQHKITKEDVIKWFQAKYEGIVLNKPN

SEQ ID NO: 12400 - protein, 150 aa, Thalictrum flavum
MASEKKLSNPMRDIKVQKLVLNISVGESGDRLTRAAKVLEQLSGQSPVFSKARYTVRSFGIRRNEKIACYVTVRGDKAMQLLESGLKVKEYELLRRNFSDTGCFGFGIQEHIDLGIKYDPSTGIYGMDFFAFLERPGYRVGRRRRCKSRV

SEQ ID NO: 12401 - protein, 124 aa, Glycine max
MNARRDNRNNRVSLFDGIEEGGIRASSVYSSSHEIDEHDNEQALDGLQDRVNLLKRLSGDINEEVDSHNRMLDRMGNDMDSSRGVLSGTMDKFKMVFETKSNQRMFTLVASFVVLFLIIYYLTR

SEQ ID NO: 12402 - protein, 126 aa, Glycine max
MNARRDGRNNRVALFDGIEEGGIRASSLYSSSSSHEIDEHDNEQALDGLQDRVNLLKRLSGDINEEVDSHNRMLDRMGNDMDSSRGVLSGTMDKFKMVFETKSSRRMFSLVASFVVLFLIIYYLTR

SEQ ID NO: 12403 - protein, 126 aa, Glycine max
MNARRDGRNNRVALFDGIEEGGIRASSLYSSTSSHEIDEHDNEQALDGLQDRVNLLKRLSGDINEEVDSHNRMLDRMGNDMDSSRGVLSGTMDKFKMVFETKSSRRMFSLVASFVVLFLIIYYLTR

SEQ ID NO: 12404 - protein, 125 aa, Vigna unguiculata
MNARRDGRNNRVALFDGIEEGGIRASSLYSTSSHEIDEHDNEQALEGLQDRVNLLKRLSGDINEEVDSHNRMLDRMGNDMDSSRGVLSGTMDKFKMVFETKSSRRMFSLVASFVVLFLIIYYLTR

SEQ ID NO: 12405 - protein, 165 aa, Cajanus cajan
MQYGDVSYLMTLRFFKQFNYVERKFILFVFVMSRDHLVACTCFCFRDNRNNRVSLFDGIEEGGIRASSLYSSSHEIDEHDNEQALDGLQDRVSLLKRLSGDINEEVDSHNRMLDRMGNDMDSSRGVLSGTMDKFKMVFETKSSRRMFTLVASFVVLFLIIYYLTR

SEQ ID NO: 12406 - protein, 124 aa, Arachis hypogaea
MNPRRDNRNNRVALFDGIEEGGIRAQSLYSSSHEIDEHDNEQAMDGLQDRVNLLKRLSGDIHEEVDSHNRMLDRMGNDMDSSRGILSGTMDKFKMVFETKSSRRMFTLVASFVVLFLIVYYLTR

SEQ ID NO: 12407 - protein, 124 aa, Arachis hypogaea
MNPRRDNRNNRVALFDGIEEGGIRAQSLYSSSHEIDEHDNEQAMDGLQDRVNLLKRLSGDIQEEVDSHNRMLDRMGNDMDSSRGILSGTMDKFKMVFETKSSRRMFTLVASFVVLFLIVYYLTR

SEQ ID NO: 12408 - protein, 126 aa, Glycyrrhiza uralensis
MNSRRDNRNGRVALFDGIEEGGIRASSLYSSTSSHEIDEHDNEQAMDGLQDRVSLLKRLSGDIHEEVDSHNRMLDHMGNDMDSSRGVLSGTMDKFKMVFETKSSRRMFSLVASFVVIFLIIYYLTR

SEQ ID NO: 12409 - protein, 126 aa, Medicago truncatula
MNSRRDTRNNRVALFDGIEEGGIRASSMYSSGSSHEIDEHDNEQAMDGLQDRVNLLKRLSGDIHEEVDNHNRMLDHMGNDMDSSRGVLSGTMDKFKMVFETKSSRRMFSLVASFVVIFLIIYYLTR

SEQ ID NO: 12410 - protein, 126 aa, Trigonella foenum-graecum
MNSRRDTRNNRVALFDGIEEGGIRASSMYSSGSSHEIDEHENEQAMDGLQDRVNLLKRLSGDIHEEVDSHNRMLDHMGNDMDSSRGVLSGTMDKFKMVFETKSSRRMFSLVASFVVIFLIIYYLTR

SEQ ID NO: 12411 - protein, 126 aa, Cicer arietinum
MNSRRDTRNNRVALFDGIEEGGIRASSLYSSASSHEIDEHDNEQAMDGLQDRVSLLKRLSGDINEEVDNHNRMLDRMGDDMDSSRGILSGTMDKFKMVFETKSSRRMFSLVASFVVIFLIIYYLTR

SEQ ID NO: 12412 - protein, 125 aa, Phaseolus vulgaris
MNARRDGRNNRVALFDGIEKGGIKASSLYSTSSHEIGELDNEQALDGLQDRVNLLKRLSGDINEEVDSHNRMLDRMANDMDSSRGILSGTMDKFKMVFETKSSRRMFSLVASFVVVFLIIYYLTR

SEQ ID NO: 12413 - protein, 124 aa, Glycyrrhiza uralensis
MNSRRDNRNNKVALFDGIEEGGIRASSLYSSSHEIDEHDNELAVDGLQDRVNLLKRLSGDIHEEVDSHNRMLDHMGNDMDASRGVLSGTMDKFKMVFETKSSRRMFTLVASFVVLFLIVYYLTR

SEQ ID NO: 12414 - protein, 122 aa, Unknown
  Sequence found in Organisms: Gossypium hirsutum, Gossypium raimondii
MNPRRDMRNNRVALFDGIEEGGIRATSSYSHEIDEHDNERAMEGLQDRVNLLKRLSGDIHEEVDSHNRMLDRMGNDMDSSRGILSGTMDKFKMVFETKSSRRMFTLVASFVVIFLVIYYLTR

SEQ ID NO: 12415 - protein, 118 aa, Arachis hypogaea
MNPRRDNRNNRVALFDGIEEGGIRAQSLYSSSHEIDEHDNEQAMDGLQDRVNLLKREEVDSHNRMLDRMGNDMDSSRGILSGTMDKFKMVFETKSSRRMFTLVASFVVLFLIVYYLTR

SEQ ID NO: 12416 - protein, 91 aa, Arachis hypogaea
MNPRRDNRNNRVALFDGIEEGGIRAQSLYSSSHEIDEHDNEQAMDGLQDRVNLLKRLSGDIQEEVDSHNRMLDRMGNDMDSSRGILSGTMD

SEQ ID NO: 12417 - protein, 123 aa, Unknown
  Sequence found in Organisms: Castanea mollissima, Quercus alba
MNARRDYRNNKAALFDGIEEGGIRASSSYSSHEIDEHDNERAVDGLQDRVILLKRLSGDINEEVESHNRMLDRMGNDMDSSRGVLSGTMDRFKTVFETKSSRRMFTLVASFVVIFLVIYYLTR

SEQ ID NO: 12418 - protein, 156 aa, Phaseolus vulgaris
MRLWKHQIIENDLACVLSDHLGHITVLYIIIFFCFRDGRNNRVALFDGIEKGGIKASSLYSTSSHEIGELDNEQALDGLQDRVNLLKRLSGDINEEVDSHNRMLDRMANDMDSSRGILSGTMDKFKMVFETKSSRRMFSLVASFVVVFLIIYYLTR

SEQ ID NO: 12419 - protein, 122 aa, Theobroma cacao
MNPRRDMRNNRVALFDGIEEGGIRASSSYSHEIDEHDNERAVEGLQDRVNLLKRLSGDIHEEVESHNRMLDRMGNDMDASRGILSGTMDKFKMVFETKSSRRMFTLVASFVVIFLVIYYLTR

SEQ ID NO: 12420 - protein, 122 aa, Unknown
  Sequence found in Organisms: Citrus clementina, Citrus sinensis
MNSRRDYRNSKVALFDGIEEGGIRASSSYSHEIDEHDNERALEGLQDRVNLLKRLSGDINEEVDTHNRMLERMGNDMDASRGVLSGTMDKFKMVFETKSSRRMFTLVASFVVIFLIVYYLTR

SEQ ID NO: 12421 - protein, 122 aa, Unknown
  Sequence found in Organisms: Gossypium hirsutum, Gossypium raimondii
MNPRRDMRNSRVALFDGIEEGGIRASSSYSHEIDEHENERAMEGLQDRVNLLKRLSGDIHEEVDSHNRMLDRMGNDMDASRGILSGTMDKFKMVFETKSSRRMFTLVASFVVVFLIIYYLTK

SEQ ID NO: 12422 - protein, 123 aa, Populus trichocarpa
MNSRRDIRNNRAALFDGIEEGGIRASSSYSSHEIDEQDNERALEGLQDRVILLKRLSGDINEEVDNHNLMLDRMGNDMDSSRGVLSGTMDRFKMVFETKSSRRMFTLVASFVVLFLIIYYLTR

SEQ ID NO: 12423 - protein, 123 aa, Populus trichocarpa
MNSRRDVRNNRAALFDGIEEGGIRASSSYSSHEIDEQDNERALEGLEDRVSLLKRLSGDINEEVDSHNLMLDRMGNDMDSSRGVLSGTMDRFKMVFETKSSRRMLTLVASFVVIFLIIYYLTR

SEQ ID NO: 12424 - protein, 122 aa, Gossypium raimondii
MNPRRDMRNSRVALFDGIEEGGIRASSSYSHEIDEHENERAMEGLQDRVNLLKRLSGDIHEEVDSHNRMLDRMGNDMDASRGILSGTMDKFKMVFETKSSRRMFTLVASFVVIFLFIYYLTR

SEQ ID NO: 12425 - protein, 122 aa, Ipomoea nil
MNSRRDRNTRTALFDGIEEGGIRASSSYSSHEIDEHENEKALDGLQDRVNLLKRLSGDIHEEVDTHNRMLDRMGNDMDASRGVLSGTMDKFKMVFETKSSRRMFTLVASFVVLFLVVYYLTR

SEQ ID NO: 12426 - protein, 122 aa, Unknown
  Sequence found in Organisms: Prunus persica, Prunus mume
MNARRDYRGNKVALFDGIEEGGIRASASYSHEIDEHDNERAVDGLQDRVNLLKRLSGDIHEEVESHNHMLDRMGNDMDSSRGVLSGTMDKFKMVFETKSSQRMFTLVASFVVIFLVIYYLTR

SEQ ID NO: 12427 - protein, 96 aa, Fagus grandifolia
MNARRDYRNNKAALFDGIEEGGIRASSSYSSHEIDEQDNERAIDGLQDRVILLKRLSGDINEEVDSHNRMLDRMGNDMDSSRGVLSGTMDRLQDGV

SEQ ID NO: 12428 - protein, 123 aa, Cannabis sativa
MNTRRDIRGNRAALFDGIEEGGIRASSSYSSHEIDEHDNERAMEGLQDRVILLKRLSGDINEEVDNHNRMLDRMGNDMDSSRGVLSGTMDRFKTVFETKSSRRMFTLVASFVVVFLVIYYLTR

SEQ ID NO: 12429 - protein, 123 aa, Humulus lupulus
MNPRRDIRGNRTALFDGIEEGGIRASSSYSSHEIDEHDNERAMEGLQDRVILLKRLSGDINEEVDNHNRMLDRMGNDMDSSRGVLSGTMDRFKTVFETKSSRRMFTLVASFVVVFLVIYYLTR

SEQ ID NO: 12430 - protein, 122 aa, Carica papaya
MNSRRDTRNSRVALFDGIEEGGIRAASSYSHEIDEHDNERAMEGLQDRVNLLKRLSGDVHEEVETHNRMLDRMGNDMDSSRGILSGTMDKFKMVFETKSSRRMFTLVASFVVIFLIVYYLTR

SEQ ID NO: 12431 - protein, 123 aa, Eucalyptus grandis
MNTRRDVRGNRAALFDGIEEGGIRASSSYSSHEIDEHENERAMDGLQDRVNLLKRLSGDINEEVETHNRMLDGMGNEMDASRGVLSGTMDRFKMVFETKSSRRMFSLVASFVVIFLVVYYLTR

SEQ ID NO: 12432 - protein, 123 aa, Vitis vinifera
MNSRRDYRGNRIALFDGIEEGGIRASSSYSSHEIDEHDNERAVDGLQDRVNLLKRLTGDIHEEVESHNRMLDRVGNDMDASRGILSGTMDRFKMVFETRSSRRMFTLVASFVVIFLIIYYLTR

SEQ ID NO: 12433 - protein, 122 aa, Hevea brasiliensis
MNSRRDVRNNRAALFDGIEEGGIRASSSYSHEIDEQDNERAVEGLQDRVNLLKRLSGDIHEEVETHNHMLDRMGNDMDSSRGVLSGTMDRFKMVFETKSSRRMFTLVASFVVIFLIVYYLTR

SEQ ID NO: 12434 - protein, 124 aa, Lotus japonicus
MNSRRDIRNNKVALFDGIEEGGIRESALYPSSHEIDEHDNEQAMDGLHDRVNLMKRLSRDIQEEVDGHNRMLDRMGNDMDSSRGVLSGTMDKFKMVFEKKSSQRMFTLVASFVVLFLIIYYLTR

SEQ ID NO: 12435 - protein, 129 aa, Heritiera littoralis
MNSRRDMRNNRVALFDGIEEGGIRASSSYSHEIDEHENERAVEGLQDRVNLLKRLSGDVHEEVDSHNRMLDRMGNDMDASRGILQEPWTSLRWYSRPNQAGECLCLWHLLWLFSLSYTILLGKLGLWCI

SEQ ID NO: 12436 - protein, 124 aa, Arachis hypogaea
MNSRRDARNSRVALFDGIEEGGIRASSLYSSYNEIDEQDNERAMGGLQDRVSLLKRISSDIHEEVDSHNRMLDRMGNDMDSSRGVLSGTMDKFKMVFEKKSSRRTFSLIASFVVLFLIIYYLTR

SEQ ID NO: 12437 - protein, 122 aa, Euonymus alatus
MNSRRDFRGNKAALFDGIEEGGIRASASYSHEIDEHDNESALEGLQDRVILLKRLSGDINEEVDSHNRMLDRMGNDMDASRGILSGTMDRLKMVFETKSSRRMFTLVASFVVIFLIIYYITR

SEQ ID NO: 12438 - protein, 122 aa, Linum usitatissimum
MNSRRDIRNNRTALFDGIEEGGIRASSSYSHEINEQANESALEGLQDRVNLLKRLSGDIHEEVEGHNRMLDGMGNDMDSSRGVLSGTMDRFKMVFETKSSRRMFTLVASFVVVFLIIYYLTR

SEQ ID NO: 12439 - protein, 122 aa, Orobanche aegyptiaca
MNSRRDRNARSALFDGIEEGGIRASSSYSSHEIDEQENDGAIDGLQDRVNMLKRLSGDIHEEVESHNLMLDRMGNDMDASRGVLSGTMDKFKMVFETKSSRRMFTLVASFVVIFLVIYYLTR

SEQ ID NO: 12440 - protein, 122 aa, Capsicum annuum
MNSRRERSNRVALFDGIEEGGIRASSSYGSHEIDEQENEKAMDGLQDRVNLLKRLSGDIHEEVETHNRMLDRMGNDMDSSRGVLSGTMDKFKMVFETKSSRRMFTLVASFVVLFLVVYYLTR

SEQ ID NO: 12441 - protein, 122 aa, Salvia sclarea
MNPRRDRNARVALFDGIEEGGIRASSSYSSHEIDEQENDRAMEGLQDRVIMLKRLSGDIHEEVDSHNRMLDRMGNDMDASRGVLSGTMDKFKMVFETKSSRRMFTLVASFVVVFLIVYYLTR

SEQ ID NO: 12442 - protein, 123 aa, Chenopodium quinoa
MNPRRDYRGSRTSAFDGIEEGGIRASSSYSSHEIDEHDNDTALDGLQDRVNLLKRLSGDINEEVDAHNRMLDRMGNEMDASRGFLSGTVDRFKQAFETKSSRRMFTLVASFVVLFLIIYYLTR

SEQ ID NO: 12443 - protein, 122 aa, Hevea brasiliensis
MNSRRDLRTNRAALFDGIEEGGIRASSSYSHEIDEQDNERAMEGLQDRVNFLKRLSGDIHEEVETHNRILDRMGNDMDSSRGVLSGTMDRFKMVFETKSSRRMFTLVASFVVIFLIVYYLTR

SEQ ID NO: 12444 - protein, 122 aa, Phalaenopsis aphrodite
MNSRRDHRSNRAALFDGIEEGGIRASSYSSHEIDEHDNDLAVDGLQDRVNILKRLTGDIHEEVESHNRMLDRMGNDMDSSRGVLSGTMDRFKMVFENKSSRRMVTLVASFVALFLLIYYLTK

SEQ ID NO: 12445 - protein, 122 aa, Triphysaria pusilla
MNSRRDRNARSALFDGIEEGGIKASSSYSSHEIDEQENDNAVDALKDRVNMLKRLSGDIHEEVESHNLMLDRMGNDMDASRGVLSGTMDKFKMVFETKSSRRMFSLVASFVVIFLVIYYLTR

SEQ ID NO: 12446 - protein, 122 aa, Manihot esculenta
MNPRRDVRTNRAALFDGIEEGGIRASSSYSHEIDEQDNERAMEGLQDRVNLLKRLSGDIHEEVETHNHMLDRMGNDMDSSRGVLSGTMDRFKTVFETKSSRRMFTLVASFVVIFLVVYYLTR

SEQ ID NO: 12447 - protein, 122 aa, Ricinus communis
MNSRRDVRTSRTALFDGIEEGGIRASSSYSHEIDEQDNERAMEGLQDRVILLKRLSGDIHEEVEGHNRMLDRMGNDMDSSRGVLSGTMDRFKMVFETKSSRRMFTLVASFLVIFLIVYYLTR

SEQ ID NO: 12448 - protein, 122 aa, Catharanthus roseus
MNSRRDRNGRAALFDGIEEGGIRASSSYSSHEIDEHENERAVDGLQDRVNLLKMISGDIHEEVENHNRMLDRMGNDMDSSRGILAGTMDKFKMVFETKSSRKMFTLVASFVVIFLVVYYLTR

SEQ ID NO: 12449 - protein, 122 aa, Coffea canephora
MNSRRERNARAALFDGIEEGGIRASSSYSSHEIDEQENEKEIDGLQDRVNLLKRLSGDIHEEVDNHNRMLDRMGNDMDASRGILAGTVDKFKMVFETKSSRRMFTLVASFVVIFLVVYYLTK

SEQ ID NO: 12450 - protein, 122 aa, Euonymus alatus
MNSRRDFRGNKAALFDGIEEGGIRASASYSHEIDEHDNERALEGLQDRVILLKRLSGDINEEVDTHNRMLDRMGNDMDASRGILSGTMDRFKMVFETKSNRRMLTLVASFVVIFLIIYYITR

SEQ ID NO: 12451 - protein, 122 aa, Euphorbia peplus
MIPRREVRTNRAALFDGIEEGGIRAAPSYSHEIDEQDNERALEGLQDRVNLLKRLSGDINEEVDSHNRMLDRMGNDMDASRGILSGTMDRFKMVFETKSSRRMFTLVASFLAIFLIVYYLTR

SEQ ID NO: 12452 - protein, 122 aa, Linum usitatissimum
MNSRRDVRNNKVALFDGIEEGGIRASSSYSHEIDEQDNEQALGGLKDRVNLLKRLSGDIHEEVEGHNRMLDGMGNDMDASRGVLSGTMDRFKTVFETKSSRRMATLVASFVVLFLIVYYLTR

SEQ ID NO: 12453 - protein, 122 aa, Fraxinus spp
MNSRRDRNARTALFDGTEEGGIRASSSYSSHEIDEQENDRAVDGLQDRVNLLKRLSGDVQEEVETHNRMLDRMGNDMDSSRGVLSGTMDKFKMVFETKSSRRMFTLVASFVVIFLVVYYLIR

SEQ ID NO: 12454 - protein, 122 aa, Tropaeolum majus
MNPRRDLRNNRAALFDGIEEGGIRQSSYASHEINEHDNNQAMEGLQDRVLLLKRLSGDIHEEVETHNRMLDRAGNDMDSSRGILSGTMDRFKTVFETKSSRRMFTLVASFVVIFLVIYYLTR

SEQ ID NO: 12455 - protein, 122 aa, Nicotiana benthamiana
MNSRRERSNRAALFDGIEEGGIRASSSYASHEIDEQENEKAMDGLQDRVNLLKRLSGDIHEEVETHNRMLDRMGNDMDSSRGVLAGTMDKFKMVFETKSSRRMFTLVASFVVLFLVVYYLTR

SEQ ID NO: 12456 - protein, 122 aa, Solanum tuberosum
MNSRRERGNRAALFDGIEEGGIRASSSYSSHEIDEQENERAIDGLQDRVSFLKKLSGDIHEEVDTHNRMLDRMGNDMDSSRGVLSGTMDKFKMVFETKSSRRMFTLVASFVVLFLVVYYLTR

SEQ ID NO: 12457 - protein, 122 aa, Rosa hybrid cultivar
MNARRDYRNNKVALFDGIEEGGIRASSSYSHEIDEQDNERAVEGLQDRVNLLKRLSGDIHEEVESHNHMLDRMGNDMDSSRGMLSGTMDRFKTVFETKSSQRMFTLVASFLVVFLVIYYLTR

SEQ ID NO: 12458 - protein, 122 aa, Fragaria vesca
MNARRDYRNNKVALFDGIEEGGIRASASYSHEIDEQDNERAVDGLQDRVNLLKRLSGDIHEEVESHNHMLDRMGNDMDSSRGMLSGTMDRFKTVFETKSSQRMFTLVASFLVVFLVIYYLTR

SEQ ID NO: 12459 - protein, 84 aa, Vitis vinifera
MGIGCIMHKAGSSLLVYMPLEHTCNLDGSIILTFPVYYFWVYFFGAVKSCRAQMGQALFYLHQLPVCLSLVEVRMVCSLGLPLA

SEQ ID NO: 12460 - protein, 121 aa, Chenopodium quinoa
MNPRRDYRGSRTSAFDGIEEGGIRASSSYSSHEIDEHDNDTALDGLQDRVNLLKRLSGDINEEVDAHNRMLDRMGNEMDASRGFLSGTVDRFKQAFETKSSRRMFTLVASFVFFSYYLLSY

SEQ ID NO: 12461 - protein, 96 aa, Arachis hypogaea
MNSRRDARNSRVALFDGIEEGGIRASSLYSSYNEIDEQDNERAMGGLQDRVSLLKRISSDIHEEVDSHNRMLDRMGNDMDSSRGVLSGTMDKFKIL

SEQ ID NO: 12462 - protein, 124 aa, Mimulus guttatus
MNSRSFRDRNARAALFDGIEEGGIRASSSYSSHEIDEQENERAIDGLQDRVNLLKRLSGDIHGEVESHNHMLDGMGNDMDASRGVLSGTMDKFKMVFETKSSRRMFTLVASFVVIFLVVYYLTR

SEQ ID NO: 12463 - protein, 123 aa, Olea europaea
MNSRRDRNARVALFDGIEEGGIRASSSYSSHEIDEQENDRDVDGLQDRVNMLKRLSGDIHEEVETHNRMLDRMGNDMDSSRGVLSGTMDKFKMVFETKSSRRMFTLVASFVVIFIVVYYLISK

SEQ ID NO: 12464 - protein, 123 aa, Amorphophallus konjac
MNSRRDYRSNRAALFDGIEEGGIRASSSYSSHEIDEHENDRALDGLQDRVNILKRLTGDVHEEVESHNRVLDRMGNDMDASRGVLSGTMDRFKMVFETKSSRRMATLVGSFVVLFLLIYYLTK

SEQ ID NO: 12465 - protein, 123 aa, Amorphophallus konjac
MNSRRDYRGNRAALFDGIEEGGIRASSSYSSHEIDEHENDSALDGLQDRVNILKRLTGDVHEEVESHNRALDRMGNDMDASRGVLSGTMDRFKMVFETKSSRRMATLVASFVALFLLIYYLTK

SEQ ID NO: 12466 - protein, 121 aa, Manihot esculenta
MMKKDLRTNRAALFDGIEEGGIRASSSYSHEIDEQDNERGMDGLQDRVNLLKRLSGDIHEEVETHNRMLDRMGNDMDSSRGVLSGTMDRFKMVFETKSSRRMFTLVASFVVIFLIVYYLTR

SEQ ID NO: 12467 - protein, 122 aa, Cleome spinosa
MNPRRDHRGTRSSVFDGIEEGGIRAAPSYSHEIDEHDNERALDGLQDRVNLLKRLSGDINEEVETHNRMLDRMGNDMDSSRGILSGTMDRFKTVFETKSSRRMLTLVASFVALFLVVYYLTR

SEQ ID NO: 12468 - protein, 123 aa, Cynara scolymus
MNTRRDFRGNRSALFDEIEDGGIRASSSYSSHEIDEHENERAMDGLQDRVLMLKRLTGDIHEEVEGHNRMLDRMGNDMDSSRGILSGTMDKFKMVFETKSSRRMFTLVASFVVGFLVIYYLTR

SEQ ID NO: 12469 - protein, 122 aa, Petunia hybrida
MNSRRERSNRSALFDGIEEGGIRASSSYASHEIDEQENEKAMDGLQDRVNLLKGLSGDIHEEVETHNRMLDRMGNDMDSSRGVLSGTMDKFKMVFETQSSRRMFTLVASFVVLFLVVYYLTR

SEQ ID NO: 12470 - protein, 121 aa, Lippia dulcis
MNSRRDRNARSALFDGIEEGGIRASSSYSHEIDEQENDRAMDGLSDRVNLLKRLSGDINEEVEAHNHMLDRMGNDMDSSRGVLSGTMDKFKMVFETKSNQRMFTLVASFVVLFLVIYYLTR

SEQ ID NO: 12471 - protein, 121 aa, Plantago ovata
MNSRRDRNTRMALFDGIEEGGIRASASYSHEIDEQENERAVDGLQDRVNLLKRLSGDIHEEVESHNHMLDRMGNDMDASRGILSGTMDKFKMVFETKSSRRMFTLVASFVVVFLVVYYLTR

SEQ ID NO: 12472 - protein, 122 aa, Tripterygium wilfordii
MNSRRDFRANKAALFDGIEEGGIRASASYSHEIDEHDNERALEGLQDRVILLKRLSGDINEEVDSHNRMLERTGNDMDASRGILSGTMDRLKMVFETKSSRKMFTLVASFVVIFLIIYYITR

SEQ ID NO: 12473 - protein, 233 aa, Vigna unguiculata
MASSSNSWMKEYNEALKLAEDISGMISEQSSFPASGPEIQRHSSAIRRKITILGTRLDSLQSLLSKLPGKQPPISDKEMNRRKDMLASLRSKVNQMASTLNMSNFSNRDSLLGPEGKPDAMARTVGLDNNGLVGFQRQIMKEQDEGLEQLEDTIASTKHIALAVNEELTLHTRLIDDLDQHVDVTDSRLRRVQKNLAILNKRTRGGCSCLCMLLSVIGIVFLVVVIWLLVKYL

SEQ ID NO: 12474 - protein, 232 aa, Glycine max
MASSSDSWVKEYNEALKLADDISGMISEQSSFPASGPETQHHSSAIRRKITILGTRLDSLQSLLSKLPGKQPISEKEMNRRKDMLSNLRSKVNQMASTLNMSNFANRDSLLGPERKPDAMTRMVGLDNNGLVGLQRQIMKEQDDGLEQLEETVASTKHIALAVNEELDLHTRLIDDLDQHVDVTDSRLRRVQKNLAVLNKRTKGGCSCMCMLLSVVGIVALIVVIWLLVKYL

SEQ ID NO: 12475 - protein, 232 aa, Cajanus cajan
MASSSDSWVKEYNGALKLADDVSGMISEGGSFPASGPETQRHSSAIRRKITILGTRLDSLQSLLSKHPGKHPITDKEMNRRKDMLANLRSKVNQMASTLNMSNFANRDSLLGPERKPDAMTRTVGLDNNGLVGLQRQIMKEQDDGLEKLEETVASTKHIALAVNEELDLHTRLIDDLDQHVDVTDSRLRRVQKNLAVLNKRTKGGCSCLCMLLSVVGIVLLVIVIWLLVKYL

SEQ ID NO: 12476 - protein, 232 aa, Cicer arietinum
MASNSDQWVKEYNEALKLGDDISSMISEQSSFPASGPEAQRQSSAIRRKITILGTRLDSLQSLLSKLPGKQPLSEKEMNRRKDMLANLRSKVNQMASSLNMSNFANRDSLLGPEVKPDVMNRIVGLDNNGLVGFQRQVMKEQDEGLESLEQTVISTKHIALAVNEELGLHTRLIDDLDQHVDVTDSRLRRVQKNLAILNKRTKGGCSCFCMLLSVIGIVVLVVVIWLLVKYL

SEQ ID NO: 12477 - protein, 229 aa, Lupinus angustifolius
MASSSDSWMKEYNEAVKLSDDISGMISERNSFPASGPETQRHASAIRRKITILGTRLDSLQSLLSKNPGKSEKDMNRRKDTLQNLRSKVNQMASTLNMSNFANRDSLLGPDIKSDAMSRTVGLDNSGLVGLQRQIMKEQDEGLEKLEETVISTKHIALAVNEELGLHTRLIDDLDEHVDVTDSRLRRVQKNLAVLNKRTKGGCSCLCMLLSVVGIVVLVLVIWLLVKYL

SEQ ID NO: 12478 - protein, 229 aa, Cicer arietinum
MASSSDSWMKEYNEAMKLADDISGMISEHTSFPTSGPETQRHASAIRRKITILGTRLDSLQSLLSKLPVKSEKEMNRRKDNLANLRSKVNQMASTLNMSNFANRDSLLGPEIKPDAMSRTVGLDNSGLVGLQRQVMKEQDEGLEKLEETVLSTKHIALAVNEELTLHTRLIDDLDEHVDVTDSRLRRVQKNLAILNKRTKGGCSCLCMLLSVIGIVVLVVVIWLLVKYL

SEQ ID NO: 12479 - protein, 232 aa, Glycyrrhiza uralensis
MASSSDPWVKEYNEAMKLADDISGMISEWSSYPASGPETQRHSSAIRRKITILGTRLDSLQSLLSKLPGKQQVSEKEMNRRKDMLANLRSKVNQMASTLNMSNFANKDSLLGPEIKPDAMSRTVGLDNNGLVGLQRQIMKEQDEGLENLEETVTSTKHIALAVNEELTLHTRLIDDLDENVEVTDSRLRRVQKNLAILNKRTKGGCSCMCMLLSVIGIVVLVVVIWLLVKYL

SEQ ID NO: 12480 - protein, 229 aa, Lupinus angustifolius
MASSSDSWTKEYNEAVKLADDINGMISERSSFPASGPETQRHSSAIRRKITILGTRLDSLQSLLSRNPGKSEKEFNRRKDTLSNLRSRVNQMASTLSMSNFANRDSLLGPDIKPDALSRTVGLDNSGLVGLQRQIMKEQDEGLEKLEDTVISTKHIALAVNEELGLHTRLIDDLDEHVDVTDSRLRRVQKNLAVLNKRTKGGCSCLCMLLSVIGIVVLVVVIWLLVKYL

SEQ ID NO: 12481 - protein, 229 aa, Pisum sativum
MASSSDSWMKEYNEAMKLADDISGMISEHNSFPSSGPETQRHASAIRRKITILGTRLDSLQSLLSRVPVKSEKEMNRRKDNLANLRSKVNQMASTLNMSNFANRDSLLGPEIKPDAMSRTVGLDNNKLVGLQRQVMKEQDEGLEKLEETVLSTKHIALAVNEELTLHTRLIDDLDEHVDVTDSRLRRVQKNLAILNKRTKGGCSCLCMLLSVIGIVVLVVVIWLLVKYL

SEQ ID NO: 12482 - protein, 229 aa, Cajanus cajan
MASSSDSWMKEYNEAVKLADDISGMISERSSFPASGPETQRHASAIRRKITILGTRLDSLQSLLSKFPAKTEKEMNRRKDMLANLRTKVTQMASTLNMSNFANRDSLLGPEIKPDAMSRTVGLDNSGLVGLQRQIMKEQDDGLEKLEETVISTKHIALAVNEELDLHTRLIDDLDQHVDVTDSRLRRVQKNLAILNKRTKGGCSCLCLLLSVIGIVVLVVVIWLLIKYL

SEQ ID NO: 12483 - protein, 228 aa, Glycine max
MASSDSWMKEYNEAVKLADDINGMISERSSFPASGPETQRHASAIRRKITILGTRLDSLQSLLSKVPAKTEKEMNRRKDMLANLRTKVNQMASTLNMSNFANRDSLLGPEIKSDAMSRTVGLDNSGLVGLQRQIMKEQDDGLEKLEETVISTKHIALAVNEELNLHTRLIDDLDQHVDVTDSRLRRVQKNLAVLNKRTKGGCSCLCMLLSVIGIVGLVVVIWLLVKYL

SEQ ID NO: 12484 - protein, 229 aa, Trigonella foenum-graecum
MASSSDSWMKEYNEAMKLADDISGMISEHNSFPSSGPETQRHASAIRRKITILGTRLDSLQSLLSKLPVKSEKEMNRRKDNLANLRSKVNQMASTLNMSNFANRDSLLGPEIKPDAMSRTVGLDNNKLVGLQRQVMKEQDEGLEKLEETVLSTKHIALAVNEELTLHTRLIDDLDEHVDVTDSRLRRVQKNLAILNKRTKGGCSCLCMLLAVIGIVGLVLVIWLLVKYL

SEQ ID NO: 12485 - protein, 229 aa, Medicago truncatula
MASSSDSWLKEYNEAMKLADDISGMISEHNSFPSSGPETQRHASAIRRKITILGTRLDSLQSLLSKLPVKSEKEMNRRKDNLANLRSKVNQMASTLNMSNFANRDSLLGPEIKPDAMSRTVGLDNNGLVGLQRQVMKEQDEGLEKLEETVLSTKHIALAVNEELTLHTRLIDDLDEHVDVTDSRLRRVQKNLAILNKRTKGGCSCMCMLLAVIGIVGLVLVIWLLVKYL

SEQ ID NO: 12486 - protein, 229 aa, Glycine max
MASSSDSWMKEYNEAVKLADDITGMISERSSFPASGPETQRHASAIRRKITILGTRLDSLQSLLSKVPAKTEKEMNRRKDMLSNLRTKVNQMASTLNMSNFANRDSLFGPEIKSDAMSRTVGLDNSGLVGLQRQIMKEQDDGLEKLEETVISTKHIALAVNEELNLHTRLIDDLDQHVDVTDSRLRRVQKNLAVLNKRTKGGCSCLCMLLSVIGIVGLVVVIWLLVKYL

SEQ ID NO: 12487 - protein, 229 aa, Lotus japonicus
MASSSDTWMKEYNEAMKLADDINSMISERSSFPASGPETQRHASAIRRKITILGTRLDSLQSLLSKLPVKSEKEMNRRKDTLANLRSKVNQMASTLNMSNFANRDSLLGPEIKPDAMSRTVGLDNSGLVGLQRQIMKEQDDGLEKLEETVISTKHIALAVNEELTLHTRLIDDLDEHVDVTDSRLRRVQKHLAVLNKRTKGGCSCLCMLLAVVGIVILVVVIWLLVKYL

SEQ ID NO: 12488 - protein, 229 aa, Medicago truncatula
MASSSDSWVKEYNEAMKLADDISGMISEHNSFPSSGPETQRHASAIRRKITILGTRLDSLQSLLSKLPVKSEKEMNRRKDNLANLRSKVNQMASTLNMSNFANRDSLLGPEIKPDAMSRTVGLDNNGLVGLQRQVMKEQDEGLEKLEETVLSTKHIALAVNEELTLHTRLIDDLDEHVDITDSRLRRVQKNLAILNKRTKGGCSCMCMLLAVIGIVGLVLVIWLLVKYL

SEQ ID NO: 12489 - protein, 229 aa, Phaseolus vulgaris
MASSSDSWMKEYNEAVKLADDITGMISERSSFPASGPETQRHASAIRRKITILGTRLDSLQSLLSKVPAKTEKEMNRRKDMLGNLRTKVNQMASTLNMSNFANRDSLLGPEIKSDAMSRTVGLDNSGLVGLQRQIMKEQDDGLEKLEETVISTKHIALAVNEELDLHTRLIDDLDEHVDVTDSRLRRVQKNLAVLNKRTKGGCSCLCMLLSVIGIVVLVAVIWLLIKYL

SEQ ID NO: 12490 - protein, 229 aa, Arachis hypogaea
MASSSDSWMKEYNEAVKLADDINGMISERSSLSTSGPEAQRHASAIRRKITILGTRLDSLQSLLSKVPGKSEKEMNRRRETLTNLRSKVNQMASTLNMSNFANRDSLFGPEIKPDAMSRTVGLDNSGLVGLQRQIMKEQDEGLEKLEETVVSTKHIALAVNEELSLHTRLIDDLDEHVDVTDSRLRRVQKNLAVLNKRTKGGCSCLCMLLAVVGIVVLVVVIWLLVKYL

SEQ ID NO: 12491 - protein, 229 aa, Arachis hypogaea
MASSSDSWMKEYNEAVKLADDINGMISERSSLSTSGPEAQRHASAIRRKITILGTRLDSLQSLLSKVPGKSEKEMNRRRETLTTLRSKVNQMASTLNMSNFANRDSLFGPEIKPDAMSRTVGLDNSGLVGLQRQIMKEQDEGLEKLEETVVSTKHIALAVNEELSLHTRLIDDLDEHVDVTDSRLRRVQKNLAVLNKRTKGGCSCLCMLLAVVGIVVLVVVIWLLVKYL

SEQ ID NO: 12492 - protein, 233 aa, Lotus japonicus
MASSSDSWVKEYNEAVKLADDISTMISERSSSVESGPEAQRHSSAIRRKITILGTRLDSLQSLLSKLPAGKQPVSEKELNRRKDMLASLRSRVNEMASTLSMPNFSNRDSLFGPEIKPDAMSRTNGLDNKGVIGLQRQIMKEQDEGLEKLEESVTSTKHIALAVNEELDLHTSLIDDLDQHVDVTDSRLRRVQKNLAVLNKRTNGGCSCLCMLLSVIGIVVLVVVIGLLVKYL

SEQ ID NO: 12493 - protein, 229 aa, Arachis hypogaea
MASSSDSWMKEYNEAVKLADDINGMISERSSLSTSGPEAQRHASAIRRKITILGIRLDSLQSLLSKVPGKSEKEMNRRRETLTTLRSKVNQMASTLNMSNFANRDSLFGPEIKPDAMSRTVGLDNSGLVGLQRQIMKEQDEGLEKLEETVVSTKHIALAVNEELSLHTRLIDDLDEHVDVTDSRLRRVQKNLAVLNKRTKGGCSCLCMLLAVVGIVVLVVVIWLLVKYL

SEQ ID NO: 12494 - protein, 229 aa, Vigna unguiculata
MASSSDTWMKEYNEAVKLADDITGMIAERSSFPASGPETQRHASATRRKITILGTRLDSLQSLLSKVPAKTEKEMNRRKDMLGNLRTKVNQMASTLNMSNFANRDSLLGPEIKSDAMSRTVGLDNSGLVGLQRQIMKEQDDGLEKLEETVISTKHIALAVNEELDLHTRLIDDLDEHVDVTDSRLRRVQKNLAVLNKRTKGGCSCLCMLLSVIGIVVLVVVIWLLIKYL

SEQ ID NO: 12495 - protein, 233 aa, Unknown
  Sequence found in Organisms: Citrus clementina, Citrus sinensis
MASASDSWIKEYNEAIKLADDINGMISERSSMPASGPESQRHASAIRRKITILGTRLDSLQSLLSKLPGKQPISEKEMNRRKDMLANLRSKVNQMASTLNMSNFANRDSLLGPEIKSADVMNRATGLDNQGLVGFQRQIMREQDEGLEKLEETVVSTKHIALAVNEELDLHTRLIDDLDQHVDVTDSRLRRVQKNLAILNKRTKGGCTCMCMLLAVIGIVVLVVVIYMLIKYL

SEQ ID NO: 12496 - protein, 233 aa, Humulus lupulus
MASSSDSWMKEYNEAVKLADDINGMISERSSLPASGPELQRHASAIRRKITILGTRLDSLQSLLFKLPGKQPISEKEMNRRKDMLGNLRTKVSQMASALNMSNFANRDSLLGPEIKPADAMSKAAGLDNNGLVGFQRQVMKEQDEGLEKLEETVISTKHIALAVNEELDLHTRLIDDLDYHVDTTDSRLRRVQKTLAIMNKRTKGGCSCMCMLLSVVGIVALAAIIYLLVKYL

SEQ ID NO: 12497 - protein, 233 aa, Tropaeolum majus
MASSSDSWSQEYNGALKLVDDINGMISERSSFSTSGPEAQRHASAIRRKITILGTRLDSLESLLSKLPGKQQISEKEKNRRKDMLGNLRSKTTQMASTLNMSNFANRDSLLGPDVKQPDLMSRATGMDNQGLVGFQRQIMREQDEGLEKLEETVISTKHIALAVNEELELHTRLIDDLDQHVDVTDSRLRRVQKNLAFLNKRTKGGCSCLCMLLSVIGIAVLVVVIWLLVKYL

SEQ ID NO: 12498 - protein, 231 aa, Malus domestica
MASSSDSWIKEYNEATKLADDISGMISELSTLPAGPDTQRHVSAIRRKITILGTRLDSLQSLLSKLPGKQHISEKEMNRRKDMIGNLRSKVKQMASTLTSNSSNRDSLLGPEINKTDAMGRTVGLDNYGLVGLQRQIMKEQDEGLEKLEETVISTKHIALAVNEELDLHTRLIDDLDDHVEVTDSRLRRVQKNLAVLNKRTKGGCSCMCMLLSVVGIVVLIAVIFLLIKYL

SEQ ID NO: 12499 - protein, 233 aa, Carica papaya
MASSSDSWMKEYHEAVKLADDINGMISERGSFPASEPGSQRHASAIRRKITILGTRLDSLQSLLSKLPGKQPISEKEMNRRKDMLANLKSKTNQMASTLNMSGFANRDSLLGPEQKSEDVMSRTTGLDNQGLVGLQRHIMREQDEGLEKLEETVISTKHIALAVNEELDLHTRLIDNLDQHVDVTDSRLRRVQKNLAILNKRTKGGCSCMCMLLSVIGIVGLIVVIWLLIKYL

SEQ ID NO: 12500 - protein, 232 aa, Vitis vinifera
MASSDSWMKEYNDAVKLADDINGMISERISFSAPGVDAQRHASAIRRKITILGTRLDSLQSLLSKLPGKQPLTEKEMNRRKDMVANLKSKANQMASTLNMSNFANRDSLLGPEIKPADAMNRTTGLDNYGLVGLQRQIMKEQDEGLEKLEETVYSTKHIALAVNEELDLHTRLIDNLDQHVDITDSRLKRVQKNLAILNKRTKGGCSCLCLLLSVVGIVILIVAIWLLVKYL

SEQ ID NO: 12501 - protein, 233 aa, Quercus alba
MAASADSWVKEYNEAVKLADDINGMISERSSLPATGPDAQRHASSIRRKITILGTRLDSLQSLLSKIPGKQPITEKEMNRRKDNLANLRSKVNQMASTLNMSNFANRDSLIGPEIKPADAVSRTVGLDNSGLVGLQRQVMKEQDEDLEKLEVTVVSTKHIALAVNEELDLHTRLIDDLDQHVDVTDSRLRRVQKNLAILNKRTKGGCSCMCLLLSVIGIVVLVAVIYLLIKYL

SEQ ID NO: 12502 - protein, 92 aa, Fagus grandifolia
MAASADSWMKEYNEALKLAEDINGMISERSSLPTTGPDAQRHASAIRRKITILGTRLDSLQSLLSKLPGKQPVTEKEMNRRKDNLANLRYQS

SEQ ID NO: 12503 - protein, 232 aa, Panax ginseng
MASSADSWAREYNEAVKLADDITGMISERTSLPSGPEAQRHSSTIRRKITILGTRLDSLQSLLSKLPGKQPLTDKEMNRRKDMLANLRSKVNQMASTLNMSNFANRDSLLGPESKPVDAMSRATGLDNYGVVGLQRQIMKEQDEGLEKLEETVLSTKHIALAVNEELDLHTRLIDNLDDHVDVTNSRLQRVQKNLAILNKRTKGGCSCMCLLLSVIGIVVLVVAIWLLVKYL

SEQ ID NO: 12504 - protein, 232 aa, Amsonia hubrichtii
MASSGDPWVKEYNEAVKLADDITGMISERSSVPATGPEAQRHSSAIRRKITILGTRLDSLQSLLSRVPGKQLTEKEMNRRKDMLMNLRSKVNQMATALNMSNFANRDSLLGPEIKPVDAMSRTTGLDNNGVVGLQRQVMKEQDEGLEKLEETVISTKHIALAVNEELDLHTRLIDNLDQHVDVTDSRLLRVQRKLAFLNKRTKGGCSCMCMLLSVIGIVVLVAVIYFLVKYL

SEQ ID NO: 12505 - protein, 233 aa, Cannabis sativa
MASSSDSWMKEYSEAVKLADDINGMISERSSLSGSGPEMQRHSSAIRRKITILGTRLDSLHSLLSKLPGKHPLSDKEMNRRKDMLGNLKSKVSQMASSLNMSNFANRDSLLGPEIKPADAMGKAAGLDNNGLVGFQRQVMREQDEGLEKLEETVISTKHIALAVNEELDLHTRLIDDLDYHVDVTDSRLRRVQKTLAIMNKRTKGGCSCMCMLLSVVGIVALAAVIFLLVKYL

SEQ ID NO: 12506 - protein, 233 aa, Castanea mollissima
MAASADSWVKEYNEAVKLAEDINGMISERSSLPATGPDAQRHATAIRRKITILGTRLDSLQSLLSKIPGKQPITEKEMNRRKDNLANLRSKVNQMASTLNMSNFANRDSLIGPEIKPADAVSRTVGLNNSGVVGLQRQVMKEQDEDLEKLEVTVVSTKHIALAVNEELDLHTRLIDDLDQHVDVTDSRLRRVQKNLAILNKRTKGGCSCMCLLLSVIGIVVLVAVIYLLIKYL

SEQ ID NO: 12507 - protein, 144 aa, Fagus grandifolia
MAASADSWMKEYNEALKLAEDINGMVSERISLPTTGPDAQRHASAIRRKITILGTRLDSLQSLLSKLPGKQPVTEKEMNRRKDNLANLRSKVNQMASTLNMSNFANRDSLLGPEIKPADAMSRTVGLGNSGLGWLRTTGYDRAR

SEQ ID NO: 12508 - protein, 280 aa, Vigna unguiculata
MVQWQRHIFPFLRHLHKRVVDPHHANPSAPSLVISRLASSLSQGQVGRRAWTITTPTLPCFSRPIFLGFQHQGISSTAPLLANSSEETPVLSPLVPVSSLGSSKGEDQKQKAVTKPEKVQAILKGIKQSPKKVNLVAALVRGMLVKDALMQLELTIKRASKTVYQVIHSARANASHNHGLDPERLIVAEAFVGKGYFKRRIAYHAKGRSGIIMKPECRLTVVVREITPEEEADIARLRVHNFKKLTKRERRLVPHQLIETTPVWGRKNKSSAQNLSAAPA

SEQ ID NO: 12509 - protein, 277 aa, Glycine max
MVQWQRHVFPFLRHIHKRAVEPHATHSAPSLVISRLASSLSQGQLGRRTWTTTTLPCFSRPIFLGFQHQGISSSANLLANSSEETPVLSPLVPVSLLGSSKGEDQKQKVVTKQEKVQAVLKAIKQSPKKVNLVAALVRGMLVKDALMQLELTIKRAAKTVYQVIHSARANASHNHGLDPERLIVAEAFVGKGFYKKRLWPHAKGKSSLRVRPECRLTVVVREITAEEEAEIARLRVHNFKKRTKRQQRLVPHQLIVSNPIWGRKNKSSGKNLSATPA

SEQ ID NO: 12510 - protein, 277 aa, Glycine max
MVQWHRHVFPFLRHIHKRVLEPQATHSAPSLVISRLASSLSQGQLGRRTWTTTTLPCFSRPVFLTFQHQGISSSAQLLANSSEETPVLSPLAPVSLLSSSKGEDQKQKVVTKPEKVQAILKAIKQSPKKVNLVAALVRGMLVKDALMQLELTIKRAAKTVYQVIHSARANASHNHGLDPERLIVAEAFVGKGFYKKRLWPHAKGKSSLRVRPECRLTVVVREITAEEEAEIARLRVHNFKRLTKRQKRLVPHQLIESNPIWGRKNKSSGQNLSATPA

SEQ ID NO: 12511 - protein, 277 aa, Glycine max
MVQWQRHVFPFLRHIHKRAVEPHATHSAPSLVISRLASSLSQVQLGRRTWTTTTLPCFSRPIFLGSQHQGISSSANLLANSSEETPVLSPLVPVSLLGSSKGEDQKQKVVTKQEKVQAVLKAIKQSPKKVNLVAALVRGMLVKDALMQLELTIKRAAKTVYQVIHSARANASHNHGLDPERLIVAEAFVGKGFYKKRLWPHAKGKSSLRVRPECRLTVVVREITAEEEAEIARLRVHNFKKRTKRQQRLVPHQLIVSNPIWGRKNKSSGKNLSATPA

SEQ ID NO: 12512 - protein, 274 aa, Cajanus cajan
MVQWQRHIFPFLRHIRKGVVDANHSSPNLVISRLASSLSQGQLERRACTTPFPWFSRPIYLAFQLRGISSSTWLLANSSEETPISSPLVPVSLLGSSKGEDQKQKAVTKPENVQAVLKGIKQSPKKVNLVAALVRGMLVKDALMQLELTIKRAAKTVYQVIHSARANASHNHGLDPERLIVAEAFVGKGNFKKRIWYHGRGNAGIRVRAECRLTIVVREITAEEEAEIARLRVHNFKRLTKRQKRLVPHQLIETNPVWGRKNKSSAQNLSAAPA

SEQ ID NO: 12513 - protein, 125 aa, Glycine max
MEVISASSLNPNAPMFVPLAYRTVEDFSDQWWDLVHSSPWFRDYWLRECFQDPQYQYDDVFDFDFDLDLQDKDENEGKEGKEVVSLGVLKWRSCGGGWAEAPRYVEKAPKFVKPKVSPRAIHQPR

SEQ ID NO: 12514 - protein, 127 aa, Vigna unguiculata
MEVIFQSSTSSRLNPNAPMFVPLAYRTVEDFSDEWWDLVHSSSWFRDYWLRECYQDPQFQNEVFDFEFDLDLEEYENEGKEEKEVVSLEVLKWRSCGGGWAEVPRYAEKAPKFIKPRVSPRAIHQPR

SEQ ID NO: 12515 - protein, 125 aa, Glycine max
MEVISASSLNPNAPMFVPLAYRTVEDFSDQWWNLVHSSPWFRDYWLRECFQDPQFQNDDAFDFDFDLDLQDEDEKERKEGKEVVSLGVLKWRSCGGGWAQAPRYVEKAPKFVKPKVSPRAIHQPR

SEQ ID NO: 12516 - protein, 128 aa, Vigna unguiculata
MEVISQSTTSSRLNPNAPMFVPLAYRTVEDFSDEWWDLVHSSSWFRDYWLRECYQDPQFQNEVFDFDFEFDLDLEDENEGKEEKEVVSLEVLKWRSCGGGWAEVPRYAEKAPKFIKPKVSPRAIHQPR

SEQ ID NO: 12517 - protein, 125 aa, Glycine max
MEVISASSLNPNAPMFVPLAYRTVEDFSDQWWDLVHSSPWFRDYWLRECFQDPQFQNDDAFDFDFDLDLQDEDEKERKEGKEVVSLGVLKWRSCGGGWAQAPRYVEKAPKFVKPKVSPRAIHQPR

SEQ ID NO: 12518 - protein, 319 aa, Vigna unguiculata
MLVFFICVLLFFIFVYKFLTAYGDFTLMSKKQPKREEIEDKVVWITGASRGIGEILAKQLASLGAKLIISARNEVELNRVRTQLKGKHAPDEVKILPLDLSSGEDSLRIAVEKAESFFPDSGVDYMIHNAAFERPKTSILDVTEEGLKATFDVNVFGTITLTKLLTPFMLKRGHGHFVVMSSAAGKTPAPGQAVYSASKYALNGYFHTLRSELCQKGIRVTVVCPGPIETSNNAGSKVPSEKRVSSEKCVELTIIAATHGLKEAWISYQPVLAVMYLVQYMPSVGYWLMDKVGKNRVEAAEKKGNTYSLSLLFGKKKAP

SEQ ID NO: 12519 - protein, 319 aa, Glycine max
MLIVFICIFLFFIFLYKFLIAYGDFTLMSKKQPKRQEIEDKVVWITGASRGIGEILAKQFASLGAKLIISARNEAELNRVRTQLKGKHAPDDVKILPLDLSSGEDSLRIAVEKAESFFPDSGVDYMVHNAAFERPKTSILDVTEEGLKATFDVNVLGTITLTKLLAPFMLKRGHGHFVVMSSAAGKTPAPGQAVYSASKYALNGYFHTLRSELCQKGIQVTVVCPGPIETSNNAGSRVPSEKRVPSERCAELTIIAATHGLKEAWISYQPVLAVMYLVQYMPTIGYWVMDKIGKSRVEAAEQKGNTYSLSLLLGKKKAT

SEQ ID NO: 12520 - protein, 319 aa, Cajanus cajan
MFVVLFICLFVFFIFLYKFLTAYGDFTLMSKKQPKRQQIEDKVVWITGASRGIGEILAKQLASLGAKLIISARNEVELNRVRAQLKGKHAPDEVKVLPLDLSSGEGSLREAVEKAESFFPDGVDYMIHNAAFERPKTSILDVTEEGLKATFDVNVLGTITLTKLLARFMLKRGHGHFVVMSSAAGKTPAPGQAVYSASKFALNGYFHTLRSELCQKGIQVTVVCPGPIATSNNAGSRVPSEKRVSAERCAELTIIAATHGLKEAWISYQPVLFVMYLAQYMPTVGYWVMDKVGKNRVEAAEKKGSTYSLSLLLGRKKTA

SEQ ID NO: 12521 - protein, 319 aa, Glycine max
MLVVFIFVFLFFIFLYKFLTAYADFTLMSKKQPKRQEIEDMVVWITGASRGIGEILAKQLASLGAKLIISARNEVELNRVRTQLKGKHAPDEVKILPLDLSSGEDSLWIAVEKAESFFPDSGVDYMMHNAAFERPKTSILDVTEEGLKATFDVNVLGTITLTKLLAPFMLKRGHGHFVVMSSAAAKAPAPGQAVYSASKYAVNGYFHTLRSELCQKGIQVTVICPGPIATSNNAGSRVPSEKRVPSERCAELTIIAVTHGLKEAWISYQPVLTVMYLVQYMPTIGYWVMDKIGKSRVEAAEQKGNTYSLSLMLGKKKAT

SEQ ID NO: 12522 - protein, 319 aa, Cicer arietinum
MLVLFLCLFLLLLFLFKFITAYGDFTLMSKKQPKLEKIEDKVVWITGASRGIGEILAKQLASLGAKLIISARDEAELNRVKSQLKGKHAPDKVKILKLDLTSGEDALREAVDLAECFFPESGIDYMIHNAAFERPKTSVLDVTEDGLKATFDVNVIGTITLTRLLTPFMLKRGKGHFVVMSSAAGKTPAPGQAVYSASKFALNGYFHSLRSELCQKGIQVTVVCPGPIETKNNAGSRVPSEKRVSAEKCAELTIIAATHGLKEAWISYQPVLAVMYLVQYMPTIGYWLMDKVGKNRVEAAEQKGSTYSLSLLLGKNKAA

SEQ ID NO: 12523 - protein, 320 aa, Arachis hypogaea
MVVALLFLGLIVLFLFRFATAYGDFTLMSKKHPKRQEIEDKVVWITGASRGIGEILANQLASLGAKLIISARNEAELERVRTQLKGKHAPGEVKILPLDLASGEESLRKAVEKAESFFPGSGVDYMIHNAAFERPKSSALDVTEEGLKATFDVNVLGTITLTKLLAPFMLKRGRGHFVVMSSAAGKTPAPGQAVYSASKFALNGYFSSLRSELSQQGIRVTVVCPGPIATSNNAGSRVPSEKRVPAEKCAELTIIAATHGLKEAWISYQPVLTVMYLVQYMPTVGHWVMDKVGKNRVEAAVSEKGSTYSMSLLFGKKKAS

SEQ ID NO: 12524 - protein, 318 aa, Medicago truncatula
MLVLFLFIFLLLLFLFKFATAYGDFTLMSKKKPKHELIEDKVFWITGASRGIGEILAQQLASLGAKLILSARDEADLNRVKSQLKGKHADEAKILPLDLTSGEDSLRKVVDEAESLFPDSGVDYMIHNAAYERPKSSVLDVTEESLKATFDVNVFGTITLTRLLTPFMLRRGKGHFVVMSSAAGKTPAPGQAVYSASKYALNGYFHSLRSELCQKGIQVTVVCPGPIETANNSGSQVPSEKRVSAEKCVELTIIAATHGLKEAWISYQPVLAVMYLVQYMPTIGYWLMDKVGKNRVEAAKEKGNAYSLSLLFGKKKAV

SEQ ID NO: 12525 - protein, 317 aa, Lupinus angustifolius
MVFVLICLFLFLFLFKFVTGYGDFTLMSKKKPKLELIEDKVFWITGASRGIGEILAKQLASLGAKLIISARNEAELERVKSQLKGKHAPNDVQVLPLDLASGEDSLRKAVEKAESLFPGSGVDYMIHNAAFERPKVSVLDVTEDELKTTFNINVLGTITLTRLLAPFMLSRGHGHFVVMSSAAGKTPAPGQAIYSASKYALNGYFHSLRSELCQKGIKVTVVCPGPIDTSNNSGAKVSKEKRVSSEKCAELTIIAATHGLKEAWISNQPVLGVMYLVQYVPTIGYWLMDKVGKNRVEAAKQNGNTYSLGLLFGKKKA

SEQ ID NO: 12526 - protein, 317 aa, Lupinus angustifolius
MFIVLISIFLFLFLFKFVTGYGDFTLMSKKKPKLEQIEDKVFWITGASRGIGEVLAKQLASLGAKLIISARNEAELERVKSQLKGKHAPNDVQILPLDLASGEDSLRKAVEKAESLFPGSGVDYMIHNAAFERPKVSALDVTEDDLKATININVLGTITLTRLLAPFMLSRGHGHFVVMSSAAGKTPAPGQAVYSASKYALNGYFHSLRSELCQKGIKVTVVCPGPIDTSNNSGAKVSEKRVSSEKCAELTIIAATHGLKEAWISNQPVLGVMYLVQYVPTIGYWLMDKVGNNRVEAAKHNGNTYSLGLLFGKKKAV

SEQ ID NO: 12527 - protein, 132 aa, Vigna unguiculata
MESQNSPNPNPLHRNSLPSSMPVWPTIDGSLGLSEEESVTYARRFYKFGFALLPLLWAVNCFYFWPVLRHSHSFPRIRPYIVRSAFGFAVFATVLCSWALTFAIGGEGLFGPVWDQLVMYNLADRLGLTSWS

SEQ ID NO: 12528 - protein, 133 aa, Cajanus cajan
MEASESNNPNPNPIRNSLASSVPLWPTIDGPLGLSEEESVSYARRFYNFGFALLPLLWAVNCFYFWPVLRHSHSFPRIRPYVLGSAVGFAVFATLLSSWALTFAIGGERLFGPVWDQLVMYNLADRLGLTGWS

SEQ ID NO: 12529 - protein, 136 aa, Glycine max
MEASQGNHPNPNPNPNRNNSVASSVPVWPTIDGPLGLSEEESVGYARRFYKFGFALLPLLWAVNCFYFWPALRHSHSFPRIRPYVVGSAIGFAVFATLLSSWALTFAIGGERLFGPVWDQLVMYNLADRLGLTGWS

SEQ ID NO: 12530 - protein, 129 aa, Trigonella foenum-graecum
MEASQSHTNNPNPLASSIPVWPTIDGPLGLSEEESVKYARRFYKFGFALLPLLWAVNCFYFWPVIRHSHSFPRIRPYVVGSAVGFTLFAAVLCSWALTFSIGGERLFGPVWDQLVMYNLADRLGLTGWS

SEQ ID NO: 12531 - protein, 131 aa, Glycyrrhiza uralensis
MEASQSQSNNPNQNPLASSVPVWPTIDGPLGVSEEESVKYARRFYKFGFALLPLLWAVNCFYFWPVLRHSHSFPRIRPYVVGSAVGFTVFTTLLCSWALTFAIGGEHLFGPVWDQLVMYNLADRLGLTSWS

SEQ ID NO: 12532 - protein, 133 aa, Medicago truncatula
MESSQSHTNNPNPNPNPLALSVPVWPTIDGPLGLSEEESVKYARRFYKFGFALLPLLWAVNCFYFWPVIRHSHSFPRIRPYVVGSAVGFTVFATLLCSWALTFSIGGERLFGPVWDQLVMYNLADRFGLTGWS

SEQ ID NO: 12533 - protein, 136 aa, Lupinus angustifolius
MEHNNNNPNPNRNPNPIRNPLSSSAPVWPTIDGALGLTEEDSVSYARNFYNFGFALLPLLWAVNCFYFWPVLRHSRSFPRIRPYVVGSAIGLTVFTALLCSWALTFSLGGERLFGPVWDQLVMYNLADRLGLTTWS

SEQ ID NO: 12534 - protein, 221 aa, Vigna unguiculata
MESVRRNAEALVEKMMKGNDASHDAAHVWRVRDLALSLAEEEGLSSDPHSMQIVELAALLHDIADYKYLRDPSEEKIVENFLDQEGVEEEKKLKILKIIREMGFKEEVTGNGSNDWFPEFGVVQDADRLDAIGAIGIARCFTFGGSKKRLLHDPAILPRSDLSKEQYMNKEEQTTINHFHEKLLKLKDMMKTKAGKRRAERRHKFMEEFVKEFYDEWNGLN

SEQ ID NO: 12535 - protein, 223 aa, Cajanus cajan
MDMESVRRNAEALVEKMMKGNDASHDAAHVWRVRDLALSLAQEEGLSSHPHSMQIVELAALLHDIADYKYLRDPSEEKVVENFLDQEGVEEDKKIKILNIIKGMGFKEEVTGNGNSEWFPEFGVVQDADRLDAIGAIGIARCFTFGGSRKRLLHDPAIPPRSDLSKEQYMNKEEQTTINHFHEKLLKLKDMMKTKAGKRRAERRHKFMEEFVKEFYDEWNGLS

SEQ ID NO: 12536 - protein, 223 aa, Glycine max
MEIERLRRNAEALVEKTMKGNDASHDAAHVWRVRDLALSLAKEEGLSSNPHSMEIVELAALLHDIADYKYLRDPSEEKIVENFLDEEGVQEDNKFKILKIIKGMGFKEEVSGSGNSEGFPEFGVVQDADRLDAIGAIGIARCFTFGGSRKRLLHDPAILPRSDLSRQQYMNKEEQTTINHFHEKLLKLKDMMKTKAGKRRAERRHKFMEEFVKEFYDEWNGLS

SEQ ID NO: 12537 - protein, 223 aa, Medicago truncatula
MEKKETIRKAEALVEKAMKGNDASHDAAHVWRVRDLALSLATEEGLSSDPHSMEIVELAALLHDIGDYKYLRDPSEEKTVENFLEEEGVEENKKSKILKIIKEMGFKEEVTGKGTTEWSPEFGVVQDADRLDAIGAIGIARCFTFGGSKKRALHDPAILPRSDLSKEKYMNKEEQTTINHFHEKLLKLKDMMKTKAGQRRAERRHKFMVEFVKEFYDEWNGSS

SEQ ID NO: 12538 - protein, 223 aa, Trigonella foenum-graecum
MERKETVRKAEALVEKAMKGNDASHDAAHVWRVRDLALSLATEEGLSSDPHSMEIVELAALLHDIGDYKYLRDPSEEKTVEKFLDEEGVEESKKSKILKIIKEMGFKEEVTGKGTTEWSPEFGVVQDADRLDAIGAIGIARCFTFGGSKKRALHDPAIFPRSDLSKEKYMNKEEQTTINHFHEKLLKLKDMMKTKAGQRRAERRHKFMEEFVKEFYDEWNGSS

SEQ ID NO: 12539 - protein, 223 aa, Arachis hypogaea
MASRETVRKAEALVEKAMKGNDASHDASHVWRVRDLALSLASEEGLSSNPHSLQIVELAALLHDIADYKYLRDPSEEKIVENFLEEEGIQETIKSKILKIIKGMGFKDEVTGNGSTEWFPEFGVVQDADRLDAIGAIGIARCFTFGGSRNRVLHDPAILPRTDLSKEQYMKKEEQTTINHFHEKLLKLKDMMKTKAGKRRAERRHKFMEEFVKEFYDEWNGVS

SEQ ID NO: 12540 - protein, 223 aa, Arachis hypogaea
MASRETVRKAEALVEKAMKGNDASHDASHVWRVRDLALSLASEEGLSSNPHSLQIVELAALLHDIADYKYLRDPSEEKIVENFLEEEGIQETIKSKILKIIKGMGFKDEVTGNGSTEWFPEFGVVQDADRLDAIGAIGIARCFTFGGSRNRVLHDPAILPRTDLSKEQYMKKEEQTTINHFHEKLLKLKDMMKTKAGKRRAEGRHKFMEEFVKEFYDEWNGVS

SEQ ID NO: 12541 - protein, 221 aa, Cicer arietinum
MEKVRKAAEALVEKTMKGNDASHDAAHVWRVRDLALSLASEEGLSSHPHSMEIVELAALLHDIADYKYLRDPSEEKTVQNFLEEQGVEENNKSKILEIIKEMGFKEEVAGQGNTEWSPEFGVVQDADRLDAIGAIGIARCFTFGGNKKRMLHDPAILPRSNLSKEQYMNKEEQTSINHFHEKLLKLKDMMKTKAGQRRAEKRHKFMEEFVKEFYDEWNGLI

SEQ ID NO: 12542 - protein, 224 aa, Lupinus angustifolius
MGRREERVRKAEEIVEKAMKNQDASHDASHALRVRDLALSLASEEGLSSDFDSMHIIELAALFHDIADHKYIRDPSEEKIVENFLNEEGVEENIKSKILKIIKGMGFKEEVDGNGNTECFPEFGVVQDADRLDAIGAIGIARCFTFGGSRKRLLHDPAILPRSDLSKEQYMNSEQQTTINHFHEKLFKLKDMMKTKAGQRRAERRHKFMEEFVKEFYEEWNGIS

SEQ ID NO: 12543 - protein, 265 aa, Vigna unguiculata
MDGAKKHGAVLAFTDGAVLPVSQVFEAIRELGNEGVQESDPLVLTSASLLSNLPVESSSVDSAILIWLSSDCPGAQLIQEILRVLKVGGIILIRKSPQSTVGSFDKIISDLQGKLLLAGFSETQILQSTGVKAKKPSWKVGSSFSLKKVIKSSPKIQIDVDSDLIDEDSLLTEEDLKKPQLPPGDCEIGSTRKACKNCTCGRAEEEEKVLKLGLTAEQINNPQSACGSCGLGDAFRCSTCPYKGLPPFKLGEKVALSGNFLAADI

SEQ ID NO: 12544 - protein, 265 aa, Glycine max
MDGAKTHGAVLACTDGAVLPVSQVFDAIRELGNEGVEQWDPLVLTSASLLSKLPVDSSSVDFLILIWLSIDCPVDQLIQEILRVLKVDGTILIRKSSQSAVGSFDKIISALENKLLLAGFTETQVLQLTGIKAKKPSWKIGSSFALKKVIKSSPKMQIDFDSDLIDEDSLLTEEDLKKPQLPPGDCEIGSTRKACKNCTCGRAEEDEKVLKLGLTTEQINNPQSACGNCGLGDAFRCSTCPYKGLPAFKLGEKVALSGNFLAADI

SEQ ID NO: 12545 - protein, 265 aa, Glycine max
MDGAKTHGAVLACTDGAVLPVSQVFDAIRELGNEGVEQWDPLVLTSASLLSKLPVDSSSVDFLILIWLSIDCPVDQLIQEILRVLKVDGTILIRKSSQSAVGSFDKIISALENKLLLAGFTETQVLQLTGIKAKKPSWKIGSSFALKKVIKSSPKMQIDFDSDLIDEDSLLTEEDLKKPQLPPGDCEIGSTRKACKNCTCGRAEEDEKILKLGLTTEQINNPQSACGNCGLGDAFRCSTCPYKGLPAFKLGEKVALSGNFLAADI

SEQ ID NO: 12546 - protein, 265 aa, Cajanus cajan
MDGAKTHGAVLACTDGAVLPISQVFNAIRELGNEGIEQWDPLVLTSATLLSKLPVDSSSVDFVILIWLSIDCPVDQLVQEILRVLKVGGTILIRKSSQSSVNSFDKIISDLENRLLLAGFSETQVLQSTGIIAKKPSWKIGSSFALKKVIKSSPKMQIDVDSDLIDEDSLLTEEDLKKPQLPPGDCEIGSTRKACKNCTCGRAEEEEKVLKLGLTAEQINNPQSACGNCGLGDAFRCSTCPYKGLPAFKLGEKVALSGNFLAADI

SEQ ID NO: 12547 - protein, 260 aa, Glycine max
MDGAVLACTDGAVLPVSQVFDAIRELGNGGLEQWDPLVLTSASLLSKLPVDSSSVDFVILIWLSIDCPVDQLIQEILRVLKVDGTILIRKSSQSAVGSFDKIISSLENKLLLAGFTEPQVLQSAGIKAKKPSWKIGSSFALKKVIRSSPKMQIDFDSDLIDEDSLLTEEDLKKPQLPPGDCEIGSTRKACKNCTCGRAEEEEKVLKLGLTTEQIDNPQSACGNCGLGDAFRCSTCPYKGLPAFKLGEKVALSGNFLAADI

SEQ ID NO: 12548 - protein, 291 aa, Glycine max
MAMASNHLRNLNRISIHHFQALLNDTTRFFSDAASSLPQPQPPSSSLKHNELAKFAAIADTWWDSEGPFKPLHVMNPTRLAFIRSALCRHFKKDPYNAKPLEGLKIIDVGCGGGILSEPLARLGATVTGVDAVEKNIKIAQLHAGLDPATSSIEFCCTTAEKLVEEGRTFDAVMALEVIEHVADPAEFCKSLSALTVPEGATVISTINRSMRAYATAIVAAEYILRWLPRGTHQWSSFLTPEELVLILQRAGINVEEMAGFVYNPVTGRWSLSDDISVNFIAFGTKSNNTE

SEQ ID NO: 12549 - protein, 298 aa, Glycine max
MSMAFNHLRNLNRISIHRILHHRFQPLLNATTRFFIDAAASSMSQPQPKQQPSAPSSSLKHNELAKFAAIADTWWDSEGPFKPLHVMNPTRLAFIRSALCRHFKKDPYSAKPLEGLKIVDVGCGGGILSEPLARLGATVTGVDAVEKNIKIAQLHAGLDPATSSIEFCCTTAEKLVEEGRTFDAVMALEVIEHVADPAEFCKSLSALTVPDGATVISTINRSMRAYTTAIVAAEYILRWLPRGTHQWSSFLTPEELVLILQRAGINVEEMAGIMYNPVTGGWSLSDDISVNFIAFGTK

SEQ ID NO: 12550 - protein, 296 aa, Glycine max
MAFNHLRNLNRISIHRILHHRFQPLLNATTRFFIDAAASSMSQPQPKQQPSAPSSSLKHNELAKFAAIADTWWDSEGPFKPLHVMNPTRLAFIRSALCRHFKKDPYSAKPLEGLKIVDVGCGGGILSEPLARLGATVTGVDAVEKNIKIAQLHAGLDPATSSIEFCCTTAEKLVEEGRTFDAVMALEVIEHVADPAEFCKSLSALTVPDGATVISTINRSMRAYTTAIVAAEYILRWLPRGTHQWSSFLTPEELVLILQRAGINVEEMAGIMYNPVTGGWSLSDDISVNFIAFGTK

SEQ ID NO: 12551 - protein, 300 aa, Cicer arietinum
MKLFNHLRNLNGTTTHRILRNRFHPLFNNTKFFSDAPFPQQPTTSHVKPPSPPSSLNRNELAKFAAIAESWWDSEGPFKPLHVMNPTRLAFIRSALCRHFKKDPYSAKPLEGLKIVDVGCGGGILSEPLARMGATVTGVDAVEKNIKIARLHADLDPTTSTIEFCCTTAEKLVEEGRKFDAVMALEVIEHVANPSEFCKSLAALTIPDGATVISTINRSMRAYATAIVAAEYILRWLPMGTHEWSSFLTPEELVLILQRAGINVEEMAGFAYNPMTGRWSLSDDISVNFIAMGTKTNNTE

SEQ ID NO: 12552 - protein, 391 aa, Vigna unguiculata
MAFLPSFAPFVFLLLVIGCTARPFYPLPNKGDGGSRKPLQTFRPYNIAHRGSNGELPEETSAAYTKAIEEGADFIETDILSSKDGVLICFHDFNLDNTTDIANHEEFADRKRTYEVEGKNSTGFFTVDFTLKELKSLRVKQRFGYRDQQFNGKFQIITFEEFINIALDAPRVVGIYPEIKNPVFINQHVKWSDGKIFEDKFVETLQKYGLKGSYLSKDWLRQPVFIQSFAPTSLVYIANKTDLPKIFLIDDVDIPTQDTNQSYWEIISDEYLNYIKQYVVGIGPWKDTLVPVVNNYVATPTDLVSRAHAHNLQVHPYTYRNENLFLHFNFSQDPYVEYDYWINKIGVDGLFTDFTGSLHRFQEWTSKHQDDDDNNASKLLHKIALLLSSYN

SEQ ID NO: 12553 - protein, 392 aa, Glycine max
MASLPSFTPFVFLLLVIGCNARPLYPLPSKGDDGNRKPLQTFRPYNIAHRGSNGELPEETHPAYLRAIEEGADFIETDILSSKDGVLVCFHDVTLDNTTDIANRTEFANRKRTYEVQGENMTGFFTVDFTLKELKSLRVKQRCSFRDQQFNGKFQIITFEEFITIALDAPRVVGIYPEIKNPVFINQHVKWSHGKRFEDKFVETLQKYGYKGSYLSKDWLRQPVFIQSFAPTSLVYISNKTDLPKVFLIDDVTVPTQDTNQSYWEITSDEYLEYIKQYVVGIGPWKDTVVPVVKNYMTNPTNLVARAHAHNLQVHPYTYRNEFPFLHFNFSQDPYMEYDFWINKIGVDGLFTDFTGSLHRYQEWTSNRKDDDDDKTESNLLHKIALLVSSYE

SEQ ID NO: 12554 - protein, 393 aa, Cajanus cajan
MASSISFAPFLLLLLVIGCTARPLYRLPSQGHDGSRKPLQTFRPYNIAHRGSNGELPEETRPAYLRAIEEGADFIETDILSSKDGVLICFHDVTLDNTTDVANHKEFADRKRTYEVQGENITGFFTVDFSLKELKSLRVRQRFSFRDQQFNGKFQIITFEEFITIALDAPRVVGIYPEIKNPVFINKRVKWLHGKSFEDKFVETLQKYGYKGSYLSKDWLRQPAFIQSFAPTSLVYISNKTDLPKVLLIDDVTVPTQDTNQSYWEITSNKYLDYIKQYVVGIGPWKDTLVPVVNNYMINPTDLVTRAHAHNLQVHPYTYRNENRFLHFNFSQDPYMEYDYWINKIGVDGLFTDFTGSLHHFQEWTTNRQDDDNKSESKLLHKIALLVSSYKKP

SEQ ID NO: 12555 - protein, 390 aa, Cicer arietinum
MVSSPSFATFVFLLLVIGGTSRPLYPLPGKGDDGSRKSLQTFRPYNIAHRGSNGELPEETRQAYMRAIEEGADFIETDILSSSDGVLICFHDVTLDETTDIANYKEFANRKRTYEVQGVNTTGFFIVDFTLKELKTLRVNQRYSYRDQQFNGKFQIITFEEFINIALHAPRVVGIYPEIKNPIFINQYVKWSDGKIFEDKFVETLQKYGYKGSYLSKDWLKQPVFIQSFAPSSLVYISNQTDLPKIFLIDDVTIPTQDTNQSYWEITSDGYLDYIKQYVVGIGPWKDTVVPVVENYAMTPSNLVARAHARNLQVHPYTYRNENKFLHFNFSQDPYKEYDYWINKIGVDGLFTDFTGSLHNFQEWTSPNRQDDKIASELLHKIAILVSPFD

SEQ ID NO: 12556 - protein, 391 aa, Medicago truncatula
MSSSLSGFAPFVFLLLVIGGTARPLYPLPGKGDHGTKQPLQTFRPYNVAHRGSNGELPEETREAYLRAIEEGADFIETDILSSKDGVLICFHDVTLDNTTDIAKYKEFTDRKRTYEVEGVNITGFFVVDFTLKELKSLRVNQRYCFRDQQFNGKFQIITFEEFITIALDAPRVVGIYPEIKNPVLINQHVKWSDGKRFEDRFVETLRKYGYKGSYLSKHWLKQPAFIQSFAPTSLVYISNQTDLPKIFLIDNVDISTQDTNQSYWEITSDTYLDYIKQYVVGIGPWKDTIVPEVNNYVMTPSDLVARAHAHNLQVHPYTYRNENKFLHFNFSQDPYKEYDYWINKMGIDGLFTDFTGSLHNFQEWTTPNRQDDKTASELLHKIAVLASAYE

SEQ ID NO: 12557 - protein, 290 aa, Vigna unguiculata
MHCVQVSAIGGFASPIPKSSVSLWSTTMAVASPNSLRVAAAQMTSVSDLAANFATCSRLVKEAASAGAKLLCFPEAFSYVGTKDGDSVSVAQPLDGPIMNQYCSLARESSIWLSLGGFQEKGSDPTHLCNTHVIVDETGKIRSSYRKIHLFDVDVPGGRVYKESKFTEPGKDIVAVDSPIGRLGLSVCYDLRFPEMYQLLRFQHEAQVLLVPSAFTKVTGAAHWEILLRARAIETQCYVIAAAQTGKHGDKRESHGDTLIIDPWGTIVGRLPDRLSTGIVVADIDLSLVD

SEQ ID NO: 12558 - protein, 311 aa, Glycine max
MFCVSVGVNFIGGFAFASGIPKSSVSATMASNSVRVAAAQMTSISDLAANLATCSRLIKEAASAGAKLLCFPEAFSYVGTKDGDSVRVAEPLDGPIMSHYCSLARESSIWLSLGGFQEKGSDPQRLSNTHVIVDDTGKIISSYSKIHLFDVDVPGGRVYKESSFTESGKDIVAVDSPVGRLGLSVCYDLRFPEMYQLLRFQHEAQVLLVPAAFTTVTGEAHWEILLRARAIETQCYVIAAAQAGKHNDKRESYGDTLIIDPWGTIVGRLPDRLSTGIVVADIDLSFVDSVREKMPIAKQRKPIGFWKAASL

SEQ ID NO: 12559 - protein, 304 aa, Cajanus cajan
MFCASVNVTAPIPKSSPLSVSATMSPVRVAAAQMTSISDVAANFATCSRLVKEAASAGAKLLCFPEAFSFISTNDGDSVTVAEPLDGPIMNHYCSLARESNIWLSLGGFQEKASDPQHLCNTHVIVDDTGKIRSTYKKIHLFDVDVPGGRVYKESRFTEPGKDIVAVDSPIGRLGLSVCYDLRFPEMYQLLRFKHEAQILLVPSAFTNVTGEAHWEILLRARAIETQCYVVAAAQAGKHNHKRESYGDTLIVDPWGTVVGRLPDRLSTGIVVADIDLSYVDSVREKMPIAQQRKPIDFWKSASL

SEQ ID NO: 12560 - protein, 327 aa, Cicer arietinum
MCSVNEIIKINTTKIPSSIHRPLLLASRQRHRLRVSISGAGESTMSTNSVRVAAAQMTSITDLASNFATCSRLVKEAASAGAKLLCFPEAFSFVGTKDGDSVRIAQPLDGPIMDQYCSLARESSIWLSLGGFQEKGSDPQHLFNTHVIVDDAGKIQSTYRKIHLFDVDVPGGRVYKESSFTEEGKDVVAVDSPIGRLGLSVCYDLRFPEIYQLLRFQHGAQILLVPAAFTKVTGEAHWEILLRARAIENQCYVIAAAQAGTHNDKRESYGDTLIIDPWGTIVSRLPDRLSTGIVVADIDLSLVDSVREKMPIAKQRKPFDFWKAASL

SEQ ID NO: 12561 - protein, 321 aa, Medicago truncatula
MRLSSCWVNNNIRINNTNGTSIRRRLRASLSVTTGESTMATNSVRVAAAQMTSITDLASNFSTCSRLVKEAASAGAKLLCFPEAFSFVGAKDGDSVSIAQPLDGPIMDQYCSLARESSIWLSLGGFQEKGSDPRHLFNTHVVVDDTGKIQTTYRKIHLFDVDVPGGRVYKESNFTESGKDIVAVDSPIGRLGLSVCYDLRFPELYQLLRFQHGAQILLVPAAFTKVTGEAHWEILLRARAIENQCYVIAAAQAGTHNDKRESYGDTLIIDPWGTVVGRLPDRLSTGIVVADIDLSLVDSVREKMPIAKQRKPFDFWKAASL

SEQ ID NO: 12562 - protein, 269 aa, Glycine max
MASNLAANMATCSHLLKEAASAGAKLLCFPEAFSYVGTMDGDSVLVAEPLDGPIMNHYCSLARESDIWLSLGGFQEIGSDPQHLCNTHVIVDDTGKIISSYRKIHLFDVDVPGGRVYKESSFTESGRDIVAVDSPIGRLGLSVCYDLRFPEMYQLLRFQHEAQVLLVPAAFTTVTGEAHWEILLRARVIETQCYVIAAAQAGKHNDKRESYGNTLIIDPWGTIVGRLPDRLSTGIVVADIDLSFVDSVREKMPIAKQRKPIDFWKAASL

SEQ ID NO: 12563 - protein, 325 aa, Trigonella foenum-graecum
GRGNSIINNININTTSIPLLLLSSSLQRRGFRASLSVAGDSTMAVNSVRVAAAQMTSVTDLASNFTTCSRLVKEAASAGAKLLCFPEAFSFVGAKDGDSVRIAQPLDGPIMDQYCSLARESSIWLSLGGFQEKGSDPQHLFNTHVVVDHTGKIQSTYRKIHLFDVDVPGGRVYKESSFTESGKDIVAVDSPIGRLGLSVCYDLRFPEIYQLLRFQHGAQILLVPAAFTKVTGEAHWEILLRARAIENQCYVIAAAQTGTHNDKRESYGDTLIIDPWGTIVGRLPDRLSTGIVVADIDLSLVDSVREKMPIAKQRKPFDFWKAASL

SEQ ID NO: 12564 - protein, 325 aa, Vigna unguiculata
MKAIVITSPGGPEVLQLQEVEDPQLRDDEVLIGVHATALNRADTLQRKGFHPPPKGASPYLGLECSGTVLSIGKNVSKWKIGDQVCALLAGGGYAEKVAVPSGQVLPIPPGVSLTDAASFPEVACTVWSTIFMTSRLSQGETLLIHGGSSGIGTFAIQIAKYRGARVYVTAGSEEKLAFCKSIGADVAINYKTEDFVARVKEETGGQGVDVILDCMGASYYQRNIDSLNLDGRLFIIGFQGGVTTEVDFRPLLAKRLTVQAAGLRNRSLENKAVIISEVEKNVWPAIAEGKVKPVVYKSFPLAEAAEAHLLMESSEHIGKILLVP

SEQ ID NO: 12565 - protein, 325 aa, Glycine max
MKAIVITRPGGPEVLQLEEVEDPQVGDDELLIGVHATSLNRADTFQRKGSYPPPKGASPYLGLECSGTVLSLGKNVSSWKIGDQVCALLAGGGYAEKVAVPVGQVLPVPAGVSLTDAASFPEVACTVWSTVFMMSRLSQGETLLVHGGSSGIGTFAIQIAKYRGSRVFVTAGSEEKLAFCKSIGADVGINYKTEDFVARVKEETGGQGVDVILDCMGASYYQRNLDSLNFDGRLFIIGFQGGVSTQADLRPLLAKRLTVQGAGLRNRSLENKAVIVSEVEKNVWPAIAEGKVKPVVYKSFPLSEAAEAHQLMESSQHIGKILLLP

SEQ ID NO: 12566 - protein, 325 aa, Cicer arietinum
MKAIVITTPGGPEVLQLQEVEDPQLRDDEVLIRVHATALNRADTLQRKGSYPPPKGASPYPGLECSGTIESLGKNVSKWKIGDQVCALLAGGGYAEKVAVPEGQVLPVPPGVSLKDATSFPEVACTVWSTIFMMSRLSHGETLLIHGGSSGIGTFAIQIAKYRGSRVFVTAGSEEKLAFCKSIGADVGINYKTEDFVARVKEETGGQGVDVILDCMGASYYQRNLDSLNFDGRLFIIGFQGGVSTEVDLRALLGKRLTVQGAGLRSRSPENKALIVDEVAKNVWPAIAEGKVKPVVYKSFPLSEAAEAHRLMESSQHIGKILLLP

SEQ ID NO: 12567 - protein, 325 aa, Cajanus cajan
MKAIVISSPGGPEVLQLREVEDPQLRDDEVLIQVHATALNRADTFQRKGSYSPPKGASPYLGLECSGTVLSVGLHVSRWKIGDQVCALLAGGGYAQKVAVPAVQLLPLPPGLSLTDAATFPEVACTVWSTVFMTSRLSQGESFLIHGGSSGIGTFAIQIAKYRGARVFVTAGSEEKLAFCKSIGADVCINYKTQDFVERVKEETGGQGVDVILDCMGASYYQRNLDSLNFDGRLFIIGFQGGVTTQVDLRPLLAKRLTVQGAALRSRSVENKAVIVSEVEKNVWPAIAEGKVKPVIYKSFPLSEAAEAHRLMESSQHIGKILLVP

SEQ ID NO: 12568 - protein, 325 aa, Arachis hypogaea
MKAVVITTPGGPEVLQLQEVEDPHIGDDEVLIRVEATALNRADTLQRKGSYPPPKGASPYPGLECSGTIESIGKNVSRWKVGDQVCALLAGGGYAEKVAVPAGQVLPVPPGISLKDAASFPEVSCTVWSTVFMMSRLSKGETFLIHGGSSGIGTFAIQIAKYRGARVFVTAGSEEKLAFCKDIGADVCINYKTEDFVARVKEETGGQGVDVILDCMGASYYQRNLDSLNFDGRLFIIGFQGGTSTQTDLRTLFAKRLTVQGAGLRNRSIENKAVIVSEVEKNVWPAIAEGKVKPVVYKHFPLSEAAEAHRLMESSQHIGKILLVP

SEQ ID NO: 12569 - protein, 325 aa, Lupinus angustifolius
MKAIVITKPGGPEVLQLQEVEDPQIKDDEVLIRVEATALNRADTVQRKGSYPTPKGASPYPGLECSGTIESVGKNVSRWKIGDQVCALLSGGGYAEKVAAPAGQVLPVPPGLSLKDAASFPEVACTVWSTIFMTSRLSAGETLLIHGGSSGIGTFAIQIAKYRGSRVFVTAGNEEKLAFCKGIGADVGINYKTEDFVARVKEETGGQGVDVILDCMGASYYQKNLESLNFDGRLFIIGFQGGVSTEFDLRPLVGKRLTVQGAGLRNRSPENKALIINEVEKNVWPAIAEGKVKPVVYKSFPLSEAAEGHRLMESNQHIGKILLFP

SEQ ID NO: 12570 - protein, 325 aa, Trigonella foenum-graecum
MKAIVITTPGGPEVLQLQEVEDPQFKDDEVLIRVHATALNRADTLQRKGAYPPPQGASPYPGLECSGIVESVGKNVSKWKIGDQVCALLSGGGYAEKVAVAEGQVLPVPPGISLKDAASFPEVACTVWSTIFMTSRLSKGETLLIHGGSSGIGTFAIQIAKYLGSRVFVTAGSEEKLAFCKRIGADVGINYKTEDFVARVKEETGGQGVDVILDCMGASYYQRNLDSLNFDGRLFIIGFQGGVSTEVDLRALFGKRLTVQGAGLRSRSPENKAVIVAEVEKNVWPAIAEGKVKPVVYKSFPLSEAAEAHRLMESSQHIGKILLVP

SEQ ID NO: 12571 - protein, 325 aa, Lotus japonicus
MKAVVITTPGGPQVLQLQDVEDPHLGDGEVLIRVHATALNRADTLQRKGAYPPPKGASSYPGLECSGTVESIGKHVSRWKIGDQVCALLAGGGYAEKVAVPQEQILPVPPGVSLTDAASFPEVACTVWSTIFMMSRLTQGETLLIHGGSSGIGTFAIQIAKYRGARVFVTAGSEEKLAFCKGIGADVGINYKTEDFVARVKEETGGQGVDVILDCMGASYYKRNLDSLNFDGRLFIIGFQGGTSTEVDLRPLVAKRLTVQGAGLRNRSIENKAVIVTEVEKNVWPAIAEGKVKPVIYKSFPLSEAAEAHQLMESSHHIGKILLLT

SEQ ID NO: 12572 - protein, 325 aa, Lupinus angustifolius
MKAIVITTPGDPEVLQLQQVEDPQINDDEVLIRVEATALNRADTLQRKGSYPPPKGASPYPGLECSGTVESVGKNISRWKIGDQVCALLAGGGYAEKVAVPAGQVLPVPPGLSLKDAASFPEVACTVWSTIFMTSRLSAGETLLIHGGSSGIGTFAIQIAKYLGSRVFVTAGSEEKLAFCKGLGADVGINYKTEDFVARVKEETGGQGVDVILDCMGASYYQRNLDSLNFDGRLFIIAFQGGVSTEFDLRALFGKRLTVQGAGLRSRSLENKAAIVSEVEKNVWPAIAEGKVKPVVYKSFPLSEAAEAHRLMESSQHIGKILLFP

SEQ ID NO: 12573 - protein, 325 aa, Arachis hypogaea
MKAVVITTPGGPEVLQLQEVEDPHIGDDEVLIRVEATALNRADTVQRMGSYPPPKGASPYPGLECSGTIESIGKKVSRWKVGDQVCALLAGGGYAEKVAVPAGQVLPVPPGISLKDAASFPEVSCTVWSTVFMMSRLSKGETFLIHGGSSGIGTFAIQIAKYRGATVFVTAGSEEKLAFCKDIGADVCINYKTEDFVARVKEKTGGQGVDVILDCMGASYYQRNLDSLNFDGRLFIIGFQGGTSTQTDLRTLFAKRLTVQGAGLRNRSVENKAVIVSEVEKNVWPAIAEGKVKPVVYKHFPLSEAAEAHRLMESSQHVGKILLVP

SEQ ID NO: 12574 - protein, 324 aa, Arachis hypogaea
KAVVITTPGGPEVLQLQEVEDPHIGDDEVLIRVEATALNRADTVQRMGSYPPPKGASPYPGLECSGTIESIGKKVSRWKVGDQVCALLAGGGYAEKVAVPAGQVLPVPPGISLKDAASFPEVSCTVWSTVFMMSRLSKGETFLIHGGSSGIGTFAIQIAKYRGATVFVTAGSEEKLAFCKDIGADVCINYKTEDFVARVKEKTGGQGVDVILDCMGASYYQRNLDSLNFDGRLFIIGFQGGTSTQTDLRTLFAKRLTVQGAGLRNRSVENKAVIVSEVEKNVWPAIAEGKVKPVVYKHFPLSEAAEAHRLMESSQHVGKILLVP

SEQ ID NO: 12575 - protein, 325 aa, Arachis hypogaea
MKAAVITTPGGPEVLQLQEVEDPHIGDDEVLIRVEATALNRADTVQRMGSYPPPKGASPYPGLECSGTIESIGKKVSRWKVGDQVCALLAGGGYAEKVAVPAGQVLPVPPGISLKDAASFPEVSCTVWSTVFMMSRLSKGETFLIHGGSSGIGTFAIQIAKYRGATVFVTAGSEEKLAFCKDIGADVCINYKTEDFVARVKEKTGGQGVDVILDCMGASYYQRNLDSLNFDGRLFIIGFQGGTSTQTDLRTLFAKRLTVQGAGLRNRSIENKAVIVSEVEKNVWPAIAEGKVKPVVYKHFPLSEAAEAHRLMESSQHVGKILLVP

SEQ ID NO: 12576 - protein, 325 aa, Medicago truncatula
MKAIVITKPGEPEVLQLQEVQDPQIKDDEVLIKVHATALNRADTLQRKGAYPPPQGASPYPGLECSGIIEFVGKNVSKWKIGDQVCALLAGGGYAEKVAVAEGQVLPVPPGISLKDAASFPEVACTVWSTIFMTSRLSKGETLLIHGGSSGIGTFAIQIAKYLGSRVFVTAGSEEKLAFCKSIGADVGINYKTEDFVARVKEETGGQGVDVILDCMGASYYQRNLASLNFDGRLFIIGFQGGVSTELDLRALFGKRLTVQAAGLRSRSPENKAVIVAEVEKNVWPAIAEGKVKPVVYKSFPLSEAAEAHRLMESSQHIGKILLVA

SEQ ID NO: 12577 - protein, 325 aa, Medicago truncatula
MKAIVITTPGGPEVLQLQEVQDPQPKDNEVLIRVHATALNSADTVQRKGFYPIPQGASPYPGLECSGTIVCVGINVSKWKIGDQVCALLAGGGYAEKVAVPEGQVLPVPPGISLKDAASFTEVACTVWSTIFMTSRLSKGETLLVHGGSSGIGTFAIQIAKYQGSKVFVTAGSEEKLAFCKSIGADVGINYKTEDFVARVKEETGGQGVDVILDCMGASYYQRNLASLNFDGRLFIIGFQGGVSTEVDLRALFGKRLTVQAAGLRSRSPENKAVIVAEVEKNVWPAIAEGKVKPVVYKSFPLSEAAEAHRLMESSQHIGKILLVA

SEQ ID NO: 12578 - protein, 855 aa, Medicago truncatula
MKAIVITTPGGPEVLQLQEVQDPQPKDNEVLIRVHATALNSADTVQRKGFYPIPQGASPYPGLECSGTIVCVGINVSKWKIGDQVCALLAGGGYAEKVAVPEGQVLPVPPGISLKDAASFTEVACTVWSTIFMTSRLSKGETLLVHGGSSGIGTFAIQIAKYQGSKVFVTAGSEEKLAFCKSIGADVGINYKTEDFVARVKEETGGQGVDVILDCMGASYYQRNLASLNFDGRLFIIGFQGGVSTEVDLRALFGKRLTVQAAGLRSRSPENKAVIVAEVEKNVWPAIAEGKVKPVVYKSFPLSEAAEAHRLMESSQHIGKIFHIYMVVTEMSSFSLLCILALLLVIGHVANAQNSRADYVNAHNDARRQVGVGDIVWDNTVASFAQDYANQRKGDCQLIHSGGGGRYGENLAWSSGDMSGSDAVKLWVNEKADYNYNSNTCASGKVCGHYTQVVWRNSQRVGCAKVRCDNNRGTFITCNYDPPGNYVGEKFKDSILSYCVVMDLTQLNPAQITVYGSAFCVMLSMHFTLQLLSQHLFYWKNPKEQKAIIIIILMAPIYAIVSFVGLLDIRGSKEFFTLLESIKECYEAFVIAKFLSLMYSYLKISITKNIVPDEIKGREIHHSFPMTLFQPHSVRLNHHNLKLLKYWTWQFVVIRPVCSILMITLQLVGFYPNWLSWIITIILNISVSLALYSLVIFYHVFAKELEPHKPLAKFLCIKGIVFFCFWQGLVLDGLVAVGVIQSRHLKLDVEHIEEAMQNILVCIEMVVFSVLQQYAYHASPYSGEVEKMFFFYVWSQPRTMNINQLSEHSFKLLDYFLNVRVNRSLVRSQMLQNTFLIEFFLKKLDIIYSSNYSSD

SEQ ID NO: 12579 - protein, 319 aa, Medicago truncatula
MKAIVITKPGEPEVLQLQEVQDPQIKDDEVLIKVHATALNRADTLQRKGAYPPPQGASPYPGLECSGIIEFVGKNVSKWKIGDQVCALLAGGGYAEKVAVAEGQVLPVPPGISLKDAASFPEVACTVWSTIFMTSRLSKGETLLIHGGSSGIGTFAIQIAKYLGSRVFVTAGSEEKLAFCKSIGADVGINYKTEDFVARVKEETGGQGVDVILDCMGASYYQRNLASLNFDGRLFIIGFQGGVSTELDLRALFGKRLTVQAAGLRSRSPENKAVIVAEVEKNVWPAIAEGKVKPVVYKSFPLSEAAEAHRLMESSQHIG

SEQ ID NO: 12580 - protein, 325 aa, Cucurbita pepo
MKAIVISEPGEAEVLQLQEVEDPIIKDDEVLIKVEATALNRADTLQRKGLYPPPKGASPYLGLECSGIVEAVGKNVSRWKIGDQVCALLAGGGYAEKVAVPAGQVLPIPPGVSLKDAASIPEVACTVWSTVFMTSRLSRGETLLVHGGSSGIGTFAIQIAKYQGARVFVTAGSEDKLAVCKDLGADVCINYKTEDFVARVKEETNGKGVDVILDSIGAPYFQRNLESLNLDGRLFIIGTMGGAVTQLDFRSLFAKRLTVQAAGLRNRSLENKAVIVSEVEKIVWPAIAAGKVKPVIFKYLPLSAAAEAHKLMESSKHIGKILLAP

SEQ ID NO: 12581 - protein, 325 aa, Manihot esculenta
MKAVVITSLGGPEVLQLQEVDDPQIKDDEVLIKVEATAVNRADTLQRIGKHPPPKGASPYPGLECSGTIEAVGKLVSRWKVGDQVCALLSGGGYAEKVAVPAGQILPVPPGISLKDAGGFPEVACTVWSTVFMMSRLSAGETFLVHGGSSGIGTFAIQIAKYQGVRVFVTAGSEEKLAVCKELGADVCINYKTEDFVARVKEETGGKGVDVILDCIGASYFQRNLDSLNVGGRLFIIGFMGGAVTELNLSILLAKRLTVQAAGLRGRSAENKAEIVNEVEKNVWPAIVEGKVKPVVYKHFPLAEAAEAHRLLESSQHIGKILLVP

SEQ ID NO: 12582 - protein, 325 aa, Citrus clementina
MKAIVITQPGSPEVLQLQEVEDPQIKDDEVLIKVEATALNRADTLQRKGSYPPPKGASPHPGLECSGTILSVGKNVSRWKVGDQVCALLGGGGYAEKVAVPAGQVLPVPSGVSLKDAAAFPEVACTVWSTVFMTSHLSPGESFLVHGGSSGIGTFAIQMGKCQGVRVFVTAGSEEKLAVCKDLGADVCINYKTEDFVARVKEETGGKGVDVILDCMGASYFQRNLDSLNIDGRLFIIGTQGGAKTELNITSLFAKRLTVQAAGLRSRSTENKALIVSEVEKNVWPAIAVGKVKPVIYKYLPLCEAAEAHQLMESSQHIGKIMLVP

SEQ ID NO: 12583 - protein, 325 aa, Vitis vinifera
MKAVVITTPGDPQVLQVQEVENPEIGDNEVLIRVEASALNRADTLQRKGLHPPPKGSSPYPGLECSGIIEAVGKAVVRWKVGDQVCALLAGGGYAEKVSVPAGQVLPVPSGVSLKDAAAIPEVACTVWSTVFMMSRLTAGETFLIHGGSSGIGTFAIQIAKYIGARVFVTAGNEEKLAVCKDLGADVCINYKTEDFVARVKEETGGKGVDVILDNIGGAYFQRNIDSLNVDGRLFIIGFQGGTVAEVNLSGLLARRLTVQAAGLRNRSLENKAAIVSEVEKNVWPAIVAGKVKPVVYKYFPLTEAAEAHQLMESSNHVGKILLIP

SEQ ID NO: 12584 - protein, 325 aa, Humulus lupulus
MKAIVITTPGGPEVLQLQEVEDPDLNADEVLIKVEATALNRADTLQRKGQYPPPKGTSPYPGLECSGTVEAVGKDVSRWKVGDQVCCLLSGGGYAEKVAVPAGQVLPLPPGVSLKEATAFPEVACTVWSTVFMTSRLTAGESLLVHGGSSGIGTFAIQIAKYIGARVFITAGSEEKLAFCKNLGADVCINYKTEDFVARVKEETGGKGVDVILDSLGASYFKKNLESLNYDGRLFIIGFMGGAVTELDLRALFPKRLTVQAAGLRTRTLENKAVIVSEVEKNVWPAITAGKVKPVIYKSYPLSEAAEAHRLMESSNHIGKILLVP

SEQ ID NO: 12585 - protein, 325 aa, Citrus sinensis
MKAIVITQPGSPEVLQLQEVEDPQIKDDEVLIKVEATALNRADTLQRKGSYPPPKGASPYPGLECSGTILSVGKNVSRWKVGDQVCALLGGGGYAEKVAVPAGQVLPVPSGVSLKDAAAFPEVACTVWSTVFMTSHLSPGESFLVHGGSSGIGTFAIQMGKCQGVRVFVTAGSEEKLAVCKDLGADVCINYKTEDFVARVKEETGGKGVDVILDCMGASYFQRNLGSLNIDGRLFIIGTQGGAKTELNITSLFAKRLTVQAAGLRSRSTENKALIVSEVEKNVWPAIAVGKVKPVIYKYLPLCEAAEAHQLMESSQHIGKIMLVP

SEQ ID NO: 12586 - protein, 325 aa, Citrullus lanatus
MKAIVISQPGEAEVLQLQEVDDPIIKEDEVLIKVEATALNRADTLQRKGFYPPPKGASPYLGLECSGIVEAVGKNVSRWKIGDQVCALLSGGGYAEKVAVPAGQVLPIPPGVSLKDAASLPEVACTVWSTVFMTSRLSRGETLLVHGGSSGIGTFAIQIAKHQGARVFITAGSEEKLAVCKDLGADVCINYKTEDFVARVKEETDGKGVDVILDSIGAPYFQRNLESLNLDGRLFIIGTMGGAVTQLDFRSLFAKRLTVQAAGLRNRSPENKAVIVSEVEKIVWPAIAAGKVKPVIFKYLPLSGAAEAHQLMESSKHIGKILLTP

SEQ ID NO: 12587 - protein, 325 aa, Vaccinium corymbosum
MKAVVITTPGGPEVLQLQEVEDPEYGDDDVLIRVAATALNRADTNQRKGSYPPPKGASPLLGLECSGTIEAVGRNVSRWKIGDQVCALLTGGGYAEKVAVPAGQVLPVPTGVSLKDAASFPEVACTVWSTVFMMSKLSGGETFLIQGGSSGIGTFAIQIAKYVGAKVFVTAGSEEKLAACKNLGADVCINYKTEDFVARVKEETQGKGVDVILDNVGGPYLQRNIDSLNFDGRLFIIGFMGGTVAEVNLQGLLARRLTVQAAGLRYRSTENKALIVSEVEKNVWPAIVAGKVKPVVYKYLPLSEAAEAHRLIETSNHIGKILLVA

SEQ ID NO: 12588 - protein, 325 aa, Vaccinium corymbosum
MKAVVITTPGGPEVLQLQEVEDPEYGDDDVLIRVAATALNRADTNQRKGSYPPPKGASPLLGLECSGTIEAVGRNVSRWKIGDQVCALLSGGGYAEKVAVPAGQVLPVPTGVSLKDAASFPEVACTVWSTVFMMSKLSGGETFLIQGGSSGIGTFAIQIAKYVGAKVFVTAGSEEKLAACKNLGADVCINYKTEDFVARVKEETQGKGVDVILDNVGGPYFQRNIDSLNFDGRLFIIGFMGGTVAEVNLQGLLARRLTVQAAGLRYRSTENKALIVSEVEKNVWPAIVAGKVKPVVYKYLPLSEAAEAHRLIETSNHIGKILLVA

SEQ ID NO: 12589 - protein, 325 aa, Eucalyptus grandis
MKAVVITTPGDPEVLRLQEVGDPKLEDGHVLVRVAATALNRADTLQRRGMYPPPKGASEYPGLECSGTIEAVGKGVSRWKVGDQVCALLAGGGYAEKVAVPAGQVLPVPAGISLKDAASFPEVACTVWSTVFMMSHLSAGETFLIHGGSSGIGTFAIQIAKYYGARVFVTAGSEEKLAACKDLGADVCINYKTEDFVARVKEETAGKGVDVILDCVGASYFQRNLDSLNLDGRLFIIGTQSGAVTQVDLRSILARRLTVQAAGLRTRSPENKDAIVDEVEKKVWPAIEQGKVKPVVYKYLPLAEAAEGHRLMESSKHVGKILLVT

SEQ ID NO: 12590 - protein, 325 aa, Valeriana officinalis
MKAIVITSPGGPEVLKLQEVEDPQIGENEVLIKVEATALNRADTIQRKGSYPPPKGSSPYLGLECSGIIQFAGPKVTRWKIGDQVCALLSGGGYAEKVVVPAGQVLPIPPGVSLKDAASIPEVACTVWSTVFMTSRLSPGETFLIHGGSSGIGTFAIQMAKYIGVKVFVTAGNEEKLAVCKDLGADVCINYKTEDFVARVKEETGGKGVDVILDNIGGSYLQRNLDSLNIDGRLFIIGFMGGAVTQVNLVSLLTKRLTVQAAGLRNRSLENKAEIVSDVEKNVWPAIAEGKVKPVIYKYLPLSEAAEAHRIMESSTHIGKIVLVP

SEQ ID NO: 12591 - protein, 325 aa, Amsonia hubrichtii
MKAIVITSPGNPEVLQLQEVEDPEIKDDEVLIKVAATALNRADTLQRQGKHPPPKGDSEYPGLECSGTIEAVGKDVTRWKIGDQVCALVGGGGYAEKVAVPAGQVLPVPPGVSLQDATSFPEVACTVWSTVFMMSRLSAGETFLIHGGSSGIGTFAIQIAKYHGVKVFVTAGSEEKLAACKDLGADVCINYKTEDFVARVKEETGGKGVDVILDNIGASYFQRNLDSLNVDGRLFIIGFMGGIKTEVNLSTLLVRRLTVQAAGLRNRSKENKAFIMREVEKNVWPAIAAGKVKPVIHKSFPLAEAAEGHKLMESSQHIGKILLVV

SEQ ID NO: 12592 - protein, 325 aa, Vaccinium corymbosum
MKAVVITTPGGPEVLQLQEVEDPEYGDDDVLIRVAATALNRADTNQRKGSYPPPKGASPLLGLECSGTIEAVGRNVSRWKIGDQVCALLTGGGYAEKVAVPAGQVLPVPTGVSLKDAASFPEVACTVWSTVFMMSKLSGGETFLIQGASSGIGTFAIQIAKYVGAKVFVTAGSEEKLAACKNLGADVCINYKTEDFVARVKEETQGKGVDVILDNVGGPYLQRNIDSLNFDGRLFIIGFMGGTVAEVNLQGLLARRLTVQAAGLRYRSTENKALIVSEVEKNVWPAIVAGKVKPVVYKYLPLSEAAEAHRLIETSNHIGKILLVA

SEQ ID NO: 12593 - protein, 168 aa, Fagopyrum esculentum
MKAVVITSPGGPEVLKVHEVEDPTIGDDEVLIKVAATALNRADTNQRMGSYPPPKGASPYLGLECSGIIEQIGKNVSRWKIGDQVCALLSGGGYAEKVAVPVGQVLPIPPGISLKDAASFPEVACTVWSTVFMLSKLKAGETFLIHGGSSGIGTFAIQIAKYYGARVL

SEQ ID NO: 12594 - protein, 97 aa, Momordica charantia
MKAIVISQPGDAEVLQLQEVEDPVIKDDEVLIRVEATALNRADTLQRQGFYPPPKGASPYLGLECSGIVEAVGKMSPAGKPAIRYVLFLLVADMLRK

SEQ ID NO: 12595 - protein, 325 aa, Populus trichocarpa
MKAVVITTPGGPEVLQLQEVEDPQINEDEVLIKVEATALNRADTLQRQGKYPPPKGASPYPGLECSGTIEAVGKNVSRWKIGDQVCALLSGGGYAEKVAVPAGQVLPVPQGVSLKDAAALPEVACTVWSTVFMMSRLSAGETFLVHGGSSGIGTFAIQIAKHQGVKVFVTAGSEEKLAVCKDLGADVCINYKTEDFVARVKEETGGKGVDVILDSVGAPYFQKNVDSLNIDGRLFLLGFMGGAVTQVNLASLFAKRITVQAAGLRTRTLENKAEIVSEVEKNVWPAIVAGKVKPVVYKYLPLSEAAEGHRLMESSQHIGKILLVA

SEQ ID NO: 12596 - protein, 325 aa, Chenopodium quinoa
MKAVVITSPGGPEVLQLQEVEDPQIKDDEVLIKVEATALNRADTIQRKGSYPPPPGASPYPGLECSGTILQLGNNVTRWKVGDQVCALLSGGGYAEKVAVPAGQVLPAPDGVSLKDAASFPEVACTVWSTVFMTSRLSAGEAFLVHGGSSGIGTFAIQIAKYYGAKVFVTAGTEEKLAYCKDLGADVCINYKTENFVGRVKEETAGKGVDVILDNMGGVYLQRNIDSLNLDGRLFIIGFQGGSTSQINLASLAAKRLTVQAAGLRNRTPENKALIVKEVEKNVWPAIKEKKVKPVVHKYFSLSQAAEAHQLMESSKHIGKILLLP

SEQ ID NO: 12597 - protein, 393 aa, Vigna unguiculata
MEDNNSQASSPASTTEGKPIRCKAAVSRKAGEPLVIEEITVAPPMPGEVRIRVICSSLCHSDVTFRELQVPPAIFPRILGHEATGVVESVGKDVSELKKGDVVIPVILPECGECIDCKSSKSNRCTNFPFKVSPWMPRHGSSRFTDKNGEIIYHFLFISSFSEYTVVDIANIIKIDPHIPPDRACLLGCGVSTGVGAAWRTAGVEPGSTVAIFGLGSIGLAVAEGARLCGATRIIGVDVYPEKFEIGKKFGVTDFVHARECEDKPVSQVIIEMTGGGADYCFECVGMASVVHEAYASCRKGWGKTIVLGVDKPGARINISSHEVLHDGKCLMGSLFGGLKPKSHVPILLKRYVDKELQLDEFVTHEVEFKDINKAFDLLSTGKCLRCVIWMDK

SEQ ID NO: 12598 - protein, 392 aa, Glycine max
MKDDKQAPVPASTTEGQPIRCKAAVSRRAGEPLVIEDIIVAPPKPREARIRIICSSLCHSDITLRNLQDPPAIFPRILGHEATGVVESVGKDVTEVTKGDVVIPVILPECGECIDCKSTKSNRCTNFPFKVSPWMPRDGTTRFTGQNGEIIYHFLFISSFSEYTVVDIANLIKIDPEIPPDRACLLGCGVSTGVGAAWRTAGVEPGSTVAIFGLGSIGLAVAEGARLCGATRIIGVDINPEKFEIGKKFGVTDFVNAGECGGKPVGQVIIEITDGGADYCFECVGMASLVHEAYASCRKGWGKTIVLGVDKPGARINLSSYEVLHDGKSLMGSLFGGLKPKSHVPILLKRYMDKELQLDKFVTHEVEFKDINKAFDLLSKGECLRCVIWMDK

SEQ ID NO: 12599 - protein, 390 aa, Cicer arietinum
MEHKLSTTSDQGEGQPIRCKAAVARKAGEALVIEEIMVAPPMPREVRIRILCTSLCHSDITLWKMQEPPGCFPRILGHEAVGVVESVGKDVTEVTKGDVVIPIFLPDCGECLDCKSTKSNLCTDFPFKISPWMPRHESTRFTDLNGEIIYHFMFVSSFSEYTVVDIANVTKIDPEIPPDRACLLSCGVSTGVGAAWRTAGVEPGSTVAIFGLGSVGLAVAEGARLCGATRIIGVDVIPEKFEIGKKFGLTDFIHALECGNKPVSQVIIEMTNGGADYCFECVGTASLVHEAYASCRKGWGKTIVVGVDKPGAKLSLSSSEVLHDGKSLTGSLYGGLKPKSHVPILLKRYMDKELQLDKFVTHEVEFKDINKAFDLLNNGQCLRCVIWMDK

SEQ ID NO: 12600 - protein, 388 aa, Lotus japonicus
MEDKLARTSEGQPIRCKAAVCRKPGEPLTIEEIMVAPPMPREARIRIICTSLCHSDITFWKIEDPPAIFPRILGHEAVGVVESVGEDVTEVTKGDMVVPIFIPDCGECVDCKSTKSNVCSKFPFKVSPWMPRYDNTTRFTDLKGEIIHHFLFVSSFSEYTVVDIANLTKIDPAIPPNRACLLSCGVSTGVGAAWRTAGVEPGSTVAIFGLGCIGLAVAEGARLCGATRIIGVDVNPEKFEIGKKFGLTDFVHAGECEKKSASQVIIEMTGGGADYCFECVGMTSLVQEAYASCRKGWGKTIVLGVDKPGSKLILNSSEVLHQGKSLMGSLFGGLKPKSHVPILLKRYMDKELRLDEFVTHEVEFKDINKAFDLLIKGQCLRCVIWMDK

SEQ ID NO: 12601 - protein, 279 aa, Vigna unguiculata
MALQEKLDKFKKQQEKCQTTLSSIAASKAAASQKSASHGSANGKNAPHPVKFSNDTERLQHINSIRKAPVGAQMKRVIDLLLETRQALTPEQINQACYVDIKANKDVFENLRKNPKVNYDGQRFSYKSKYGLKDKTELLQLIRKYPEGLAVIDLKDAYPTVMEDLQALKGAGQIWLLSNFDSQEDIAYPNDPKLHIKVDDDLKQLFRSIELPRDMIDIEKDLQKNGMKPATNTAKRRSAAQIQGISSKPKPKKKKSEINKRTKLTNAHLPELFQNLNNS

SEQ ID NO: 12602 - protein, 279 aa, Glycine max
MALQEKLDKFKKQQEKCQTTLSSIAASKAAATQKSAAHGSANGRNAAPAVKFSNDTERLQHINSIRKAPVGAQMKRVIDLLLETRQAFTPEQINGACYVDMKANKDVFENLRKNPKVNYDGQRFSYKSKYGLKDKTELLQLIRKYPEGLAVIDLKDAYPTVMEDLQALKAAGQIWLLSNFDSQEDIAYPNDPKVHIKVDDDLKQLFRSIELPRDMIDIEKDLQKNGMKPATNTAQRRSAAQIQGISSKPKPKKKKSEISKRTKLTNAHLPELFQTLNSS

SEQ ID NO: 12603 - protein, 277 aa, Cajanus cajan
MALQERLEKFKKQQEKCQTTLSSIAASKAAAQKSASASANGRNAVPPVKFSSDTERLQHINSIRKSPVGAQMKRVIDLLLETRQALTPEQINEACYVDMKANKDVFENLRKNPKVNYDGQRFSYKSKYGLKDKTELLHLIRKYPEGLAVIDLKDAYPTVMEDLQALKAAGQIWLLSNFDSQEDIAYPNDPKVHIKVDDDLKQLFRSIELPRDMIDIEKDLQKNGMKPATNTAKRRSAAQIQGISSKPKPKKKKSEISKRTKLTNAHLPELFQNLNSS

SEQ ID NO: 12604 - protein, 280 aa, Glycine max
MALQERLDKFKKQQEKCQTTLSTIAATKAAAATQKSATHASANGRNAAPAVKFSNDTERLQHINSIRKAPVGAQMKRVIDLLLETRQAFTPEQINEACYVDMKANKDVFENLRKNPKVNYDGQRLSYKSKYGIKDKTELLQLVRKYPEGLAVIDLKDAYPTVMEDLQAMKAAGQIWLLSNFDSQEDIAYPNDPKVHIKVDDDLKHLFRSIELPRDMIDIEKDLQKNGMKPATNTAQRRSAAQIQGISSKPKPKKKKSEISKRTKLTNAHLPELFQNLNSS

SEQ ID NO: 12605 - protein, 281 aa, Trigonella foenum-graecum
MALQEQLDRFKKQQEKCQSTLSNIASSKVGGSRKATTPVAAHASANGRNSTSSVKFSKDTERLQQINNIRKAPVGAQMKRVIDLLLETRQAFTPEQINEACYVDMRANKDVFDSLRKNPKVGYDGQRFSYKAKYGLKDKTELLRLIRTYPEGIAVFDLKDAYPTVMEDMQALKAAGQIWLLSNFDSQDDIAYPNDPKAHIKVDDDLKQLFRSIELPRDMIDIEKDLQKNGMKPATNTAKRRSAAQIDGISSKPKPKKKKSEITKRTKLTNAHLPELFQNLK

SEQ ID NO: 12606 - protein, 270 aa, Medicago truncatula
MALQGKLDRFKKQQEKCQSTLSSIAANKAVSASVPNALAPVKFSTDTERLQHINSIRKAPVGAQMKRVIDLLFETRQALTLEQINETCHVDMKANKDVFDNMRKNPKVRYDGERFSYKSKHALRDKKELLFLIRKFPEGIAVIDLKDSYPTVMEDLQALKGGREIWLLSNFDSQEDIAYPNDPKVPIKVDDDLKQLFRGIELPRDMIDIERDLQKNGMKPATNTAKRRSAAQMEGISSKPKPKKKKNEITKRTKLTNAHLPELFQNLNNS

SEQ ID NO: 12607 - protein, 269 aa, Lupinus angustifolius
MSLQESLERFKKQQEKCHSTLSSIANGRNSVPPLPSGVAVKFSNDTERLQHINSIRKAPVGAQMKRVIDLLFETRHAFTPEQINEACYVDMKANKDVFDSLRKNPKVKYDGQRFSYKSKHNLKDKNQLLQLIRKFPEGIAVIDLKDSYPTVMEDLQAWKAAGQIWLLSNFDSQEDIAYPNDPKVPIKVDDDLKQLFRSIELPRDMIDIEKDLQKNGMKPATNTAKRRSAAQIQGASSKPKTKKKKSEISKRTKLTNAHLPELFQNLNSS

SEQ ID NO: 12608 - protein, 270 aa, Cicer arietinum
MALQGKLDRFKKQQEKCQTTLSSIAASKASSVSASNPPVPVKFSSDTERLQVINSIRKAPVGAQMKRVIAILYETRQALTLDQINEACYVDMKANKDVFDSMRKNPKVRFDGERFSYKSKHALRDKKELLFLIRKFPEGIAVIDLKDSYPTVMEDLQALKAAREIWLLSNFDSQEDIAYPNDPKVPIKVDDDLKQLFRGIELPRDMIDIERDLQKNGMKPATNTAKRRSAAQMEGISTKPKPKKKKSEITKRTKLTNAHLPELFQNLNNS

SEQ ID NO: 12609 - protein, 282 aa, Medicago truncatula
MALQEQLDRFKKQQEKCQSTLSSIASSKVGSRKPNTPVVATNASANGRNSRTGVKFSSDTERLQQINNIRKAPVGAQMKRVIDLLLETRQAFTPEQINEACYVDMRANKDVFESLRKNPKVEYDGQRFSYKAKYGLKEKSELLQLIRRYPEGLAVFDLKDAYPNVMEDLQALKAAGQIWLLSNFDSQDDIAYPNDPKANIKVDDDLKQLFRSIELPRDMIDIEKDLQKNGMKPATNTAKRRSAAQIDGVSSKPKSNSRKKNEITKRTKLTNAHLPELFQNLK

SEQ ID NO: 12610 - protein, 284 aa, Lotus japonicus
MALQQQLDKFKKQQEKCQSTLSNIAANKAANRKSSAPVVAAPASANGINPAPAVKFSNDTVRLQNIHTIRNSTVGHQMKRVIELLLETRQAFTPEQIKEVCYVDMKANKDVFDSLRKNPKVHYDGQRFSYKSKYGLKDKTELLQLIRKFPEGIATIDLKDAYPNVKEDLQALKAAGQIWLLSNFDSHDEDIAYPNDPKVHIKVDDDLKQLFRSIELPQDMIDIEKDLQKNGMKPATNTAKRRSAAEIQGIPSKSKPKKKKREISKRTKLTNTHLPELFQNLFNS

SEQ ID NO: 12611 - protein, 270 aa, Trifolium pratense
MALQGKLDRFKKQQEKCASTLSSIAASKAASSAVPSPLVPVKFSNDTERLQHINSIRKAPVGAQMKRVIDLLFETRQALTLEQINETCHVDMKANKDVFDNMRKNPKVRYDGERFSYKSKHSLRDKKELLFLIRKFPEGIAVIDLKDSYPTVMEDLQALKAGREIWLLSNFDSQEDIAYPNDPKVPIKVDDDLKLLFRGIELPRDMLDIERDLQKNGMKPATNTAKRRSAAQMEGISSKPKPKKKKNEITKRTKLTNAHLPELFQNLKNS

SEQ ID NO: 12612 - protein, 278 aa, Juglans hindsii x Juglans regia
  misc_feature (157)..(157): Xaa can be any naturally occurring amino acid
MALQEQLDKFKKQQEKCQSTLTSIAASNKATNKKSTFVPAAPSANARIPAPAVKFSNDTERLQHINSIRKAPVGAQIKRVIDLLLETRQAFTPEQINETCYVDTNANKAVFDSLRNNPKVNYDGKRFSYKSKHDLKDKTQLLHLIRKFLEGIAVIDXKDAYPTVMEDLQALKAAGQIWLLSNFDSQEDIAYPNDPRVPLKVDDDLKQLFRGIELPRDMIDIERDLQKNGMKPATNTAQRRARSEVHGISSKQKPKKKKHEITKRTKLTNAHLPELFRT

SEQ ID NO: 12613 - protein, 174 aa, Vigna unguiculata
MQRQLVCNGCRSLLLYPRGATNVCCALCNTITSVPPPGMEMSQLYCGGCRTLLMYTRGATSVRCSCCHTVNLVPATNQVAHVHCGNCRTALMYPYGAPSVKCAICHYITNTNNGRLPIPVHRSNGTANAGTLPSTSTSMPQSQSQTVVVENPMSVDSSGKLVSNVVVGVTTDKK

SEQ ID NO: 12614 - protein, 176 aa, Cajanus cajan
MQSQLVCNGCRSLLLYPRGATNVCCALCNTITSVPPPGMEMSQLYCGGCRTLLMYTRGATSVRCSCCHTVNLVPASNQVAHVHCGNCRTTLMYPYGAPSVKCALCHYITNVSMNNGRLPIPVHRPNGTTNAGTLPSTSTSMPQSQSQTVVVENPMSVDSSGKLVSNVVVGVTTDKK

SEQ ID NO: 12615 - protein, 175 aa, Glycine max
MQSQVVCNGCRSLLLYPRGATNVCCALCNTITSVPPPGMEMSQLYCGGCRTLLMYTRGATSVRCSCCHTVNLVPPASNQVAHVHCGNCRTTLMYPYGAPSVKCALCHFITNTNNGRLPIPVHRPNGTNNAGTLPSTSTSMPQSQSQTVVVENPMSVDSSGKLVSNVVVGVTTDKK

SEQ ID NO: 12616 - protein, 177 aa, Glycine max
MQSQVVCNGCRSLLLYPRGATNVCCALCNTITSVPPPGMEMSQLYCGGCRTLLMYTRGATSVRCSCCHTVNLVPPASNQVAHVHCGNCRTTLMYPYGAPSVKCALCHFITNVSTNNGRLPIPVHRPNGTTNAGTLPTTSTSMPQSQSQTVVVENPMSVDSSGKLVSNVVVGVTTDKK

SEQ ID NO: 12617 - protein, 176 aa, Trigonella foenum-graecum
MQSQLVCNGCRSMLLYPRGATNVCCALCNTITSVPPPGMDMSQIYCGGCRTLLMYTRGATSVRCSCCHTVNLAPVSNQVAHVPCGNCRTTLMYPYGAPSVKCAVCHYITNINMSNGRLPIPGHRPHGTTDSGTLPSTSTSMPQSQSQTVVVENPMSVDSSGKLVSNVVVGVTTDKK

SEQ ID NO: 12618 - protein, 176 aa, Medicago truncatula
MQSQLVCNGCRNTLLYPRGATNVCCALCNTITAVPPPGMDMSQLYCGGCRTLLMYTRGATSVRCSCCHTVNLAPVSNQVAHVPCGNCRTTLMYPYGAPSVKCAVCHYITNINMSNGRLPIPGHRPHGTTDSGMLPSTSTSMPQSQSQTVVVENPMSVDSSGKLVSNVVVGVTTDKK

SEQ ID NO: 12619 - protein, 175 aa, Lotus japonicus
MQSQLVCNGCRSILLYPRGATNVCCALCNTITAVPPPGMDMSQLYCGGCRTLLMYTRGAASVRCSCCHTVNLAPANQVAHVPCGNCRTTLMYPYGAPSVKCALCHYITNVNMSNGRLQVPMHRPNGTTNSGALPSTSTSMPQSQTQTVVVENPMSVDSSGKLVSNVVVGVTTDKK

SEQ ID NO: 12620 - protein, 177 aa, Arachis hypogaea
MQSQLVCNGCRSILLYPRGATNVCCALCNTITSVPPPGMEMSQLVCGGCRTLLMYTRGATSVRCSCCQTVNLAPPAPSQVAHVHCGNCRTTLMYPYGAPSVKCALCQYVTNVNMNNGRLPIPVHRPNGTTNYGTVPSTSTSMPQSQTQTVVIENPMTVDSNGKLVSNVVVGVTTDKK

SEQ ID NO: 12621 - protein, 176 aa, Lupinus angustifolius
MQSQVVCNGCRNILLYPRGATNVRCALCNTITSVPPPGMEMSQLYCGGCRTLLMYARGATSVRCSCCHTVNLVPASNQVSHIHCGNCRTTLMYPYGAPSVKCALCHYITNVTTTNGRLPNPGQRTNGPTNPGTVSSTPTSMPHSQSQTVVVENPMSVDSSGKLVSNVVVGVTTEKK

SEQ ID NO: 12622 - protein, 171 aa, Cicer arietinum
MQSQIVCNGCRSMLLYPRGPTNVCCALCNTITPVPPPGMDMSQLYCGGCRTLLMYTRGATSVRCSCCQTLNLAPAHVPCGNCRTTLMYPSGAPSVKCAVCHYITNINMPNGRLPIPVRRPYGTTNSGTLPSTSTSMPQSQSQTVVVENPMSVDSSGKLVSNVVVGVTTEKK

SEQ ID NO: 12623 - protein, 176 aa, Lupinus angustifolius
MQGQLVCSGCRSNLLYPRGAPNVCCALCNTITSVPPPGMEMSQLYCGGCRTLLMYPCGATSVRCSCCHTVNLAPASNHVAHIHCGNCRTTLMYPYGAPSVKCAICHYITNVSMINGGFPIPVHSPNGMTNSATVPSTSTSMPQSQSHTVVVENPMSVDSNGKLVSNVVVGVTTDKR

SEQ ID NO: 12624 - protein, 174 aa, Glycine max
MRSQLVCNGCRSILVYPRGATNVCCALCNTITSVPPPGMDMSQLYCGGCTTLLMYTRGATSVRCSCCHTINLVPESNQVIHCANCRTTLMYPYGASSVKCAICCYITNISMTNGRLSIPVQRPNGTANSGTVSSTSSSMPYSQSQTVVVENPMSVDSSGKLVRNVVVGVTTDKK

SEQ ID NO: 12625 - protein, 176 aa, Glycine max
MGSQLVCNGCRNILVYPRGATNVCCALCNTVTSVPPPGMDMSQLYCGGCTTLLMYTRGATSVRCSCCHTINLVPVLESNQVIHCTNCRTTLMYPYGASSVKCAICRYITNVSMTNGRLPIPVQRPNGTANSGTVSSTSSSMPHSQSQTVVVENPMSVDSSGKLVSNVVVGVTTEKK

SEQ ID NO: 12626 - protein, 176 aa, Prunus mume
MQSQLVCSGCRSILLYPRGATNVCCALCNIITPVPPPGTEMAQLICGGCRTLLMHTRGATSVRCSCCHTVNLAPASSQVAHVNCGNCRTTLMYPYGAPSVKCAVCHYVTNVGMTNMRVPIPVHRPNGTANSGMAPSTSAAMPHSQSQTVVVENPMSVDESGKLVSNVVVGVTTGKK

SEQ ID NO: 12627 - protein, 176 aa, Sarracenia psittacina
MQSQLVCSGCRSFLFYPRGATNVCCVLCNAITSVPPPGMEMAQLICGGCRTLLMYTRGATSVRCSCCQTVNPVPASNQLAHVNCGNCRTTLMYPYGAPSVKCAICQYITNVNMGNARVHIPVHRPNGTTTSASMPSASTPMPSSQSQTVVVENPMSVDESGKLVSNVVVGVTTEKK

SEQ ID NO: 12628 - protein, 176 aa, Euonymus alatus
MQSQLVCGGCRSILLYPRGASNVCCALCNTVTSVPPPGMEMTQLICGGCRTLLMYTRGATGVRCSCCHTVNIAPASNQFAHVNCGNCRTMLMYPYGAPSVKCAICQYITNVGMANARLPLPANRPNGTVASGAVPPASTVIPQSQSQTVVVENPMSVDDSGKLVSNVVVGVTTEKK

SEQ ID NO: 12629 - protein, 180 aa, Taraxacum officinale
MQSQIVCSGCRSILLYPRGASNVCCALCNAVTSVPPPGMEMDQLICGGCRTLLMYTRGATSVRCSCCHTVNLAPVSNQVAQVSCGNCRTMLMYPFGAPSVKCAICHYITNVNTSNGRVPVPMRPNGTTTTSGSLPPVSTAMPHSHNQTVVVENPMSVDESGKLVSNVVVGVTTDKKKAIK

SEQ ID NO: 12630 - protein, 70 aa, Fagus grandifolia
MQSQLVCSGCRSILLYPGGATNVCCALCNTITARPPTWDGNGSAYMWWLQDIANVYTVGQQALDALAATQ

SEQ ID NO: 12631 - protein, 170 aa, Prunus persica
MQSQLVCSGCRSILLYPRGATNVCCALCNIITPVPPPGTEMAQLICGGCRTLLMHTRGATSVRCSCCHTVNLAPASSQVAHVNCGNCRTTLMYPYGAPSVKCAVCHYVTNVGMTNMRVPIPVHRPNGTANSGTAPSTSASQTVVVENPMSVDESGKLVSNVVVGVTTGKK

SEQ ID NO: 12632 - protein, 176 aa, Tripterygium wilfordii
MQSQLVCGGCRSVLLYPRGASNVCCALCNTVTSVPPPGIEMSQLICGGCRTLLMYTREATSVRCSCCHTVNLAPASNQVAHVNCGNCRTMLMYPYGAPTVKCAICHYVTYVDAANARLPLPANRPNATLASGAVPPASTVIPQSQSQTVVVENPMSVDESGKLVSNVVVGVTTEKK

SEQ ID NO: 12633 - protein, 175 aa, Carica papaya
MQSQLVCSGCRSILVYPRGAANVCCAICNAVTTVPPPGMEMAQLICGGCRTLLMYTRGATSVRCSCCHTVNLAPASNPVAHINCAHCRTTLMYPYGAPSVKCALCHYVTNVGMANVRVPLPANRPNGTTAGQMPSTSTSMPHSQSQTVVVENPMSLDESGKLVSNVVVGVTTDKK

SEQ ID NO: 12634 - protein, 175 aa, Humulus lupulus
MQSQLVCSGCRNVLLYPRGSANVCCAICSTITSVPPPGMEMAQLICGGCRTLLMYTRGATSVRCSCCHTVNLAPGSNQMAHVNCGNCRTTLMYPFGAPSVKCAVCQYVTNVGMGNMRVPIPVHRPNGINSGTMPSTSSPMPHSQSQTVVVENPMSVDESGKLVSNVVVGVTTEKK

SEQ ID NO: 12635 - protein, 385 aa, Vigna unguiculata
MASADSRKKSVVLALCKYLSLDPSVVPAESLDSDIKSLYLKIKEASGHGVDNTDEVLKWVSFAEAFPVANDACFENLKRLNDELSGKSVVLGNGLKPSEADVIVYSVIHSSLVNLSDTNKEKLSHVLRWMDYIQNKQEFVGLFEKILLQKPGFEPPVTKAVGVLEADLKSKTDQSIKNVSKSETEPSKDKNKAEGKATAADKEPNKAKAKPAEKEVAGKENEVSVSLLNIQVGLIRKAWKHPSADSLLVEEIDVGEAKVRQVVSGLAKYFSPDELTNRRVVLITNVKPGKLRDVVSEGLVLCASNEGPTVVEPLIPPEGAKIGERISFTGIDGKPEDVLNPKKKQLEKITPHLFTDDKGVATFKGIPFMTSGGPCTSSIPRATIK

SEQ ID NO: 12636 - protein, 385 aa, Cajanus cajan
MATVESRKKSLVLALCKHLSLDPSVVSADSLDSDIKSLYLNIAAAPGHEVNHSDEELKWVAFAEAFPVAPDACFENLKKLNEELSGKAVLLGNGLKPSEADVIVYSVVHSSLINLSDTNKDKLPHVLRWVDYIQHKQEFVGLFEKILVQKPGLKPPVTKPVGAVEADLKSNKTEQSIKNVNKPETDISKAKTKAEGKSIGDKEPTKAKAKPADKEVAEKENEVSVSLLNIQVGLIRKAWKHPSADSLLVEEIDVGEAKLRQVVSGLAKYFSPDELTNRRVVLITNVKPGKLRDVVSEGLVLCASNEGPTVVEPLLPPEGAKIGERISFSGIDGKPEDVLNPKKKQLEKITPHLFTDDKGVATFKGIPFMTSGGPCTSSIPRATIK

SEQ ID NO: 12637 - protein, 390 aa, Glycine max
MATVESRSKSVVLALSKYLSLDPSVVPADTSDSDIKSLYLNIIAVSGHGVNHSDEVLKWVAFAEAFPVALDACFENLNRLNDELSEKSVLLGNGLKPSEADVIVYSVIHSSLINLSDTNKEKLPHVLRWMDYIQHKQEFVGLFEKILLQKPGFEPPVTQPVGAVEADLKSNKTEQSVKNVNKSEVDSSKDKNKAEGKATGGKSTGDKEPTKAKAKPADKEVAEKENEVSVSLLNIQVGLIRKAWKHPSADSLLVEEIDVGEDKVRQVVSGLAKYCNPDELTNRRVVLITNVKPGKLRDVMSQGLVLCASDEGPTIVEPLLPPEGSQIGERISFSGIDGKPEDVLNPKKKQLDKITPHLFTDDKGVATYKGIPFMTSGGPCTSSIPRATIK

SEQ ID NO: 12638 - protein, 389 aa, Glycine max
MATIESRRKSVALALSKYFSLDPSVVPADSSDSDIKSLYLNIIAVSGHRVNHSDEVLKWVAFAEAFPVALDACFENLKRLNDELSGKAVLLGNGLNPSEADVIVYSVVHSSLINLSDTSKEKLPHVLRWMDYIQHKQEFVGLFEKILLKKPEFEPLVTKPVGAVEADLKSNKTEQSIKNVNKSEADSSKDKNKAEGKATGGKSTGDKEPTKGKAKPADKVAEKENEVSVSLLNIQVGLIHKAWKHPSADSLLVEEIDVGEAKVRQVVSGLAKYYSPDELMNRRVVLITNVKPGKLRDVMSEGLVLCASNEGPTIVEPLLPPEGAKIGEHISFSGIDGKPEDVLNPKKKQLEKITPHLFTDDKGVATYKGIPFMTSGGPCTSSIPRATIR

SEQ ID NO: 12639 - protein, 385 aa, Cicer arietinum
MASVDNRKKSVVLALSKHLSLDPSVIPADSLDGDIKTLYLNITAASGQEVNHSDEVLKWVEFAESLPVALDACFESLKRLNDELSGKSVLLGNGLKPSEADVIVFSVIHSSLISLPDTNKENLPHVFRWIDYIQHKQAFVGLFEEIMLQKPEFEPPVTKSVDVVESDLKSNKTEQSIKNANKSEADISKDKKKAEGKSTGDTGPTKAKAKPAGKDVAEKENEVSVSLLNIQVGVIRKAWKHPSADSLLVEEIDVGETKLRQVVSGLAKYFSPDELTNRRVALITNVKPGKLRDVMSQGLVLCASNEDHTTVEPLLPPEGAKIGEHVSFAGIDGKPEEVLNPKKKQLEKITPHLFTDDNGVATFKGIPFMTSGGPCTSSISRATIK

SEQ ID NO: 12640 - protein, 388 aa, Medicago truncatula
MASVDNRKKSLVLALSKHLSLDPSVFPADSAGGDIKTLYLNIIAASGHEVNHSDEVLKWVEFAETLPVSLDGCFEILKRLNDELSGKSVLLGNGLKPSEADVIVFSVIHSSLISLPDTNKEKLAHVLRWVDYIQHKLEFVGLFEEILLQKPEFEPPVTKSAAAVESDLKSNKTEQSVKNVNKAEPETSKDKNKAEVKSTGDTEPAKAKAKPAKPAAKEVSEKENEVSVSLLNIQVGLIRKAWKHPSADSLLVEEIDVGEAKLRQVVSGLAKYCSPDELTNRRVALITNVKPGKLRDVVSEGLVLCASNEGSTIVEPLLPPEGAKIGERVSFAGIDGKPEDVLNPKKKQLEKITPHLFTDDNGMATFKGIPFMTSGGPCTSSISRATIK

SEQ ID NO: 12641 - protein, 143 aa, Trigonella foenum-graecum
MASVENRKKSLVLALSKHLSLDPSVIPADSLDGDIKTLYSNLIAASGKEVNHSDEVLKWVAFAESLPVALDECFENLKKLNDELSGKSVLLGNGSKPSEADVIVFSAIHSSLISLPDTDKEKLATCVEMDGLHPAQTGIYRLI

SEQ ID NO: 12642 - protein, 94 aa, Cajanus cajan
MSAESPTSVRKVVVHLRATGDAPILKQSKFKIAGTDKFAKVIDFLRRQLHRETLFVYVNSAFSPNPDELVIDLFNNFGFDGKLVVNYACSMAWG

SEQ ID NO: 12643 - protein, 94 aa, Glycine max
MSSELPSSVRKVVVHLRATGDAPILKQSKFKIAGTDKFAKVIDFLRRQLHRETLFVYVNSAFSPNPDELVIDLFNNFGFDGKLVVNYACSMAWG

SEQ ID NO: 12644 - protein, 94 aa, Vigna unguiculata
MSAESPSSVRKVVVHLRATGDAPILKQSKFKIAGTDKFVKVIDFLRRQLHRETMFVYVNSAFSPNPDELVIDLFNNFGFDGKLVVNYACSMAWG

SEQ ID NO: 12645 - protein, 94 aa, Glycine max
MSAESPSSARKVVVHLRATGDAPILKQSKFKIAGTDKFAKVIDFLRRQLHRETLFVYINSAFSPNPDELVIDLFNNFGFDGKLVVNYACSMAWG

SEQ ID NO: 12646 - protein, 94 aa, Lupinus angustifolius
MATESPSSVRKVVVHLRATGDAPILKQSKFKIAGSDKFAKVIDFLRRQLHRETLFVYVNSAFSPNPDELVIDLYNNFGFDGKLVVNYACSMAWG

SEQ ID NO: 12647 - protein, 94 aa, Theobroma cacao
MAAESPTSVRKVVVHLRATGDAPILKQAKFKIPGTDKFAKVIDFLRRQLHRDTLFVYVNSAFSPNPDELVIDLYNNFGFDGKLVVNYACSMAWG

SEQ ID NO: 12648 - protein, 94 aa, Arachis hypogaea
MAAESPSSVRKVVVHLRATGDAPILKQSKFKIAGADKFAKVIDFLRRQLHRETLFVYVNSAFSPNPDESIIDLYTNFGFDGKLVVNYACSMAWG

SEQ ID NO: 12649 - protein, 94 aa, Cicer arietinum
MATESPTSARKVVVHLRATGDAPILKQSKFKIAGTDKFAKVIDFLRRQLHRDTLFVYVNSAFSPNPDELVIDLYNNFGFDGKLVVNYACSMAWG

SEQ ID NO: 12650 - protein, 94 aa, Lotus japonicus
MSVESPSSVRKVVVHLRATGDAPILKQSKFKIAGTDKFAKVIDFLRRQLHRDTLFVYVNSAFPPNPDELIIDLYNNFGFDGKLIVNYACSMAWG

SEQ ID NO: 12651 - protein, 95 aa, Medicago truncatula
MAAAESPTSVRKVVVHLRATGDAPILKQSKFKIAGTDKFAKVIDFLRRQLHRESLFVYVNSAFSPNPDELVIDLYNNFGFDGKLVVNYACSMAWG

SEQ ID NO: 12652 - protein, 94 aa, Primula obconica
MSSDSPSSARKVVVHLRATGDAPILKQAKFKIAGSDKFAKVIDFLRRQLHRETLFVYVNSAFSPNPDELVIDLYNNFGFDGKLVVNYACSMAWG

SEQ ID NO: 12653 - protein, 95 aa, Trigonella foenum-graecum
MAVVESPTSVRKVVVHLRATGDAPILKQSKFKIAGTDKFAKVIDFLRRQLHRESLFVYVNSAFSPNPDELVIDLYNNFGFDGKLVVNYACSMAWG

SEQ ID NO: 12654 - protein, 96 aa, Quercus alba
MAAESQSPSSVKKVVVHLRATGDAPILKQAKFKIPGTDKFAKVIDFLRRQLHRETLFVYVNSAFSPNPDELVIDLYNNFGFDGKLVVNYACSMAWG

SEQ ID NO: 12655 - protein, 95 aa, Panax ginseng
MASESPSNAARKVVVHLRATGDAPILKQAKFKIAGTDKFAKVIDFLRRQLHRETLFVYVNSAFSPNPDELVIDLYNNFGFDGKLVVNYACSMAWG

SEQ ID NO: 12656 - protein, 94 aa, Unknown
  Sequence found in Organisms: Gossypium hirsutum, Gossypium raimondii
MAAESPSSARKVVVHLRATGDAPILKQAKFKILGTDKFAKVIDFLRRQLHRDTLFVYVNSAFSPNPDELVIDLYDNFGFDGKLVVNYACSMAWG

SEQ ID NO: 12657 - protein, 94 aa, Actinidia deliciosa
MASEPPSSARKVVVHLRATGDAPILKQAKFKIAGTDKFAKVIDFLRRQLHRETLFVYVNSAFSPNPDELVIDLYTNFGFDGKLVVNYACSMAWG

SEQ ID NO: 12658 - protein, 81 aa, Castanea mollissima
MAAESQSPGSVKKVVVHLRATGDAPILKQAKFKIPGTDKFAKVIDFLRRQLHRETLFVYVNSAFSPNPDELVIDLYNNFGF

SEQ ID NO: 12659 - protein, 95 aa, Aristolochia fimbriata
MAAESVASTRKGVVVHLRATGDAPILKQAKFKIAGTDKFAKVIDFLRRQLHRDTLFVYVNSAFSPNPDELVIDLYNNFGFDGKLVVNYACSMAWG

SEQ ID NO: 12660 - protein, 95 aa, Prunus mume
MSTVESPSAVRKVVVHLRATGDAPILKQAKFKILGTDKFAKVIEFLRRQLHRDTLFVYVNSAFSPNPDELVIDLYNNFGFDGKLVVNYACSMAWG

SEQ ID NO: 12661 - protein, 94 aa, Vitis vinifera
MASESPSSARKVVVHLRATGDAPILKQAKFKIPGTDKFAKVIEFLRRQLHRDTLFVYVNSAFSPNPDELVIDLYNNFGFDGKLVVNYACSMAWG

SEQ ID NO: 12662 - protein, 94 aa, Gossypium hirsutum
MAAESPNSARKVVVHLRATGDAPILKQAKFKILGTDKFAKVIDFLRRQLHRDTLFVYVNSAFSPNPDELVIDLYDNFGFDGKLVVNYACSMAWG

SEQ ID NO: 12663 - protein, 93 aa, Carpinus betulus
AADSPSSIRKVVVHLRATGDAPILKQAKFKIPGTDKFAKVIDFLCRQLHRETLFVYVNSAFSPNPDELVIDLYNNFGFDGKLVVNYACSMAWG

SEQ ID NO: 12664 - protein, 94 aa, Papaver somniferum
MATESPNSSRKVVVHLRATGDAPILKQAKFKIAGTDKFAKVIDFLRRQLHRDTLFVYVNSAFSPNPDELVNDLYNNFGFDGKLVVNYACSMAWG

SEQ ID NO: 12665 - protein, 94 aa, Amborella trichopoda
MAAESPATPRKVVVHLRATGDAPILKQAKFKIGGTEKFAKVIDFLRRQLHRETLFVYVNSAFSPNPDELVIDLYDNFGFDGKLVVNYACSMAWG

SEQ ID NO: 12666 - protein, 94 aa, Cleome spinosa
MATESPSSVRKVVVHLRATGGAPILKQSKFKIPGTDKFAKVIDFLRRQLHSDTLFVYVNSAFSPNPDESVIDLYNNFGFDGKLVVNYAFSMAWG

SEQ ID NO: 12667 - protein, 94 aa, Gossypium hirsutum
MAAKSPNSARKVVVHLRATGDAPILKQAKFKILGTDKFAKVIDFLRRQLHRDTLFVYVNSAFSPNPDELVIDLYDNFGFDGKLVVNYACSMAWG

SEQ ID NO: 12668 - protein, 94 aa, Euonymus alatus
MSMESPNSFQKVVVHLRATGDAPILKQAKFKIAGTEKFAKVIDFLLRQLHRETLFVYLNSAFSPNPDELVIDLYNNFGFDGKLVVNYACSMAWG

SEQ ID NO: 12669 - protein, 94 aa, Euonymus alatus
MSMESLNSVQKVVVHLRATGDAPILKQAKFKIAGTEKFAKVIDFLLRQLHRETLFVYLNSAFSPNPDELVIDLYNNFGFDGKLVVNYACSMAWG

SEQ ID NO: 12670 - protein, 94 aa, Tropaeolum majus
MAKESPSSIQKVVVHLRATGDAPILKQTKFKIPSTDKFAKVIDFLRRQLHRDTLFVYVNSAFSPNPDELVIDLYNNFGFDGKLVVNYACSMAWG

SEQ ID NO: 12671 - protein, 95 aa, Panax ginseng
MASESLSNAARKVVVHLRATGDDPILKQAKFKIAGTDKFAKVIDFLRRQLHRETLFVYVNSAFSPNPDEFVIDLYNNFGFDGKLVVNYACSMAWG

SEQ ID NO: 12672 - protein, 95 aa, Rosa hybrid cultivar
MSTTESPTAAKKVVIHLRATGDAPILKQAKFKIPGTDKFAKVIDFLRRQLHRDTLFVYVNSAFSPNPDELVMDLYNNFGFDGKLVVNYACSMAWG

SEQ ID NO: 12673 - protein, 94 aa, Carica papaya
MASDSPSSVRKVVVHLRATGDAPILKQAKFKILGNDKFVKVIDFLRRQLHRDTLFVYVNSAFSPNPDESVIDLYNNFGFDGKLVVNYACSMAWG

SEQ ID NO: 12674 - protein, 90 aa, Solanum lycopersicum
MAADSRKVIVHLRATGDAPILKQAKFKIAGTDKFIKVIDFLRRQLHRETLFVYVNSAFSPNPDELVIDLYNNFGFDGKLVVNYACSMAWG

SEQ ID NO: 12675 - protein, 92 aa, Tripterygium wilfordii
MSTESPNSVQKVVVHVRATGDAPILKQAKFKIAGTEKFAKVIDFLLRQLHRETLFVYVNSAFSPNPDELVIDLYNNFGFDGKLVVNYACSMA

SEQ ID NO: 12676 - protein, 96 aa, Arabidopsis thaliana
MATESSSPSSVRKVVVHLRATGGAPILKQSKFKIPGTDKFAKVIDFLRRQLHSDSLFVYVNSAFSPNPDESVIDLYNNFGFDGKLVVNYACSMAWG

SEQ ID NO: 12677 - protein, 96 aa, Chelidonium majus
MAAAAESPNSSRKVVVHLRAIGDAPILKQAKFKIAGSDKFAKVIDFLRRQLHRDTLFVYVNSAFSPNPDELVIDLYNNFGFDGKLVVNYACSMAWG

SEQ ID NO: 12678 - protein, 95 aa, Fragaria vesca
MSSTESPTAAKKVVIHLRATGDAPILKQAKFKIPGTDKFAKVIDFLRRQLHRDTLFVYVNSAFSPNPDELVMDLYNNFGFDGKLVVNYACSMAWG

SEQ ID NO: 12679 - protein, 94 aa, Acacia harpophylla
MATDSPGSVRKVVVLLRATGDAPILKQAKFKIAGTDKFAKVIDFLRRQLHRDTLFVYVNSAFSPNPDESVIDLYKNFGIDGKLVVNYACSMAWG

SEQ ID NO: 12680 - protein, 94 aa, Beta vulgaris
MASESPSAVRKVVIHLRATGDAPILKQQKFKVSGTDRFASVIDFLRRQLHRETLFVYINSAFSPNPDESVIDLYNNFGIDGKLVVNYACSMAWG

SEQ ID NO: 12681 - protein, 94 aa, Elaeis guineensis
MAAESPTSDRKVVVHLRATGDAPILKQAKFKISGNDKFSKVIEFLRRQLHRDTLFVYVNSAFSPNPDELVIDLYNNFGFDGKLVVNYASSMAWG

SEQ ID NO: 12682 - protein, 94 aa, Raphanus sativus
MATESPSSVRKVVIHLRATGGAPILKQSKFKIPVTDKFAKVIDFLRRQLHSDSLFVYVNSAFSPNPDESVNDLYNNFGFDGKLVVNYAFSMAWG

SEQ ID NO: 12683 - protein, 94 aa, Eutrema halophilum
MATESPSSVRKVVVHLRATGGAPILKQSKFKIPGTDKFAKVIDFLRRQLHSDSLFVYVNSAFSPNPDESVDDLYNNFGFDGKLVVNYAFSMAWG

SEQ ID NO: 12684 - protein, 94 aa, Chenopodium quinoa
MASESPSAVRKVVIHLRATGDAPILKQQKFKVSGTDKFASVIDFLRRQLHKDTLFVYINSAFSPNPDESVIDLYNNFGIDGKLVVNYACSMAWG

SEQ ID NO: 12685 - protein, 94 aa, Arabidopsis lyrata
MESSSPGSVRKVVVHLRATGGAPILKQSKFKIPGTDKFAKVIDFLRRQLRSDSLFVYVNSAFSPNPDESVIDLYNNFGFDGKLVVNYACSMAWG

SEQ ID NO: 12686 - protein, 94 aa, Arabidopsis lyrata
MATESPNSVRKIVVHLRATGGASILKQSKFKIAGTEKFAKVIDFLRRQLHSDSLFVYVNSAFSPNPDESVIDLYNNFGFDGKLVVNYACSMAWG

SEQ ID NO: 12687 - protein, 90 aa, Mimulus guttatus
MASETRKVVVHLRATGDAPILKQAKFKIAGTDKFVKVIDFLRRQLHRETLFVYVNSAFSPNPDELVSDLYNNFGFDGKLVVNYACSMAWG

SEQ ID NO: 12688 - protein, 90 aa, Nicotiana benthamiana
MASDSRKVIVHLRATGDAPILKQAKFKIAGTDKFIKVIDFLRRQLHRETLFVYVNSAFSPNPDELVIDLYNNFGFDGKLVVNYACSMAWG

SEQ ID NO: 12689 - protein, 94 aa, Allium cepa
MAAEIAGADRKVVIHLKATGDAPILKQAKFKIAGTDKFSKVIEFLRRQLHRDTVFVYVNSAFSPNPDELVIDLFNNFGFDGKLVVNYASSMAWG

SEQ ID NO: 12690 - protein, 90 aa, Capsicum annuum
MTSDSRKVIVHLRATGDAPILKQAKFKIAGTDKFIKVIDFLRRQLHRETLFVYVNSAFSPNPDELVIDLYNNFGFDGKLVVNYACSMAWG

SEQ ID NO: 12691 - protein, 90 aa, Sesamum indicum
MASETRKVVVHLRATGDAPILKQAKFKIAGTDKFVKVIDFLRRQLHRDTLFVYVNSAFSPNPDELVIDLYNNFGFDGKLVVNYACSMAWG

SEQ ID NO: 12692 - protein, 140 aa, Cannabis sativa
MTFLIGSNCAAYLRQFQVTVLFGLPGSISMGDECSPLLKGGVDETQIRVVFLYKDLTIPEPMRYWMVFSTCFISTLPERYRYLLRRSPCLFSSAVHALVHIPQEVGLAPVSSLTPSKVLSIVWYVGRASSVIISPTNATK

SEQ ID NO: 12693 - protein, 95 aa, Unknown
  Sequence found in Organisms: Brassica napus, Brassica oleracea, Brassica rapa
MAETESPSSVRKVVVHLRATGGAPILKQSKFKIPGTDKFAKVIDFLRRQLHSDSLFVYVNSAFSPNPDESVNDLYNNFGFDGKLVVNYAFSMAWG

SEQ ID NO: 12694 - protein, 92 aa, Fraxinus spp
MASETRKVVVHLRATGDAPILKQAKFKISGTDKFVKVIDFLRRQLHRETLFVYVNSAFSPNPDELVIDLYNNLALMVNWWLITLAPWHGGNH

SEQ ID NO: 12695 - protein, 52 aa, Nicotiana tabacum
  misc_feature (42)..(42): Xaa can be any naturally occurring amino acid
  misc_feature (45)..(46): Xaa can be any naturally occurring amino acid
  misc_feature (48)..(48): Xaa can be any naturally occurring amino acid
MGSWWLIMHAPWRGAENSWLFALHCFKSPYLVTTFSSSNRTXASXXSXIVLQ

SEQ ID NO: 12696 - protein, 94 aa, Eutrema parvulum
MATESPSSVLKVVVHLRATGGAPILKQSKFKIPGTDKFAKVIDFLRRQLHSDSLFVYVNSAFSPNPDESVNDLYNNFGIDGKLVVNYAFSMAWG

SEQ ID NO: 12697 - protein, 90 aa, Triphysaria pusilla
MASETRKVVVHLRATGDAPILKQAKFKIAGSDKFVKVIDFLRRQLHRETLFVYVNSAFSPNPDELVIDLFKNFGIDGKLVVNYACSMAWG

SEQ ID NO: 12698 - protein, 94 aa, Musa acuminata
MAAESPTAERKVVVHLRATGDAPILKQAKFKISGSDKFSKVIEFLRRQLHRDTLFVYINSAFSPNPDELVIDLYNNFGFDGKLVVNYASSMAWG

SEQ ID NO: 12699 - protein, 94 aa, Cirsium arvense
MASDSPIASRKVVVHLRATGDAPILKQAKFKIAGTDKFSKVIDFLRRQLHRETLFVYVNSAFSPSPDEIVNDLYDNFGFDGKLVVNYACSMAWG

SEQ ID NO: 12700 - protein, 90 aa, Ipomoea nil
MTTESRKVIVHLRATGDAPILKQSKFKIGGNDKFAKVIDFLCRQLHRETLFVYVNSAFSPNPDELINDLYNNFGFDGKLVVNYACSMAWG

SEQ ID NO: 12701 - protein, 90 aa, Lippia dulcis
MASEARKVVVHLRAAGDAPILKQAKFKIAGTDKFVKVIDFLRRQLHRETLFVYVNSAFSPNPDELVIDLYNNFGIDGKLVVNYACSMAWG

SEQ ID NO: 12702 - protein, 89 aa, Valeriana officinalis
MASDRKVVVHLRATGDAPILKQAKFKIAGSDKFVKVIDFLRRQLNRETLFVYVNSAFSPNPDELVIDLYNNFGFDGKLVVNYACSMAWG

SEQ ID NO: 12703 - protein, 94 aa, Ambrosia trifida
MASDSPIASRKVVVHLRATGDAPILKQAKFKIAGTDKFSKVIDFLRRQLHKETLFVYVNSAFSPSPDQLVNDLYDNFGFDGKLVVNYACSMAWG

SEQ ID NO: 12704 - protein, 94 aa, Eucalyptus grandis
MASDSPNSDRKIVVHLRATGDAPILKQAKFKISGAEKFAKVIDFLCRQLHRETLFVYVNSAFSPNPDELVNDLYENFGFDGKLVVNYACSMAWG

SEQ ID NO: 12705 - protein, 90 aa, Fraxinus spp
MASETRKVVVHLRATGDAPILKQAKFKISGTDKFVKVIDFLRRQLHRETLFVYVNSAFSPNPDELVIDLYNNFGIDGKLVVNYTCSMAWG

SEQ ID NO: 12706 - protein, 94 aa, Lactuca sativa
MASDSPIASRKVVVHLRATGDAPILKQAKFKIAGTDRFSKVIDFLCRQLHRETLFVYVNSAFSPSPDELVNDLYDNFGFDGKLVVNYACSMAWG

SEQ ID NO: 12707 - protein, 90 aa, Olea europaea
MASETRKVVVHLRATGDAPILKQAKFKISGTDKFVKVIDFLRRQLHRETLFVYVNSAFSPNPDELVKDLYNNFGIDGKLVVNYACSMAWG

SEQ ID NO: 12708 - protein, 94 aa, Raphanus sativus
MATESPSSVRKIVVHLRATGGAPILKRDKFKISGTDKFAKVIDFLGRQLHSDSLFVYVNSAFSPNPDESVIDLYNNFGIDGKLVVNYACSMAWG

SEQ ID NO: 12709 - protein, 90 aa, Vinca minor
MASEPRKVVVHLRATGDAPILKQSKFKIAGSDKFMRVIDFLRRQLHRETLFVYVNSAFSPNPDQLVIDLYNNFGIDGKLVVNYACSMAWG

SEQ ID NO: 12710 - protein, 95 aa, Echinacea purpurea
MASSDSPITSRKVVVHLRATGDAPILKQAKFKIAGTDKFSKVIDFLCRQLHRDTLFVYVNSAFSPSPDELVDDLYDNFGFDGKLVVNYACSMAWG

SEQ ID NO: 12711 - protein, 95 aa, Unknown
  Sequence found in Organisms: Citrus clementina, Citrus sinensis
MAATDSPSSTRKVVVHFRATGGAPILKQAKFKISGSDKFAKVIEFLCRHLGRETLFVYVNSAFSPNPDELVIDLYNNFGFDGKLIVNYACSMAWG

SEQ ID NO: 12712 - protein, 94 aa, Arabidopsis thaliana
MATESPNSVQKIVVHLRATGGAPILKQSKFKVSGSDKFANVIDFLRRQLHSDSLFVYVNSAFSPNPDESVIDLYNNFGFDGKLVVNYACSMAWG

SEQ ID NO: 12713 - protein, 94 aa, Taraxacum officinale
MASETPIASRKVVVHLRATGDAPILKQAKFKIAGTDRFSKVIDFLCRQLHRETLFVYVNSAFSPSPDQLVNDLYDNFGFDGKLVVNYACSMAWG

SEQ ID NO: 12714 - protein, 94 aa, Flaveria ramosissima
MASDSPIASRKVVVHLRATGDAPILKQAKFKIAGTEKFSKVIDFLCRQLHRETLFVYVNSAFSPSPDELVNDLYDNFGIDGKLVVNYACSMAWG

SEQ ID NO: 12715 - protein, 90 aa, Orobanche aegyptiaca
MASETRKVVVHLRATGDAPILKQAKFKIDGSDKFVKVIDFLRRQLHRETLFVYVNSAFSPNPDELVLDLYNNFGIDGKLVVNYACSMAWG

SEQ ID NO: 12716 - protein, 94 aa, Phalaenopsis aphrodite
MAAESPTSDRKVVVHLRATGDAPILKQAKFKTAGSNKFSTVIEFLRRQLHRDTLFVYINSAFSPNPDELMIDLYNNFGFDGKLLVNYACSMAWG

SEQ ID NO: 12717 - protein, 92 aa, Pinus taeda
MDPEASSRKVVVLLRATGDAPILKQSKFKIGATEKFAKVIDFLRRQLHRETLFVYINSAFSPNPDEAVIDLYDNFGIDGKLVVNYACSMAWG

SEQ ID NO: 12718 - protein, 301 aa, Mimulus guttatus
MAGSAPTISFFNSSSLYCNRAFDNFKHSRTFDKRLSFTCFSSKKKQLGFMDQILDYIEGGPKLRKWYGAPDILSKDGIESAENEAPEEDEVKDAVLVTDGDNEIGQMIILSLIVKRIRVKALVKDKRVAMEAFGTYVESMAGDTKDKAFLKKALRGVRAVICPNEGFLYNLESWKGIQHVILLSQLSVYRGSTGIQAVMNSNARKLAEQDENLVKASGVPYSIIRTGVLKDTPGGQQGFCFKEGSAAKGSLSKEDASFICVEALDNVPVKGLVFEVINGEEKVSDWKKCFATLMDMSSGEA

SEQ ID NO: 12719 - protein, 95 aa, Picea glauca
MNRMDPEASSRKVVVLLRATGDAPILKQSKFKIGATEKFAKVIDFLRRQLHRETLFVYINSAFSPNPDEAVIDLYDNFGIDGKLVVNYACSMAWG

SEQ ID NO: 12720 - protein, 68 aa, Fagus grandifolia
VVVHLRATGDAPILKQLKFKLLGTDKFAKVIDFLRRQLHRETVFVYVNSAFSPNPDELVIDLYNNFWF

SEQ ID NO: 12721 - protein, 92 aa, Pinus pinaster
MDTEASSRKVVVLLRATGDAPILKQSKFKIGATEKFAKVIDFLRRQLHRETLFVYINSAFSPNPDEAVMDLYDNFGIDGKLVVNYACSMAWG

SEQ ID NO: 12722 - protein, 89 aa, Artemisia annua
PIASRKVVVHLRATGDAPILKQAKFKIAGTDKFSKVIDFLRRQLHRETLFVYVNSAFSPSPDQLVNDLYDNFGFDGKLVVNYASSMAWG

SEQ ID NO: 12723 - protein, 94 aa, Euphorbia peplus
MAGESPSSGRKVIVQLKATADAPILKQNKFKIDATDKFAKVIDFLRRQLHRETVFVYINSAFSPNPDELVSDLFNNFGVDGKLLVNYACTMAWG

SEQ ID NO: 12724 - protein, 94 aa, Fagopyrum esculentum
MASGSSTAVSKVIVHLRATGDAPILKQAKFKISGADKFANVIDFLRRQLHRETMFVYVNSAFSPNPDELIIDLYNNFGIDGKLVVNYACSMAWG

SEQ ID NO: 12725 - protein, 89 aa, Prunus persica
GFQFGPVVVHLRATGDAPILKQAKFKILGTDKFAKVIEFLRRQLHRDTLFVYVNSAFSPNPDELVIDLYNNFGFDGKLVVNYACSMAWG

SEQ ID NO: 12726 - protein, 94 aa, Helianthus annuus
MASDNPIASRKVVVHLRATGDAPILKQAKFKIAGTDKFSKVIDFLRRQLHKETLFVYVNSAFSPSPDQLVNDLYDNFGIDGKLVVNYACSMAWG

SEQ ID NO: 12727 - protein, 98 aa, Amorphophallus konjac
MAASTAVDSPLSTRKVVIHLRATGDAPILKQSKFKVAGSDKFVKIIEFLRGQLHRDTLFVYVNSAFSPNPDELVIDLYNNFGFDGKLVVNYACSMAWG

SEQ ID NO: 12728 - protein, 98 aa, Zostera marina
MAAIVPESPNSSDQKVVVHLRSTGDVPILKQSKFKIAGSDKFSKVIDFLRRQLHRDTLFVYVNSAFSPNPDEFVIDLYNNFGFDGKLVVNYASSMAWG

SEQ ID NO: 12729 - protein, 83 aa, Centaurea maculosa
VVVHLRATGDAPILKQSKFKIAGTDKFSKVIDFLRRQLHRETLFVYVNSAFSPSPDEIVNDLYDNFGFDGKLVVNYACSMAWG

SEQ ID NO: 12730 - protein, 94 aa, Echinacea purpurea
MASDNPIASRKVVVHLRATGDAPILKQAKFKIAGTDKFSKVIDFLCRQLHKETLFVYVNSAFSPSPDQLVNDLYDNFGIDGKLVVNYACSMAWG

SEQ ID NO: 12731 - protein, 87 aa, Brassica juncea
SVRKIVVHLRATGGAPILKQNKFKISGTDKFAKVIDFLGRQLHSESLFVYVNSAFSPNPDESVIDLYNNFGIDGKLVVNYACSMAWG

SEQ ID NO: 12732 - protein, 94 aa, Populus trichocarpa
MATESLSSARKVIVQLKATADAPILKQNKFKILGTDKFAKVIDFLSRQLHRESMFVYINSAFSPNPDELVIDLFNNFGVDGKLLVNYACSVAWG

SEQ ID NO: 12733 - protein, 94 aa, Populus trichocarpa
MEIESQDSARKVIIQLKATADAPILKQKKFKMLGTDKFAKVIDFLRRQIHRETVFVYINSAFSPNPDELVIDLFNNFGVDGKLLVNYACSVAWG

SEQ ID NO: 12734 - protein, 82 aa, Papaver somniferum
VVHLRATGDAPILKQAKFKIAGTDKFAKVIAFLRRQLHRDTLFVYVNSAFSPNPDELVNDLYNNFGFDGKLVVNYACSMAWG

SEQ ID NO: 12735 - protein, 94 aa, Senecio madagascariensis
MASESPITARKVVVHLRATGDAPILKQTKFKIAGTDKFSKVIEFLLRQLRRDTVFVYVNSAFSPSPDEVVNDLYDNFGFDGKLVVNYACSMAWG

SEQ ID NO: 12736 - protein, 94 aa, Silene vulgaris
MASESPTVVPKVVIYLRATGDAPILKQQKFQVSGNDKFARVIEFLRRQLHRDTLFVYVNSAFSPNPDELVSDLYNNFGIDSKLVVNYACSMAWG

SEQ ID NO: 12737 - protein, 88 aa, Eutrema parvulum
IFSVTVVVHLRATGGAPILKQSKFKISGTDKFAKVIDFLGRQLHSDSLFVYVNSAFSPNPDESVIDLYNNFGFDGKLVVNYACSMAWG

SEQ ID NO: 12738 - protein, 90 aa, Solanum tuberosum
MASDSRKVIVHLRAIGDAPILKQDKFKIAGTDKFIKVINFLRRQVRRETLFVYVKSAFSPNPDELVIDLCNNFGFDGKLVVNYACSVAWG

SEQ ID NO: 12739 - protein, 100 aa, Cynara scolymus
GGQNRFLASDSPIASRKVVVHLRATGDAPILKQAKFKIAGTDKFSKVIDFLRRQLHRETLFVYVNSAFSPSPDELVNDLYDNFGFDGKLVVNYACSMAWG

SEQ ID NO: 12740 - protein, 443 aa, Vigna unguiculata
MGLESVGDLAINAILRKLEAEDIARVACASKRFRSFASDDTLWINLCFNELALTQPIDHLGNPFPSFKECYQAWRKAFGMYPWFLVKRVKRCWDRIKTWLTNNFPEAEATLCKGATEADIQMLENLLKVELPLPTRILYRFNNGQEIVKANLEASTFGSCLGLIGGYSFYNHLVNVYLLPVHQIIRETQQIWRHLNFLRTSKFVLVASSSTLRRKLFFLNCSNGQLYVGTNKLRSEKDIIPCVPQDLISLHQESNGEEQQDAMLLWLEEHGRRLEHGFIKLCENEYGRSINLFPEESPFCSTAVTNGVKVRSSALVIPEFIDPQDDSEKYLFAYSIRLSLEPQGCLINGMSFDSCQLHWRRWIIRANDDVVSDVNGEAVIGQYPLLHPGGQEFVYQSCTPLPTPSGSIEGSFTFIPGSLAYPKGDPFLATVAQFPLQLPDYIF
